United States Patent 10,147,505 (METHODS OF ASSESSING A RISK OF DEVELOPING NECROTIZING MENINGOENCEPHALITIS) - sequence listing, part 2

SEQ ID NO: 1 - DNA, 4121701 bp, Canine spp. (residues 2,060,852-4,121,701 of 4,121,701)
  misc_feature (47680)..(47775): n is a, c, g, or t
  misc_feature (51930)..(54842): n is a, c, g, or t
  misc_feature (69336)..(69631): n is a, c, g, or t
  misc_feature (77302)..(77881): n is a, c, g, or t
  misc_feature (372046)..(372208): n is a, c, g, or t
  misc_feature (415822)..(416054): n is a, c, g, or t
  misc_feature (447511)..(447647): n is a, c, g, or t
  misc_feature (597085)..(597159): n is a, c, g, or t
  misc_feature (932668)..(932722): n is a, c, g, or t
  misc_feature (1112563)..(1112670): n is a, c, g, or t
  misc_feature (1121582)..(1121791): n is a, c, g, or t
  misc_feature (1125670)..(1125886): n is a, c, g, or t
  misc_feature (1128841)..(1130039): n is a, c, g, or t
  misc_feature (1133950)..(1134022): n is a, c, g, or t
  misc_feature (1142791)..(1143414): n is a, c, g, or t
  misc_feature (1302167)..(1302167): n is a, c, g, or t
  misc_feature (1485108)..(1485411): n is a, c, g, or t
  misc_feature (1511373)..(1513902): n is a, c, g, or t
  misc_feature (1525812)..(1527173): n is a, c, g, or t
  misc_feature (1551312)..(1551355): n is a, c, g, or t
  misc_feature (1557346)..(1558099): n is a, c, g, or t
  misc_feature (1661044)..(1661297): n is a, c, g, or t
  misc_feature (1664024)..(1664587): n is a, c, g, or t
  misc_feature (1665318)..(1665425): n is a, c, g, or t
  misc_feature (1673704)..(1673837): n is a, c, g, or t
  misc_feature (1742657)..(1742657): n is a, c, g, or t
  misc_feature (1818640)..(1818997): n is a, c, g, or t
  misc_feature (1820864)..(1822549): n is a, c, g, or t
  misc_feature (1823227)..(1823834): n is a, c, g, or t
  misc_feature (1826090)..(1826090): n is a, c, g, or t
  misc_feature (1841658)..(1841792): n is a, c, g, or t
  misc_feature (1864584)..(1864584): n is a, c, g, or t
  misc_feature (2039695)..(2040344): n is a, c, g, or t
  misc_feature (2053185)..(2053396): n is a, c, g, or t
  misc_feature (2055020)..(2055044): n is a, c, g, or t
  misc_feature (2245964)..(2246041): n is a, c, g, or t
  misc_feature (2313152)..(2313586): n is a, c, g, or t
  misc_feature (2595493)..(2595660): n is a, c, g, or t
  misc_feature (2603699)..(2605049): n is a, c, g, or t
  misc_feature (2673369)..(2673427): n is a, c, g, or t
  misc_feature (2683838)..(2683838): n is a, c, g, or t
  misc_feature (2762679)..(2762696): n is a, c, g, or t
  misc_feature (2768337)..(2768716): n is a, c, g, or t
  misc_feature (2781178)..(2781404): n is a, c, g, or t
  misc_feature (2809171)..(2809188): n is a, c, g, or t
  misc_feature (2866169)..(2866288): n is a, c, g, or t
  misc_feature (2872438)..(2872632): n is a, c, g, or t
  misc_feature (2874651)..(2875352): n is a, c, g, or t
  misc_feature (2919729)..(2919729): n is a, c, g, or t
  misc_feature (2973352)..(2973391): n is a, c, g, or t
  misc_feature (3065733)..(3065783): n is a, c, g, or t
  misc_feature (3121383)..(3121484): n is a, c, g, or t
  misc_feature (3150472)..(3150472): n is a, c, g, or t
  misc_feature (3153643)..(3153849): n is a, c, g, or t
  misc_feature (3159627)..(3160516): n is a, c, g, or t
  misc_feature (3168272)..(3168487): n is a, c, g, or t
  misc_feature (3267063)..(3267072): n is a, c, g, or t
  misc_feature (3367561)..(3367671): n is a, c, g, or t
  misc_feature (3437432)..(3437847): n is a, c, g, or t
  misc_feature (3439000)..(3439498): n is a, c, g, or t
  misc_feature (3447319)..(3447617): n is a, c, g, or t
  misc_feature (3527217)..(3527268): n is a, c, g, or t
  misc_feature (3598312)..(3599438): n is a, c, g, or t
  misc_feature (3639070)..(3639602): n is a, c, g, or t
  misc_feature (3759074)..(3759360): n is a, c, g, or t
  misc_feature (3908098)..(3908320): n is a, c, g, or t
  misc_feature (3915608)..(3915608): n is a, c, g, or t
  misc_feature (3917868)..(3917868): n is a, c, g, or t
  misc_feature (4015567)..(4015759): n is a, c, g, or t
  misc_feature (4024564)..(4025110): n is a, c, g, or t
  misc_feature (4077020)..(4077113): n is a, c, g, or t
  misc_feature (4084691)..(4085160): n is a, c, g, or t
ggagatgacgagggctggagctgactccagagcaatcaagagtgttttggggacaggtcaacttgttgggcatccagatgggatgctgaggagatggttggatttatcaggctggagttcaatgcccaaagttggggctggaaatacacaagggggacatttaaagccataggcctaggggagatgacttggagaatagatgtgcccaagggagaaaaggggtcccagggctgagccctgggtgcataggtcagtagagagccaaggaaagatggcagtgagagtgtggtgtcagaagcagaaaggccaccatgtcagggctgatggggctggggctttggtggtgccggccagtggtgaccagggagggccagagcctgactggggggtctttgggaaggagggcttgtggatggccttcccagagcatcccctgtgaaccatgggagcaggcccatggggcaggaactgagggcagtgtgcagttctggggggggggggctttatttttttaattttcccttggtgagaaaagagttgatatggggggaaccctgatcacatgggagggagatcatcgtggctggaaagccaggagggcaagggctagcgcctggtgcgagggaggcaaagcttggggtgagtgggggcagagcgagtgcaggggtgttttcggcagactgctcccattttctcccgaaaacagcaccggcgtcagctggagcgaagaaggaggaggtgttgtgaaacattggtctccgtggcagttctcacagccaccgtgttaagtaggtgctgtcatcccgcttcgcagaaaatgagaaatgagaaaatgggcctgagggtgacttgtcaggaagggacagggtcgagatttgatcagagtctagtggatccctaaggcactccttgggatgtttgtacaggagtgtggacttcaggttgagtctacatcctgcccttgcagcctccccttcacctgcagggggagccgggggcccagacaggggagatgactgctccaaggtcatgcagagtggctcagggcagacgcagtggactcctgtgagcccaccctgggccacgaagccagtgtcatctggcctcatatgctgccaccacacagcgatcatgatggctgtttgggcctctgggattgatatctatttggaccttgtgtctaatagcccttgaaaggcctgggttttcctccctccccagtgatgcttaccccaataaatggctgtgtaagtccctaggggagattggtcaaatcattatctggggtcaccggtctcttcctctgggggacctggtctctactgcagtcacttgggtctgaaaccttgctcaggtctggaaatggggcagaggatcatgacttttattgatcatcaggccttgctttcttttgattatctagagtgggcggggttcttgctggctgcccatgggcttgcccttggggccgccggattctgttaaccatttccatagcttggtggctcaggccatcccagctgtggctccgaccttgccaggaattatgattttgcacccaccttggttctgacgagtaagtgctgccacttggcctcttattttggggcactgtcatctcattgctatctggacacccagttctgtaacgacagctcctagtctcggtcttcaaggacactcacccctaagctcgtcgggctgctgggcctgctcaggccactacctcccttatggctttggcaaagggagggtccgtcagtcctacaggaggtagacagacctctggtgggctttctggcctgactgacctatccactgactgcgcccgcttgtccgaggctctgcccccatcttctagggtgacacggcaggcctggcatctctgcctctcacaccgtgatcggtgctgtctctctctcttatatgtgggattcttcattatccagcctcttggcccccacactccttgatcccgccctcggatggcacccgaatgctcccctggtttctgccagggcacggtggccccatctgcagccgggccgaggtgtgtcttaccctggtcattgggctgggccccagggtggggtgggggtggggtgccgatcccagggaggatcctcagcaccatcttcaacgtgaaagcatgcttggctctgagggggtcacttccaaggcccacccctcccaagcaaggcctgaccttggtgccaaagactcattgtgggctgagaatccagcctgctctgatattctgctccccttgtcattaagccctgcctctattcctcagcgattccctcaccttcagctgcgggggagaatttatatgctgctaaggaggccgttggctttcacacttggccttgaattagtgattcatcactctagcctttcactgtctttctctggggcacaagaacctccagcaatagccggcccatttcactttcccaggctttgtaattactactcccccaacctttccaactctagaggcattgccccttcagcttgctcccttccacctgcagcccaggaaggtgttaacaagcttcactgctgcaggctgctggtacttctcctacccagccgaggtgctcactgccagccaccagagggggacccaggactgggcagagagggagaagctgaacacaggcctcacttgaccccagagggggctctgagtctgccggggtacttcacatctgtcgtcctttgttagggagatggatccaggcctggtggcaaccagttattggatgtgagctgcctgcctggagcgttttttgtaaggtggagggaagatcttggggaggcaccaagagttgtcagcagtgggcagcacgggtggctcagcggtttagcgtcgccttcagtccaggatgtggtcctggagacccgggatcgagtctcatgtcaggctccctgcatggagcctgcttctccctctgcctgtgtctctgcctctctctctctgtgtctctcatgaataaaaaaaaaaaaaaaaagaattgtcagcagtgaacactccctgaagctggggtaagggaacctttggcctgaagccactgcatacagtttagttcatctttccgctgtcagtggaaatttgggtggtgtggggctaatacaaataccacccagtgagcattcatgcttggcgctctggcggccgtttgcactcatcaccgttgggcatacacccaaaagtggaagtgttggcctacagtatgcatgtagcgaactttgctagatttttcccagtggttttccaagctggccatttttttctttttttttttttttttaagatttaaaaaaattatacatttgagagagcgagagcacatgagtgagggggaagtggcagaggcagagagagagggagaagcagactccctgctgagcagggagcccaatgtggggcttgatcccaggaccctgagatcatgacctgagccaaaggcagatgtttaaccatctgagccacccaggtgccccaagggggccattttcaactaccgggggaggtgttgttctgcatcctagccagcacttgaaaccatctgtccttttattttagccattgtggtggtccagacagcactgattcttacgtgcagtcatggtggggagctgctgctccctggtgggtggatggatgtgagatttggagaacctggaccacccccacctgactgtacctggtacccacttctaggggccttcttcagatactgacagatgcattaaaacattatcaggaaataacaccgtcacatgacttggtttgtccaactcctttcagcctgagattccagttctgaagggtcatgggaaggaaacaggtaagcttgctgccaggtttatgcggggtctcctgaggacaccaggaggcagcggcagtgactcactctgtctagtggttcacagtttccaaaatgctttctcattgtagctcccctgggcctcacagcagccctcacattcgtggcaaagtgagccatgcacctagcgatggactccaagtcatgggtcctaactttacatcttactggcctgtgacccccctcccttccttgagaaagcagctcaggtgggctttcactcctctccccaatttcctcgtcctccacttgttttatgagggacccctgcctattgcccgttaatgttctctcagaagcaagtaattcccggggctctctggggctaactgctaattgggctggagcttctgatgggttcagaagtgtcctggggactttgctccaagattcagagtcagaggatctggtgggcccaagattctgcatttctcacaaacatccaggtgatgccagtgctgctggtccacagaccacactttgagttgtgagagttagaccattccccagttgtgggctgtgcaggcaggtctctgttctgggcttgacatcccccatggaactcaggcagacactggttagtaaccatctggattctggcaggagtgctagttacggcaagttcaagcctccctctggtttctccaccatgagacataccagtcaagtcatctggctcagttaaaagccccttactcttactacctgtctcaggagcatctctgttccctccctcttcctactttcttctttcttcaacactcctttttcttttttggggggtggggcttaaatcttaacacattaatcttaaatacataaatcttatgtatttgtgtgtgtgagagagagagcgcgcaatcagggggaagggcaaagagagagagggaaagaatcccaagcagactcttccttgagtggggagcctgacatgggtctcaatcccacaatccatgagatcatgacctgaactgaaaccaagattcagactctctactgactgagccactgaggctcaacactcctaattcccaccctcgtcttcccctaaatgggcagaatgtcagctagacattaagcagaaaggtggctaagtaaacttctttatactaaagtgtgaatgacccacatctcttcccttacctcttccaggggttatttagatgtgaaaaagaaggtgctttgggttgttggaaaagtcaacagtgagggaaagatcagagactattcagggattatttcctctgccctctaatgtttcctaagcttaggcttgttattgaaatcatatgagggaacttttaaaaaataaaacaaaacaagacagggacacttgggttttaccgcagatccgcagactcaagactctccagagtgggtactaggaatgtgcattttctttgaaagagatttttgtcccacatccaagtttagaaactgcttccctaaattataccatgggtgctactcgtgtatccatttcccctctgtttctagaggagaatgactcagagggtccttctatctcacccaggaaactgctgagtgggaataaaggggacccagatgagatgtgagaggctaagctcccaccagaactcagtgaggaggggcctctgtttgctcacctctgcaatgggactgaagccagccacctgcagcccaccctgtggttgtcgctggagagtggagaggcctcaggttgtgcagttgcagcagattatgcggagggacaaaaggcagccctggggtggggggacgggggaggcaagaaccaaagtccattgggggctcagcacctgcactgaagcctggtcacagtggctcgctgaggattgttgctgtggtaatcatgaagattgcacaggcaaagggattccactttacattctgctcccttgcagaggtcatctgtagttgcctgaattcctccctgtagtgggtaggagactgcggtgggggcccctcagggaggggtgtctcagggttgcaggcccaagcttagggggagggggaccagagcccctgggggcggcctcaggcagcctgaggtgggtggcaggccactgaactcgcttgccgctgtgcagaagcctcctcctccaggatgcacctgggctccctaccgcactcttagttgaggtggctgcagctcggggcacctcgtgcttaccgagtcatgtggagcctgaggccagcgtggtgatctgacctgcccatcagtccatctggaagactcagtcccggttccccctcagcctgacatcctgtggggttggctttgtgccatcacccaccttctctggttgtctttctcgacaagagaaaggagatgcaggggctctgggaggcaccttccagctctggggcccaggaatccagcatctgtttccaagttttgcagaagatttgtgcgtagctttggagtgggacagaatagagtttcaatcctggctcattcctgctgtgtgatactgggccactgattttacctccctgatccccagtttcctctttggaaaaatagagataatggtataatggtatccatctcttagggtcgctgccgagattaaaggagataataatgaagaaatatctagttggcactattgactgcttcttccgtgtcaggcatggttccaggggcctttcctggcccagatcacgaaatcctcccagccgccctgtgtgccaagtgctgctgttatcccagtttaaagatgaggaaacacgaccctggaaagcatgagcagataggctcctggcagacggtacaattatttctttttctttcttccttgggaagtttctccagcaggtcttccccatttgccccaggtatactcacccatgtgcctctgctggagctcctcctcctgtgaaactctccttcctatctgtcccttcaaggctgaaccccagcctgtctccaggcagccctccctgcagccggacctctctgattccgtggtttggacagcctgtctcatgctatttggcaccctattaccatcttactctgtggcttctccagagtctacacctgttcccctggagctgaccttgtgaccagatcttatttatctccttagatgcacctgacatagcgtggagaaccatgtgtttaaaaagttctagggccagaatctcccacagtcaccccaggcccagcataaaccccattgaatacttccatgggcctcacctttgctagaaactcagccgagaccaatgcaggctgacctgggactaaaatttcagggcagtaggacattggttcatagcccaggatgtgtttgggaaccatttgaggagcttttcttttcactgatgcttgggccccaccatagagatcctggggtatagaaggagttttaaaagtgtcctaggcagggacacctgggtggctcagcggttgggcatctgccttctggctcagggcgtgatcctggagttctgggattgagtcccacatggggctccctgaggggagtctgcttccccctctgcctatgtctctgccttctctctgtgtctctcatgaaaaaataaataaaatctttaaaaaaaaataaaagtgtcctaagcaagaaaattggatagccgcatgcaaaagaatggagttcgacccttactttaccaccatatacaaaaattcactcaaatggatcaatggcctaaattgaatcaatagaactaaaaatataaaattcttagaagcaaactcagaagggagtcttcatgatgtcgaatttggcaatgatttcttggatatgataccaaaagcatgggcaacaaaagaaaaaataaattgaactttataaaaatttaagacttttggggcacctgggtggctcagtcatttaagcatccaactcttgattttggctcaggtcatgatctcagggttatgagatcaagccctgtgtcaggctccttgctgggcagggagcctgcttaagattctctttctccctctgcccctaccccctataaaaaaaattaagacttttgcgcgtcaaaggacatcaagagagtaaaaggacaacatacagagtgggagaaaatatttgcaaatagtatgtctggtaagggattaatattcagaatatataaagaactcctacaactcaacacaaagaaccaggaacctggtttaaaaataagcaagggatttgaatagatattcctttaaaaaaggagatgcaggtggctaataagcacttgaaaatgtgttcaaccgcattaattattagggaaatgcaaatcaaaactacaatgagataccacatcacacccattaggatggctattattaaaaacaaaaaacaacaacaacaacaacaaaaaacaaacccagaaagtaataactgttggtgaggatgtggataaattggaaccccttctgcatggctgatgggaatgtaaaatggtacagctgctgtggtaaaacagtttggcagttcttcaaaaagttaaacacaggatatgaccaaaattccacttctgggtatctacccaagagaagtgaaagcaggaactcaaaacagatactgaattacagagttgatagcagcattattcacagtagccaaaaggtgtaaacaacacggcgtcccttggtgggtgaatggataaagaaaatggtgcatatacatccaatggaataggagtcagccttcaaaaggaatgaagtactgacccatgctgcaatagggatgaaccttgaaaacattaagctaggtgaaagcagcgagacataaaagatacattgtgtgattccacttactatgaggtggtccctggatgaggcaaattcataggcatggaaggtagaacggtgattaccaggagctgattgaagagggaggacagggagtttattaatgaggacagagtttcagtttgtgatgatgaaaaagttctagagatggattgtagtgatgtttgcataacaatgcgaatgtacttaattgtatacttaaaaatgtttaaaatggtaaattttatgttatgcatattttaccacaatcttttaaaaaaagtgttccaggtaattctgatgtgcatctggatttgaaaagcactttaagaggagctagcagattgtcatgaaagtgatagttgcagttaagtattacatgtgcagtgatagacatgagtatgtatgtgggaaaactgggtatgtctgtgtagaaaggtcaggaggtcaggggggattttttccccccgcacaggtaggctgctataatgattagaaggtcagttctaggaccagactatttggtttaaaatcccacctagttctgtgggttttgtgcagtaacttgggcaggttactgctatgtgcctcagtttcctcatctgtaaaatagggattctaataatgcgtgcctaatagggaagctatgaggctaaacaaggtaattcatgtagaacatttataaaagagagtatccatttagtgaatgttaactaatgttgggcgcctgggtagctcaattggttaaatgcctgactcctgatttcagctcaggtcatgatctcagggtagtgggatcaaacactgggccaagccctgcatcagactccccactcagttgagggggtctgcttgaggattctctctcttcctctgcccctgcccccacttgcatgcaagcacacactctctctctaaaataaattagttaatttaaaaaatgttaactaatgtcatggtaatatgaatatacggtaatttattaatttccccaactagggacctttaggtcatttctcccttttctgatgtagcaaaactgcaaaggacatttttatgtttgttttcttgaacatatgtaagtttttctcaagagggtatgccattaagtggaattcctaagttacaggtatgggcatggtcagctttatgagacatggccacaatgttctctagtgctgggaagactgttggggtcctcttgaaagaattacttcaatgtgatttaaatgtgtaaatcctgtgttcaggtgtgttagctgcatagatggtaacagttgggatgtcagtaacagaaaaaaacaactcaaaatggcttaagccattgtttctcaaattttattgtatatacagtttacatattacctgtgaaaatataggctctgagtcagtaggtcccagagtgtggggtggggcctgagattccccatttctcacaagctctcagataatgctaatgttgatggtccatcaaccacacttgcagtagcaagagttcttaaactggggacacttgagtggcttggtgattgagtgtctgcctttggctcagggcatgatcctggggtcctgggatcaagtcctcgcattgggctccctgcagggaccctgcttctccctctgcctgtgtctttgtgtctctctgtgtgtctctcatgaataaataaataaaatcttaaaaaaaaaagttctcaaacttgattaaatgttgaaacacctggtgaaactttaaaaaaatactggttcttggattgtacactcagaggttctgacttaattgatgtgagaggagtcttaaagcttcccatgtattctaatgggcagtaaaatttgggaactacttgcttaaactaaaaggaaatcttgctatcttgctcatcaagatttcatgaggttaaccctagtatgagttctgtgactcaaccaacatcaggaacaagctttctatcttcagtgggtaggtttggccctcaagctcctgggagcacaaaatggctgctacagctccagacatcacatgcagactccacaatgtctgagaagacaaatgactatttctttccaagtgcctcttaccatcaacaaggaaacctttcctggaagctctttccctctggtctgattggccagggggaacaggagtgccacaaatggcttagacccgtggttctctctcttttttttttaaagatcttattaattcatgagagacagagagacgcagagggagaaacaggctccatggagggagcccgacgtgggacttgatcccgggtctccaggatcacgccctgggctgaaggcagcactataaaccgctgagccatctgggctgccgggaccaatggttctcaaaatgggtccctggactaggagcttcagcatcacctggatgcccagtagaaatgcaaattctccaacccaccacagacctattgagtcagaaactttggaggtaaggcccaggaatctgtgttttatcaagtccacaggcagagttcataccttaggccagaggttctccacctgagttaattttgtgccccaggagacatttggcaatgtttgcagagtttttggttataataactcagagtggggctgctgctggcatccagtgagtagaagccagggatgctgccgaacctcctacaatgcacaggacagcccccaacaaagaatcaccagctccaaatctcggtagtgctgaggtcgagaaagcctgccctaggccattcaggcattcttctgagtctcataaagcagctggggctccaatcagcaagtgcaaaggaggaccagctgtgggttagacaaccagcagtgtcggctgctaaaaattactttcacaataaatcagacagccccccacccttcccacactgcccccttgcagaacagccttttagaaatagctgcacggggcttgcagggtcaaagagatttctgtttgtcaggatgagccaaggcccctggctctccttctttgagggtgcagggagccctacggggccggttctgagtaggggccatacttggtggcttagcctagatactattggtcaggcaattctatcaagaccttagtcatctttttaaaaaattttatttatttatttgagagaatgagaaagagaacatgagaggtgaaggtgggggcagagggaggggggaagtaggctccctgctgaacagggagcccaacacggggctcgatcccaggaccccaggatcataacctgggccaaagacagatgctcaaccaactgaaccccaggcaccccagtcatctttctttaaacatagtacatgagggatccctgggtggcgcagcggtttggcgcctgccttgggcccagggcgcgatcctggagacccgggatcgaatcccacgtcgggctcccggtgcatggagcctgcttctccctctgcctgtgtctctgcctctctctctctctctgtgtgtgactatcataaataaaaaaataaataaataaacatagtaaattactttctttttctttttttttttttttttagtacctgactttcaaggttggctgtatcctggggagcctagctggctcagttgtagagcacgtggttctttatctcaaagttgtaagctcaagccccacgttgggtatagagattacttaaaaataaaatctttaaaaaatatggttggctctatccctaagtgtgatttttgcactgttctggagccaatttttttttttttttgaaaaaaaaaaaaaaaagaaatgcagttccatcacatcctatgagcagtagagcacctagaatttgatgtgtaggagctctctttttgggtcccgtcaaatgtgtcgtgttggacatatctgcatttgtatctttttaaaaggttttatttatttattttagagagagagggagagagattggggggaagggtagagtggagctcagttattttgaatattaccaaaactgtccccaaactgagcatttctcagactgaggcagtacagtccagccagtgcctcagaatgcttcgctttgggtgggagttttatcctttcagcatagaaatgttggtaatgccttgctgatcagaaactctacctggtaattaattgagtcaggagtaatttgtggtttagcttaaaaaaaatttctcagctcgtgcagtttgttagacaagagtctttccaaacgtgaagcttcttgggtgaagaaatatgtaaagggtccctcggtggtgcagagattgttcatctggtcccaccggctcactttgaggacagcagactggtaccccaagagggagtgccctgtgcaaagtcacctggctggactggggctgagtcaggactcagagccacagtcccacccttactggagaagccactatctgaacagtgttcctgtgacccagtgtgtggatctgctctgggctgtccacctccgcctcctccaagacagtgattgtgtctgtgacattccctttgatcaatgactagaaccagcggggagactgagaagcctctttgatgttggtgttacagaataggtgtaggaatagggtaggaagttcttgcagtgcggtcactggaacgcctgtatccccctcacagtggggatttacctggaaagaggtaaaaaaaaaaaaaaaaaaaaaaaaagcaaatccaggggatgcctgggtggttctgtggttgagcatctgtctttggctcacggtgtgatccctggggtcctgggatcaagtcccgcatcgggctccctgtgaggagcctgcttctccctctgcctgtgtctgtctctctctgtgtctctcatgaataaattcttaaaaatgcaaatctgaggacacctgggtggctcagtggcatttaaatgtctgcctttggctcaggtcatgatcccagagtgttgggatccctcttcctctgcctccttgtgcacgtactctcgctctctctctctcaaataaatatataaaatcttaagaaaatgcaaattcgtgggccccatcactgacttaactgtggtctgatacattggtgctccctgctgtcacctgtgaaccccacctcccactatgtacaccctggtgtagcaccttccctccctccacccttctcccctcccccattgactctgggtttgctgtgtgacctgctatgggcaatttgacgttggccagcttgagagaagcagagggttgatagataagataacttgaaagacaagttgcatgctggaacttgtacttttcgaatgtctgctcttagagccctgagctactatgtaagtaggtcttaaggtttcctgctggagagaccacagcctgggggaaaagacatccctcccctggggggatggggactgcctggattagctgaggccactcacgggaatgaagaagctgtttcggacactgcagccccagctgaggccactgtagaagagacaatcacccaggtgaacccagccaagccacagagttgcaaaatacaataaatcattgttttaggtcgctaaattctgaggagctttatcatgcagtgacataactgaaacccctgctagatcagaatctctgtggctggggccagaatctccattttatccaaacctccagatggttctggtgcttccctaagccagacaacccctgggaggggaaagagcctgattcagatcaccatgagctatgtggtttcagacaaattccttagtttctctcattctccttttccttgtgggggtaagtacagactccagagattcatggagaggagcaatttttgcagtcactactttgaagactttcagcccctcacccttagtcctgcccacccacccccctaacaacaggaatgttggctcttttgttatgagcctaagggcccagaggctctgttcattcctccaccctgtccatcctcactctgttggcagattgggtcatttctattgttttatcttcaagttcacagattctttcctctcttgtctccaacctgctgttgagcccctccaatgacctttcagttctaaagtttcagtttgattctccttcgtatcttctgtttctttgctaaggctttctattttgtttgttatttgttctagggtgttcatgcttgtggaagcctttttaagattgcagctttaacttccttgtccgatgattccaatatttgtgtcatcttgctgttggcatatgttggttgccttttctcattcagattgagattttttctggctcttggtatgacagatgatttttctattgtatcctggacattggggtattatgagacactggctcttattcaagcctcctgttttagtgggtctcctctaagactgcctgttgatgccagatgggggtggaagtccgtttcccccacttgaactcagctgacaacctggtgggggagaagacttcctccttactgctgggtgggaatgggagttctcattatccaccagacctccactgatacctccctgcctgggaagagaggggtagctcatgattgctccctgtgtggtcttcactagtgaggatggtgaaggtcctaactgggtttcctaggcccctacccagtgtggcgggtactgttgggtggggatggaagtcccagctccctacctgttctctgtaaccacctggtggtaggggaatggggtcctgattacaaccaggcacagctctccactcagcgtctggtcatgtagaggggatggggccacagtttttttctatagtgtttggctagagtagggcatttattgttttcaagattttgtcttgctagactgcctttcccagtccttgagatagggagaagatgcttttcttaaggctgtttttgtccatgctcattggtatttctgggttgctgacttctccagctccaaatctgagatatttggggcaataaagaaaacccagagaactcactgctgtgttgctccttgggtcttccttagtctactttcttctctcccttttgagagtctttgtaagtttgttttatatataacatccagggcattagctgtacttcacaggagaagtaggaaaaagtgtatctgcttcatctggcccaggaaccagaagccaagatttacctgtttttgaacttcatgtagatagaatcactacagatgttctttaagcttggcttcccttgctcagcatgatgtcttgagattgaccatgtggttgtgtgtagtctgatgttttttattgctgtataaggtttgataaccttatacaaaccacactgtggaatttacccagtagaatcctatacagcaatgaaaaaacaagctacctacttttactgtgcagtaaaccacacaatttgctgatcagcccttctgtagatggcatctgggttgcttccagtttggagctattataaacagagctgctttgaagagaatttgctgttatgaacaaatatttttggacgtgtgttttagtgcccacagaactcctttctgttggaaataaatatttcaaaacctcttaactggtttgcttctttagcccttgcctcctcctactcacttttccacataaaagccacagcgatcttttaaaaacataaatgggatcccgttttccccttgttcaaaaataccaaaggctttggggcatctggctggctcagctggtggtgtgtgtgactcttaacattgaggttgtgagtttgagtcccatgttgggtatagagattacttaaaaataaaatcttaaaaaatatatcaatggcttctcttcatacttagataagatggtaggggcgcctgggtggctcagttggttgggcgtctgccttcagctcaagtcatgatcccagagtcttgggatcaagccccacatcaggctccctgcgtggtggggagtctgcttctccctctccctctgcagggaggatcttaaaaaatctttaaaaaaagaaagaaagtagaattctccccataacctacaaggccctgcaggatatagctgctgcctgcctcttctttatccctaccttatttactatctctttctacctgccatccctttgtctacctgcctgtccatccctccacacatccatttagttttggggtgtcttcagtgtgcctggcttactcctgcttcaggacatttgcccttgttctctgtgctggaaaacactgttcccgcaaatcaccatatacctcctcttccccctttatttaagtctctgttcaaatgtcatctcctcaaagagggatcctaacatgtcacctcattcatcctttctctaccccacagtatttttctcagtagcacccatcaccccatcaccacttgacctgcaattatgtgtttgttgtatttgtgtctcctgctttgggagaatgtctatgaaatgtctgcaaggttatggatattgtcttttgggttatctcctgtgtccctctccttagtgtagtgctgcacatagtaggtgctcaggaaagatttgttaatttgggattaactgattcaggcaccagtttcatctcctggctgtgtatcagagggcagctcccttaacaagtacttctcctaccctagtctcctgggatcttgtggcaatgcagactccagttcagggtctagggtgggacttgaatttttgcatttcctcccagctcccaggtgacaccccagctgctggtcctgagatttagacattgagtagcaaagccttaacagcttggagcctcagtttccacatctgtaaagtggttcattgtgaaaaacaaatagctaaagtgcataaagcactgtgcatggtgcctggacttagcaggtgcctggtaagtatctactgctcttcctttggctgcctatctgggtctggaacttgaagttgccttggttttctccttctgctcttccctatccctccatgtttagccccttagtggaattttgtccatcttatttctccagagctgaccagccctgcctgtcatgggcaggggtttggggaggattctggcattttgacagtcatgggaacattatgcaaatgagatgcaaagcagcagctaataagccctgattgcatttgccctggcactggggaactgtgggatagctgtgttgggatgggaaggagggggcaatgaatgttttctgggttggacgagaaggggtcagcttctcctgggtggcatgaggccccttcctcatgttgactgctcgcgcctgtgggactgcactattgttaaggttcgggagtagagctgaggtcgggcatgggtgtgtgtgtgtgtgtgtgtgtgtgtgtgtgtgtgtggtgtagggatgtccctgagcctgtctgagacctgcaggtgggagagtacatggctgcacactggtggcttgggggccttcccaggagcagatgagactggatcaggctgatggtggggcagcgtggaggtggatgctctgcaggctgggcagagagggggtgacagaagggtcaccttcttccacagagcttgtctaagcctgggaaggaagaactggagggtctgcccagcagcaggtggggctgggtccggttgatgcaggggtggaagcggagagcagctatctttcaaaatgcagaatggagctggctcgttagtagaaagatgatctggggctgggggcctgacaggtgggtagggggctctgcttacagtgcctggaaacccaatccctcctcacccccaactaaggtgtcccctctccagggagccctggctctcaggtgccagccccactgtctggtttgggtcttgacttgaccctccactgagaaccttcaggcctggggatggctgtcaggcttctggctccagatggtcaggctataagtgacttctgaggtcatttggcgggggggtcttcactcatgcccacttcttgactggcacttcaaatgcatatgaccctgttctgcctttaatctttttttttttttttttttttgcctttaatctaaggatgagaagcacatgtggctgtgaaacttctagaaaatgggtggctgttgccatgtgtcccaatcagatcttaatggagccaatgtagagcattggaaaaagcttggcaaagcagcaggtttgaatcccaacccaggcatttaccggctgtattacctggggcaaattgctcagtctctggagcctctgtttccttgtcagttctgtgacctcacctgtagggctgcagtgacagccagaggtgctgcaggaaggcaggaggtcagcgccctcaaggtcagggactttgttttgcccatggctgtgtcccagttcctagaacagtccctggtacctggtgggtgcccagtaagcatctgctggatgactgagatgccttgtttcacctatcccaacatggttttccccctcccagctgacatctctcatttgcatgcgccatacagcttatagccctggtttaattggtggcaatttcatggttgaggggggtcttagatgggatgaaatatggaagaggctattattattaacagctttggagtgggcttctgggtctttccattgtatctgccttctctgggctgtatgaagcccctgagaagtgccctgggacacggggttggcaatgatccttgccagggtccttccaaggtggtgctggggtgggggcagtgcatcctgtagggcacactgtgtgtcctgggccccaatccccacttgacatcccagccgcctccaccagatactgcccctcctgggggatggcagggtcatctgagcctgggattccttccaaggaggaggggccccctttactgtatttgtcataattctaagtctcaggacctgacatcaactgcggggggttgggagggaagggaagggtggagatacctgtgagccccctgggccgaggcaggggctctaggtaggatttagtctggatcaggcaggggacttatcagaatgagggaaggagttaggggagggcgagcccaggcctcctgcagcagagctgaggcaggggggcagattagagtctgatctctggagggcaggtgcagagcagacaggtctttcccagaagtggattctggttctgacactggattcttgcttgtgtcactgatcccctcccgtgggctagggctggggcttgtgtggacagctgttgattttgtgtagaaagggtttatgtgttgcgtgttctggatccatgtagatgtgtgcacacgtgtcttaaaggtgcataaatgctgatgttacagttctagttatgcatatgcatctgtcacctgtgcacgtagacttgtggaactgcatgggtgcaaatacatgtgggtgtttgtatctttaagtgtgttgttggggtgtacatttatgtggcacgtggctggcgcatgtagatcacacgtgtacagtgcgagcctagctgttttctttgaggggtatgtgatagcggtggccccgtgggagcagcaccagaactggaatcacaaggcctccctgccagtaaccagcccaggagcctcagaagctcagacaagttgttttacaactggaggcctcagcttttccagtctgtaaaatgggtatggattctcaaagggatgagagtgtcagatgagcatcccatactcagcctaccccagaatgggctcaacataaaatcgtgaagaatgaccaagtgagtgtaaatgatgaagcaaacaaatgcttacggagcagcaggcagtgaagtttaaggacccaaggcaagtgcttgggaaggtgctgctcgcagtgtctccgagggatgttgggagggagggtcttggggagagagaaagcagagggcctggagcagggtcccccacagagtggccttgtgagcccgtctgttcaccccgcccgaggtgacgtcctccccacattagcaggccagcgtcccctggtgtatgggagggaggctggctgtgcagcattgcccggttgccatagaaacgagcagaaggaggtgggtggctggggaaggaggcgggtcgggaggagggaggggaggaggcagcagtggggggcggggagctggcttctgcagttctggcgctgctgccttcctgagccggtggtggagggaacctgagaggaccgagccccccacccggacaccaggccccctccctgcccaccaccacggagacggtggaggacagccagcccctccggccctggcctggcccagcaggggtggtgagcacctacctgcccctggcttggtgcccagacaggcccaggtaggcatcccgatggggacagctggaagaggctgcagggagagtggggtccccctgcctccaagcacctggtaggaagcatactggctggaggggccggggtcagtggacctgggggggagcagcctgcatcctgggaggccctcttcagaacaggaggacagtccccacctctgccttccccctctgcactcctgtccctctcgccacaggtcctgactgtagaaccgctctcccgctggaggcgtgggctgcggggaggctggcacttccagggatccacagggctacccctccccaggctgaggctggaggggtgggcagggaaaggtgaggctatcccctgctcccactcagggccctgctaggccctggccgttggagagcagcagattcacgtcccaccctccacagcagctgcctctgctggccccaggtgatctcgggcattgggcttcaagccccctggtcgggcaagaggcatccttctcctcccccaagctcaggccctttgctccccatttctccctgcagtcctgagccccagacctcctgggggaccccgggcccttccccagcaagcccagggtctccatgttggattggggggggtgcctgtggtcctccctcccccgtgtctgtccctctgctgcattgctcctggggacagactcgaggctgctggggagctccggcactggcactgcggaggagcctctgcccgctgctcaggagggggcggggctggggctccgggaggacctgggcgcccaaaggacgggagagggcgtgcagttcatcgcgtgagttgcacctggtctggtcctgccctgggacagcgctgaagggccttggctggcattggggggacaaatcctagcccaataagggcaggggattggtgtgtgcagccctggtttgctccatgtgcctgggcagagaaggatcttcccatctagtgtaccccgagagctgggctgggtcctctgctgggccttggcatcacattatggggcttcccatttccctgggcacgtgggggtcagagtactaggtgcagggaccagggtggggtaatactcgccaagaagctcgttcatttctgcaaacattagttgcacctgctgaacgttaggcgcaggggacttccgccgtggggctgacagcctgggagtgagaaggccagacaaggtggcggtgtcgatctgcccagaaactggtggccaggtaacccatatacactgtcacagtcggccccctgctcctctgaaccccgccaccctctttgctcatctctctccttcgcaaggaggtggggacccccctccccaccatggcctggcacggtcatctgtcctgcctcaccttctacagctgagcctgcctccatcccagccagaacagggagcaggttgttttggcaagagctggaaggagccatcccttcccccagaccctctgggcctggccctgcccttctctgctcctcaccgccttctctaggccacattcttcttcttcattgttttctgccctacatgtccctaggggctgtgcttgctctgggtctctgtcttatccccacacttggggcagggagcccaccaggatggcctcctggagcatatttcccaagtctacccctttgcacccagtgggcccgcagtggaagccagtgtgagacccagcctctctgaattagtcttctcggtgtcagaaaggggttgaaaggacactcagaggcctggggcttagccaggggctggggtcctgggacaggctagaaggacactttagccctaggctggcccctcctgtgtaggagctctgggggaaaggaggctccttatgggcatcttaagtcttcaaagtcaaggtcctaggctcccccaaacagtttctcctacttggctgccttctcaggaaatagtcctccacctgccggccactcaggcccaaaccccagagtgtctctgactccttccgtgcctcacgctctctttcaagccattagcaaatcccattggctcctgagtcagagtatttccagcctgcagccacttgtgcctgccccggttgcctttggagctggtctgctctcaactcaaggactgcaggcacctgcctgccgcctcctgccctctgctccccccgtcctgccctcatcactatctccctggcagccaaggatccttcaaaacctaagcccagtcacatcctacctcttctcaaaccccgcagctcactctgaggcaggaagtcagaggtctcactctgccctacaggcccctgtggggtcagcctcctgccccagcctccccacctcaacctccctgacctgactccttccttctccctgtcactcactcccctccagccacatggcccccttattcctcaaccatggcagccatgcttccacctcagggcctctgcacgtcagctctgtgagggcatgggggtttctgtcttactcaccgtagctcagagctgccccgcaaggacctggactgcagaataaaactggggctggccttctgcgtctgtgctgtgatgaagggcctgctattgggccctcacaagggaaggggcgcagggccccctggctggacagttgcctcaggggcatcaagctggacaggatgttgtgcagaagctgctccagccatcgccaggatgtctctacctggccaggaaggggaggaaagtgagctgtatacattccacccccagtcccactgaagacagagggtagcttcctttgggtgggaattcatcccaaagttctctgcccggggtgggggagaagcatgcagtgcacccatcgggagctgcccctacacagcagcagcccgatctggcccccatcctccaggaggccatggacacagagggctcaggacaggacccaccctctcgggagccaggtatgtgggatgactgctcccaaggagagagatgcacccagaacacagaggatgggggcctgtgtattgccagctcccactcctgcctcgtcatctgtggtgttatggtttgggcttcccaagaagctgaccctgagacaaggatttgatttgggtgatggcccgtggaaacaatgagcatgtgtaggtgagacagggagcctgttgcaagcagtcctgctggggacctctgggaggcactggaggacccaccctgggctcagcccaccgggaggggctgctggagtgtgtatgcaccatatgcccccgttgcttgaaggccgctcctgaccccctcaacctgcctggtgtccccctaactcttgtcactaccgcctagcgagcaagatgatatgtattcacttctgggccttccgcctggcgcgggtaaaggctccatgggaggccagcctcattccctgtgaagcctgctacacggcacggacaccagcactgtcctagggctccctggagatggacaggccgctggatgagatgtttcctcatccacttggcctgggaccctggcagggtgcagggtggggccacctttagtgatgattttctggaggagagagagagagagtgtctggggctggtggaagagggagagaatagggagggtaaaggccaaaggtcagagtctagggaggaggggaggagaggacagggtggctgaggtggagtggctttgatcactggctttaaccatattctgccgaggatgatcctacctggtcccccggaccctgggcctctctggggccctccagcctcaatgcagatccaggctctgcctctcagtttccccatttgtgtttccatcccctttcttccaccctaccttgggactcatttctgaagggagggccccttggggactgccccatgggccttaccttagaggagatggaggatgtgaggcctgggttttatatccagagagaaggcaagaggaagccaggcctggactcttctcacagggcacctggagacctgggggtcccagatgaggcccaacagtcatggaagggactctcaactcaggtggccagcacagaacacaggatggcatgaactacgggcatttatttcccacagtctcagagcctggaagcccaagatcaaggtatcagcctactgggttccagggaaggcctttcctcctggcttgcagatggttgccgtcttgccctgtcctcacaccgacttctctcaatgcaggcacagagggagacagtgagcatctctcttcctccaccagtcctattcgatggggactccacccttctgacttcatgtacctttaatcacctcctaaaagccctgtttccaaaccacagtcacattggggaggggataaatattagcacatgaatatagtggggatgcaagtcagtctttagcaaaggtctctggggggcattagctcaaattgagggggggatgtgaagccctccagggagatgagcgtctcctgctttgaaagctctgcagctgtagaagcacaggtaataacatctctgataataataccaatagttaacatggggcctcctgcaccagggcactcattgcacaaaaaccccatggggtagccattgtcctcacctccattttgccgatggggaaactgaggcacagagagtttaagcagcttaccaaagtcacacagctggcaaacggcagagctggggtttgaactcagttgatctgtctggccccacaggcagcgctctcaactactgtgctaacatagcaggattttctctgcttgtcgagagggaaccagcaagatgtggtggtttgtggcaggtgtgattaagaactgcaccagggcgtaggggtgaagtaggtgagggctggggtattcagagaaggcttcttggaggaagtgggactgagagggcccttggaagggaagcagggttattttattttgggagagacagtgatgggaggcagtgatggcacgcaccccgggcagggggaaggtgtgaacgaaggagcagaggctggaatgaacacagggtggggaggaggagcggaggacggcacctcacagctgaccccaatccttcctgctgcatcttgctcttctggcagctccctgtgtggccccacgtcaggcgcgatgagcgggtccacctcagggtatcgggtccacctcagggtatcgggaggagcagggctgccgctgggaatgtgtgcgggacctgagacccactccgggtgagggggaggcggctcaagcatcccgtggccccgtccaggtttgagctgagccgctcccttgggagagtgtcttaggcaggagggccagggtgacacccatggggcggggggtgctggctctgcactgggcacctggtggggggcagaaggatgcacccctgggcctggatctgactccgtgtcctccctgctgtgtgaccttggacaagtcatttaacctctctgcgtctcagagaagatgggagtcactgcccatctcagtgggctgccgtgaggattgggggtgaagggtaggaagaggctggcatattgcaggtactcaactgtcatagctgatatagggggagagtgaagagagggtactagaacaacctcttttgtatgatgcggatccccgaggagggagggtaccaccttagggcagaatcgtcactgggatccgggaggaagagaccctggaactggaccctgagggttggccaagaggagaggaaggggggatgccaggagaagtgggcggcctgagaacagaggacaggtgggatctggaagccttgtgagattctggcttttggttgtatcaccatcattatcaacatttcttgagtacctactgtgcgccgtatttgcttctgaggtatagaattcagtatttctgctatttaatgaatgaatgttccagaaggtgcttggcatttattcattcattcaacagaaacatatcacacacttaactatgtgccaggcactgctctggatgctggaaatacagcagagaaccagacagacaaaatttactgaccttagcaagctgacatttcagtgagagaggaagacacaaacaggatgagcactctaatgttgggagcctggcatatggtagcatgtgctgtggagattactaaagcaaggacagggagacaggagagtgctaggggtgggaaaagagtgtcaagtgagatggtgggaggtcaggacatttgagcaaacatggaaatctggggctgggggcattcctagcaagtgcaaaggccctggggttagagcagcaaggaggttggtggagctggaggagatgcagggcctcctgggaaagaattagacttttacttggaggaaatggggagtcacgggaggatgccgagtagggcagtggtggggtctgacttaggaattactaaagtcccctggctgttgcagtggggaacagactggagtgggcacaggggtgagggacacaaggtcagaggcaggcaagccagtaaagagggcactgaggagagtgatggggctgggaccagtgtgattgagagcagggcccgggatctgctgatgcgttgggtggtggcgggaagagaaatgggctggggtgactttgaggcctgtggttgttagtgacctctgatgcacgagtccacatggtgcctttgtccacagcaggcctactctctctgggctcatgctcttaatcctctgacccttcttcactccagggtgaacaggccccagccctccaggggctttcagaggcagctgactagaagcctggggccctaaggggggcacctttcaccctggggctcctttctctctatagagtaaaggtcaaggccaacatgcaaacttcacacttccataaatggtctgtatttttcaataagagtttcctacccttttaccatttgagtgtcacatgagactgaaatattgtttcccatcggaggagttagaaaaccaggacactgtcacaggacttgattgggattccaccaggaagtggtagggctggagcagagcccatgccccctggtcagcacactgagggctgtactatctttgtgggcaagagagacctggctccttccctggctgtacaaaaatagcaccccaccccgccccacgtggcgccgccatgggcctgccacccccactacagcaatggtgacaaatcaataatgagaggtgacaagctctttctgtcatgtcccagcctctggatgctctctccgataatgtgggggtgatagtagcacctgccgtagtggcttgcttgcaggatttgatgaattaagacacatgaacagtccttggcaccaagtatgtgctccataaatgccagttgttattatcaatgataaagggcttgtagggccgcaattgctttacaaccaccaggaaaaaaaagtctgatgggcatcgtgcccattcaatgggttctgctaagagtgcatcaggcttgcccatgggcatgatcgatgctggccacaccagcttcctgactctgagagatgcagtgttttcagtgacggcagctcctgaccaccattcaggaagaccatggcatttgccagagttaagcctcccacttgcgcccagggtggggtgtgaggctgatttgcaggaggtgggtgcagggtgtctcgccaggcagtgctgggggcctgccccctcctgcatcctctccccagtgctgcctgcctgtctccccgagcctgcctctgtgcgggtccagcctggcccctcaccgcttcatccaggcctcacgttgggtcgtaccatcctcatttcacagcgaggcctgacaaagtcatgtgaattgcctgaggtcacaccgcagtttggtgacacagcagggacccccaaggctagaactacacatgctaactcagctgggagccctgagacccatgacttacctgcactgagggaggggccccagcaaatccactctcctgcccctgggcccggacagagtggagattggtctctgccctcatgcattcccatcccatctgacatgccaggtctttgcagagctgtccccttcctctgtgtgtctggtacactctgggtcctggctgagctccctcagctcccttccaatgcaggccagaaggttttcttttttttttttaagattttatttatttatccatgatagacatacagagagaggcagagacacaggcagagggagaagcaggctccatgccaggagcccgatgtgggactcgatcccgggactcctgggaccctagccaaaggcagacactcaaccactaagtcacccaagtgccctgggccagagggtttttaaaaatatgcaatttatgcatacaaagcacaatttaaaaggcataaaggacctgcagatgccagatgcctactctccttcccatcacattccccagccaactagttccctgaaggcaaccaccactaccagctttccagaagtgttccctgtctgtatttttccccccatacaaatggaagcatccgcagcctcgctcttctgcaccctgctccttttgtcttagtggcatggcttggggagggttcggttcaggaccagagcattctgttatgtgtctgcaccataatctccttaggcagtcccctggctgggaagcagggatgtttccagcctttggcttttgcaagcagtgctgcagcaaatggaattaggcagcatcgccctgtggctggaaggtgaattcctaggagtggcattgcttgggtgagggaggcatgcctctgtcatggggagagaagatgcaccctgccccctctgatccaggctggtcaagtcacttccccactacctgggtgggttcgacctttgctctcatgagggcatgtccctaccctcctccccttcctgcccccactgctagcctgatgacaactgagcattatttgaatccccaaagagcacggttctgtatgatttcaaggattctagagagggctctggtcccagagatacttaatctaacctggctgaaagtccttcattaaatatccctgcctttcactttcctatatctatgtgcattgctctttatgaagtgaacgctgctttgtaggtgaaaagtgccaaattcagaaaaataaaaatccagacttgtttctttgtcccttgatgccgcccttcctcccacccacccccactgtgcatgagtttgtgggaaggttggtctgaggctttgtgaaggggagtggaacaaaatatatttagagcctgggaggagcaaagaggaggcagtactgggttattactgggagtagggcagtagcccctggacagacagggagactgaagccagggaaggcagggatgtccttgaccaaggatcctcacgtggcgatgccacctgccctgagcctgaaggtgagctgccataggggctgggcatccccgggacccccaggtgggtgtgaacttcgcagaggccaaccctcccccagtatcctcacaggagaaggttcttttttaatttttatttttattttaaagatttcatttatttattcatgagagacacagagagagagagagagaggcagagacaccggcagagggagaagcaggctctatgcagggagcccgacatggaactcgatcctgtgtctccaggaccatgccctgggctgaaggtggtgctaaaccacggagccactcgggctgcccctcctctggagagggctcatagtccctgagcagtgcagatgcagggaggcatcccttgggcatcccctgccctgaggctggcagctcctcatggggtcattcctgccctggcctccctgcccctttgaagaccaggtccctggccctctgggtcctgtctcctgagccattcttgcatgggttggcagcacagggtgggagcacggggaagggcagcatcccagccccggggcagcacatggcccagattggacagccttgatgcctgccgacagatccaggccacacacagccactccagtgctcacacagatcacagtggtctgacctgtaggccaggaagctgcatgtttgggactcttaaagagacatgtaagtggctgatggaggcttttgaggcctggcaccggggcaggcaaaagggcatttacagggacccagcctgggccagagatgggaggcgggccctgctgccggcttcccagggagctcaggtccaggttccgggtgggggacttgaggctctaggggctgagaccagggactctgttgggtgggagagctaaggagggtatatttggtgcaagggttcaggtggatcagggtgggggcagtgctaaggggggcagattgagaaccagctggggtcacggagcctcagtgggccctacaggatgccaggtcctggggaggggaggcaggacgtgcataaagattcgcctgattgctgccttcgaggagctgtgtgtgtttctgaggccaactgcaggtttatataaagaaatatgtaagtgtatggttctgacttttaactttgagtccaggagcacaaaaacagttgtgggtgccatggttctggcagttggggctggcttctgaaaagagctgccacactggagctgaagaatggatctgggggagaggatatggagtgaagggaggcaagatggggggtctacacaaggggtgctacgaggttactcttggggttactgtaaggatggggagcctgtcccccagcaggaagtccccatccccatgcaaggctcaagcctgtggagccctcatccccacagcaggtttgggcctcaggcctggaatgggctacatggggcacttcccctctccagggatctctctttaccttcccagcgcatgagcagcccagcctgctgaccaccactgcacacccacctgtccccccacggctacaccatgtctggctcctacgacgaggcctcgctagctccggaggagaccactgacagcttctgggaggtgaggctttgacgctccccagtcctggagaccagatggcctggccctgtggcagccaggctcccacccacccacaaccttgctccccagcccctcgggtccctccaaattccttggcgttcaacaggcagccgtagccatgaagtgggggtaaaaaccactgcccaccaagcccagagcccctctgccccacagctgcccctggagagatctgccgcattttgtgatgtggaacaggctcctcctgactggctgctctagggaatctcactcagaccctgaccttgaggaaggcaggtgcagggcttcacagcttacacagcctttcactgcggctccccaccccctaccctgtaccgtgaattccagaagccccacagcaacaaagaggtggagaccagaggagaagccagcatttcaggcggctcccaaactatctgagaccaaggaataacatgttttcgatcggcttcctaaacccaaagcaaaaactgccaagcctgtattaataagtgtttaatgagatgtctacaaaacataatattatgtcaagaagctgcagctcagctcaacacttacatgactctataaatataatacgtttagctgcaagaacaagatgaataattcattcaagtctgggtccaaattataaaaatcttgcactttgtggcagcgagaaaattatgtggcaagccaggtgagggagtgtataggccgtgaggtttggcgcagggtgctgagcaacccccccaaagtgagaggaggaggggcccccagcgcgttccggggcggtgaggcggtggggagggggaaggagggcgcggcggcgccccctgcaggacgcggcgtcccgggcgggcgggggcgcgggccgcggggagcccgcgggagtcgtgctcgctccttggccgccaggtggggaactacaagcggacggtgaagcgcatcgacgacggccaccgcctgtgtaacgacctgatgaactgcgtgcaggagcgcgccaagatcgagaaggcgtacgcacagcagctcaccgactgggccaagcgctggcgccagctcatcgagaaaggtgctcccatgcccaccccgggcgcgctgcccacggtctggggccccagggcgccccgccccgcggatgcgcctgcagccccggcgccggccccacactgcgccctgaccctcccagaccaagccaggtctccctgtgcctgttctactcgactttgtacgattttaggttggattaaaaagacagaacaaaaccagacctttttatttccaaatacttttaacttcttagagaaaagatgcaagaatcagagagagaactatgtagtcttcacccaggttcaccagttaacgctttaccacattgtattctcagtccctctttctttctctgatgcatttttttttaactgtttacgtgggagacatgccactctaccctaaatccttcatatatctcccaagaataagaacgtttgcttacataaccatagttcaacgatcaaattcaggacatttaatatgactcatatgcaaattttattatagcaattgtttgtgctggtccagaagccaatccagaatcacatcctgcatttagttatcctgtgtatagagtcctttaatctggaacactttcaggttagggtttacaggtatttgttaattttttttttcttccgtgagaccctaaatcccatgagggcaggggctaaacctgtactccccagcattgtgcctggcacagagttgatccccaatatacagatgaacaaacaaacgactgtggaatgtatggttccagtggcctcccggcatcagtcaccagctgcttcttcagttttatactcagtcaacattcctgaagcactggctgtgtgccaggtgctgtgctgggcttgtgagagcttgccgggtccaggctgccccccaccatggggctcaccagctggctggggagatagggagtagagagaggcagatgctgtatgaaggattcagtgagggtgagggctgcaggctgcagggtgtgagaacagagcagtcagagaaagcttcctggaggaggtacatgggccctgaaagatggataaaacaataaagagagcaggggagggcatttctgtgcatgtggcatggacggggaaagcctcagagaaaggaggcatgagagaggcctctgagcagggggtaatgagggcatcgtgatcctgtgacatttcctcagggccacagtatggcagcctggagagggcctggggtgccatcatgacagaggcggacaaggtgagcgaactgcaccaggaagtaaagaacaatctgctgaatgaggacctggagaaggtcaagaactggcaaaaggatgcctatcacaagcagatcatgggcggcttcaaggagaccaaggaggctgaagacggcttccgcaaggcccagaagccctgggccaagaagatgaaggaggtgcccaggggtggctgctgcggttggggcgagggtgggcagctgagctcagaggggcagtctgattggagagggtgggcggtacctcacccgccgggattgtgcctgccggggatcagcattgcctagatggcagaaatagccacagatggggcgggcatcacggtgcccaatgggagggtgtccctagaggcagcaggcagtgccgtgcagggaaacatccacagatgggtgggcactgctcccaaatacctggagcaagggcccacatcccttctgcctctttaggacatgtgctccccagcccccggcaggtgggagggcttgacgagtgaccgcatctgttcctgattataagtaggagctctacctcctgttccctccggcccacagctagaggcagcgaagaaggcctaccatctggcctgcaaggaggagaagctggccatgacacgggagatgaacagcaagacggagcagtcagtgacgcccgagcagcagaagaagctgcaggacaaagtggacaagtgcaagcaggatgtccagaaggtgccccagggctggggtctgagagctgctgggagtgggtgggggctgggagccgtgtgcctgggcctcacccttccttcgccctggtgcctgtagacgcaggagaagtatgagaaggtgctggatgacgtgggcaagaccacaccccagtacatggagggcatggagcaggtgttcgaacagtgccagcagtttgaggaaaagcggctggtcttcctcaaggaggtgctgctggacatcaaacgtcacctaaacctagctgagaatagcaggtagctgggagtggcagcatggggggcacgggcacagagggcagggggtggaagtggtgtgcaaggccccctgggcccgatgtcgctgggacaggaggggtgggcagagctgcaagggccaagaaggaagaggctccacagcctggctgccggggaaacatgcctggatggatgggtgagtggctgaggtggggataagaacctcctggtgtgtccggggctgcccactcagggatcgctccttggccagcccaccttctacctagctggccctgaatgggctccctctggccctcagcgaggatgagaaggggccatggtgcatcttgccccccaactccccatctcccccatgcacagctatgtccatgtgtatcgggagctggagcaggctatccggggggccgatgcccaggatgacctcaggtggttccgcagcaccagcggccctggtatgcccatgaactggccccagtttgaggtgaggaagtgtggggatggggaagggaagtcggaaaaggctggaagggacctcaggggtctccctgcctcactgctcccctggtacccaccaggagtggaacccagaccttcctcacactgccaccaagaaagagaaacagcccaagaaggcagagggggtgacgctgaccaatgccactggagtggtggagaccacatcccaggctggggaccgtggcaggtgagtgcctcctgcagaacttcatgagggggctggaggggcccacatactggggcagatgagttttacctcaggagacaagaaatggtctgaatcacaggaatcacatgctcctctcaaagatagtggtaggtcatcctttgagagctcctactactccttactacgtaagccctttccatatattaactcctggaagcctcccaacactgagaagtgtgtagagagtcccattctgcagatggagaaactgaagcccagagagattaagtgacttacccaaggccacacagctagttagtaagcctcagagctgggatatgatgtccaaaaggtcaagctcctgggacacctaggtggctcagtggttgagcgcctcccttgggcccaggctgtgatcctggagtcccagagtcgagtcccacattgggctccctgcatggagggagcttgcttcttcccctgtggtgtctctgcctctgtctgtgtctctcatggataaataaaaataaaatcttaaaaaacaaaacaagacaaaaaaaggtcaagctccttatccacttgctgcccttctcagatgaagggtcagatgttctcaggggtcccatgcagtgccccctcactcaagggctgggtaataatgctaatagtcctgcctcatatttatcgaaagagctgtcaatgagcgtcactggaccgggaccccctcttacgaggcccatccctacaccagccttggtggaatttggggccagagccctggtgggcaggacggggcagccctagagacgaggggaggggcagtttatgcggggtcctctcattgcgtcccagcgttagcagctacgaccggggccagccttatgccaccgagtggtcagatgatgagagtgggaacccatttgggggcaatgaggccaacgggggctccaaccccttcgaggacgacgccaagggagtgcgtgtgcgggcgctctacgactacgacggccaggagcaggatgagctcagcttcaaggctggtacgggccggggcggagggcagggggtgccgggattgggcgggagtgcggctggggccgggccaagcctggctggatcccgagacggggcctgggctctggggggcagggccgagacccagttcaggtgtctggctgggggccgcacgtgggtgtcgggatgtggctggggctgggctccagagcgggctttggaacagtgatgggagggcagtgggatggcccagaataaccagttttagagagctcacctagcattgtgggggtgggggtggctctctctgagcccctgtcgatgagctcctctgtgttcccttcctaggagatgagctcaccaagctgggcgaggaggacgagcagggatggtgccgcgggcggctggacagtgggcagctgggcctctaccccgcaaactacgtggaggccatctagctgccctgctcctctccacacccccctcacccctcgtccactgcctcccctcccttctctctcgtccctcttccctcgccatagagttccagacatattttccgatcaagcttttatttttttaaaagtcaaaacagaacaaaacaaaaaatacagagacagaagcatttgcagggccgcctggaggccagggtggtgggactcagggtgatggccccagggtaggtgagggtcttagtacttagcccaacagagacattacttctgctcttcagatcccaccaaagagtctcctgagccctgagggatgtctcctggacccgcactccccagactacacttcccaaccccaggctgccagcacctgttccccatcctctcctcggggcctgctttccccgacctcttccttctgtcccgccatgctcctctccctccaccaccctactgtcaaaggcctccccttcagaccccagagaagggggccctcccagtcttcagtcttccactttgccctggggagtacccttcttcccctggcctcacccctaaggactggtgggcctggaggaggaacagtcgctgtcttctcccatagccatgtcctggggtccctagatgcccccagacatgacggggtgagctggagttggtgacagtgtcactggggtatagaaggatgagtgtaggggggccaggccctcagcaaccccagcaccaggctcagctatggcactaagacccggttggggcgcttctttccagctgttggcgatttgggcacaggctcttgcttggagccatacccttcagtgacttgcagaaaccctgcccctctctcctaagtcctcaggcagggggagaggcctcacagcccagggcaaagccagcaactgtagcagcctcctcccgttccctgaggagaagggcaccttgcccaaccacccctgtccctccctgtgcaccccctccttgtgaatcttcctagattcactaagttcagccagcacccctcccccccgccaactcgcccttttgccagacagccttgtggcctcccatccctctctctccttctctggccttcccgagaagatgctgcagggtccaagggattttccagcctgggaccactaggaacacagtagcaccaaggggaaagatgtggctttggcaagaaggaggctcccaggctctccggagcaggacagtcacagtgtctttcttccttgtcccgtcctcaactggtccttgcccctggagcagcattccccctgctggcagcccctccgtatctctaggcctgggtctcaaaggactttttgggaggtggggggtgggggtagaggaggcaaaggacctgcccagagtcagtgtttcctgtggttggtgaaggaaagcagggttgggttaccaagtattagtaccaggtaccagcttctcccacacatgtgggcacaggggcttgaagcagaccagaccagggcaggacaaaaacctcaaggcagccggggcggggggtgggggggtggctggaagaggagtctctcggaaacctctgggacttcttgtagcaccaggagagcttctgagcctcagggctgcagacaccccacccccttctacagcacctggtgcccgggtgataccccagccttctggcacccctcagtccttctgctccggctgcttctgccatcagtccactttcaggtggtggaccccagcctccaggccctgaccctgttggcgtgtgcacggaggatcccggcagactctgcagagctccctgagggtcaggagagttggagggtggaggtgatgacacccccagggacaggtggactcccatttcttgctactgtctgctctctgggcgtctgctgcagcctgagatgtgccctaggcccctcagagcccaaagcaggatttcggaagccctctgcccatctgactccagaccaaaagcctcttcagcctctccttcgggtgggagttggggttgggagtctttgcccttcaccatggacccttggaaggcaggaagctggcacatctgcaccttggggcctgggctccctttgtctgtgccagtggctttcaagcacctggggagggcctggggtccctgctggatcccaggcctgtccccctcagcactccagctgccctttctggggcagggacttgagatcccattctttctgagcaaccacctccatggcccaatttgggaccactctctcttagtcccctggctcctcaggaccccggagtgggaggctctcccacctggccgtcccccccaccccgagctctaggggcctagccccacccgtcagtgctggtgtcagggcactcaccaccaagtgtgggggccgcacccctcaccgtgcccaccatctcttgtagcccctacctgcaccctcaatgctgcacgggcccgccccttggggctcggcaactaatgtgttttgtccccagttaatcaccattctacagcctggctctgcaaggggctggggctgccccgccgcccgccatctgctgccctaggcttcctgactccattcgtccaacacttgtgacactccgagaagtgctgtggtctcagcaatgcacctgttttgtacatgattgtgtaatttaaaggtatataaatacaaatatatatatatatatcagttgtgatcgtatgactgtggataaaatccagaactgtgtcaacctagtgggacgtggtgttcttgagtcttgtgtgtctctcgaactctctgaaacttgtttgtacttggggggcctgtcaaggagggggtgcccagcatactgtgtgccgtcctggctgaccactgatgggcaggaggactgagggctggccccccaaccttccagggccctgggctgtctgcacagggtggtaggtgacagatgaggcttctgacgctgtggccctagggtcctgggtgcccagagatgagcactgatcaagattgctggggctccaaactcacagttcaagggtgacccctacataggtttgtatttatttatttatagcgggggcggggggggggcactgaaccaggaagctttattttaatttatttttaaaaaatattttattgattatttatttgagagaaagccgggggtgggggcagggtgaggccagatggagcagagggagagggacaaacagacttcccactgagtgcagagcctgacatggggctcgatcccacgaccctgagatcatgaccagagctgaaatcaagagtaggatgcttaacccgactgagccacacaggcacctcaggttttagtttttaaagcaaaattgtaaaagtgactgctgaggcctgtggctccagttattcactgtcccagggctccctgtggtgtggcatcaggtcatggcccattttcctgtatcctgcctgtcctctgacagcatttctgtgtgggaaccctgggagggctcccccaggaggattgctcaaggggggtgggcaggaccgaggtcctgggctctcagctccattacccaccctccactcgcaggtaggtctcctctgggttaggcaggagtcccaggtctgggccagttctgccaccagttcgctgcatccccacctgcaccccagcctcagcttcccccagtcaggtcagatatctttctgaggcccctctggccctggcagcctggtggggcccaacacaaagccattattggaggcacatgtaccgcagcccccaagccctggcagcttggggcctcaggccagggaggaaaggtcaaggtgggggttgatctgttcaccaccttgtgtcctttatcccccacatccacctccagtgacaagcccctggttttagccacacagaagacccttcaaataaagacaaagggtggcctggtcttatttgtgcaggcttttctgtgcggttgtggggagccctgcaggcactgtcctgggaggagggccaggaaacacctgggcaggatggagttccgatgggcaggtgtgtggaggaggaagaggactctggagttgatgtcagtgcacgaggtgtcactggaggggtgtgtgcctgccaaggggatgtgtgcctcgtggcagatccacgcagcaaggagctgcctcacccctctccagagcaccttttctgggagtagctccagctccccactcctagccactaatcctccgtcctctgctccctcctcgccccagcctgagaccccaagctgctccaggcccaggtccagctggggacatgcaagcaggtggctccagggactcaactgggggcaggccaggaaggcgggagacaaaaccagtttagcagagtagagctgagttctggccagggtcccaatcgggccccctccctagaaggaggcaggcagccagcccccccaccccctccacccccctggcagaggcacaggcctggggcagggccccctcctcctgccagtccagtcccaactgacagatgccaaggtggtgtttgctcactgccaggagtaaactttcttttggagacaataaaattgctgagggcagaaggcagcagtctagggtagcatttaaccctccatggtctgggccactctggctgcctcccaatcccgtctcctggagcctggcatcagaagtggacggttatggaggctagagctgctcaccagccacaaaacaaggagagtggaggggcagagagagcactgtccctgcgggttcagctcctggttctgccactgattggctgtgtgactctgagtaagtcatttaactgctctgagccttagtttcattgtctgcagaataggggagtaacccctacctcacagttttgctggaaaggttcatgacaaaaaaagcggtggaggcacctagcacatagtcggtcctcaggacgcggaagctggctgaacaaatctgaagaagctgagatggttgctggtgggcccagctctccccccgcactcccccctcacacacacacattctgatcccacctttccccaacagcatggggtgctttgcagggcgcatttgcagaggtccatgactctctaagaaagggatactgcaggggatccctgggtggctcagcggtttggcgcctgcctttggcccagggcgtgaccctggagccccgggatcgagccccgggatcgagtcccacatcaggctccctgcatggagcctgcttctccctcctcctgtgtctctgcctctctctttctctctctctctctctctatcataaataaataaatcttaaaaaaaggaaaaagaaagggacactgcagacaagccacccttcctccaccccttttgctgcagagccagggtcccaggcaggaggctgaagtgcccaccctctcctgcacccctgctgccccatccagagcccccgaggttcagggtcccctcgaaagagggttagcaccctggccacttcaggcagaaagccctgatgtacagcagagcatgaggaagccaccttctctccattcctaagtaggggagactcccttcagccccagccccactccttcctttcggcccccacctggaggggaggacatgtgggccattccagcccctccttggccttgagggctcactgcctctctcccacagcttctacccatcaattatccctttcctgataggctcagctcaatgctgcttcccccaggaagcctcctttgaccacccccaggccactgtgaccataaccactttgagcattggtggcttcagggctgtgccactcacttgctgcagacaccggaggccacgttggtttctagtatctttattacccgttcccaggagcacccttggctccccaacctaggggtgcagaggtgtcctagcaccatggcaagcatggtgcagaatgggtggcagggagcaccggactgcgagtggccttggctaagtcactgctgttcggttggctctgctctggaagttctggggtcagaggttggggtggagggacggcctttcctggagagttgtgaacactgaggactgccctggttccttctatcctccagtggactgggcacatgagcagtcaggcctgagggggatgcacccccaccctggggtcccttgggcccctgagagctcacttaaacccctgggagcagtgggctgtcccctccctgaccttgggctccgatgccagcagactgccctcagctcagggtctggcggaggcaggggcaggcgggagggggcactggcaaggacgagtttcaggcccagggcctggcccgcagccctcagatggggtgcacgaactggtagacgaggcgttgggagatgtctggcttccggatgatgcccttcttgtaatactggcggatggagcggctcagcttgtcgtagttcatggcaggcctgttcttgcggatgccccatagccgggccacctgggcggagtcctcaatcttgaagatgcctgagggagcagggatcccagagacagagccaggggcgggcaaaagaccaaaaccaacaggtcagactcagaaagccaagggggtcggtgtcagctggaagcaagggccaggctgtgggggcagcagtacctatacccaaggttacggtgagggttggaggctctctgtgcagagtgcatcacagggcccaataagtggcaagtgataccatggagtcacagacctcctgagtgcagggtgagcctgtgtacagtagtgggttatttggggtcctcgaggcatggcccgtgccagcctctgctcctcctgtgttcgcactatcattcagaagccctggggggctctgagctgtggccacagctcctttttcaaggtcatccccacctccacccccacccctgccactttcaccagcagtttccaagcccaaaagagctcttggccatcctcagacacttaagccagcacagccctatctggtaagattgattccgaggaggcagaggaagccgtggatttgagccaggctgaactgggttcgaagactggttctgccctcttctacctttggaagctattctgaggcccctttatccagtcattggagggggtcgtagcgactaccattcgtggaatggtgacagaaaaagcttacaggggaggctgaaggaagtgcccccagagaggaaccattacactgttaacaccccagttctcctgccaacccaggccaggacaccccctccaggaagccttcccagaccaccctgccttccctgatctttccctagaagtctaccatggaactgtctccccgaggaccggctcacattaagtctcaaatatacatgagggctaccgccccttgtgctggaacttctttccacctcctctagccctgtacgtccttcgcactcagcccgtcacctcccccgtgaaatcctcctggaccaaggcacagctggccccaccgccgacatgctctgcaggccagctcgtttcactgctagctctcctaccacgctgcaagtccctccaggatggggtgcagctgaatcttccctctaccgtcaggacactgattgtccataaatgttgcctgggcaagtgtggacagaggaggtactcaaggagaggttgttgggtgaatgaatccagtccattttaagataagaagactgaggtcccggtacccacagctacagatgacaggatggggtctaaaacccaggtttcttgtcttggagttttttccaacacacgcacacacacacatacacacaccccacctggtcctgtccaatgagacaaccactagccatatgtggtcttgagcacttgaaatgtggcaagtccaaactgaggtgtggtctaagtgtaaaatatacaccagattttgaagacttaataaaaatacctcattgataattttcgactaattatatgttgacattttaataacggttaatatcagattaaataaacgtgttctcaaaattaaagccgccttttaaaaaagtttgataacgtgacgtggttacttggaagcctgaggctgcgtttgcggctcctatcgggcttctcattggaccccatccggctccccgagaagctacagtgttgaaggcgaggaccgtgtccaattctcagccaagttcaaaccccttagtgtggcccgggcaccgtgtggagtgggtgtccagacccctcggcctgcccccagccccccggggcctggcacctggtaggaggccagcaggtccccgccagccccctgaggcctgttccccgtggctcacccttctctttgttgagccaccggatgaagcggccgtagctgtgcggcttgagcagcagctccttgagaaactgccacaggtggatgggctgcccggagcacgaggagtccacctcgctgtcggtccagctgtcctcgctggtcgaggctgggcagccggcgggggaggcggtgagtggggggccccctgcttcgggcgcagccagccctccagcccggccccggccccggccccggcccctccctggcagccctggctcaccgcagtagtgaacggtcccaggagaagtcctctctttcatccaggccgctgcagggcagggagagaaggctagagacccagggctgaccccaaggctgttggggggcttgggtgggactgtggggcctgcagaaacgcccctctgtggccaagcaagggggcacggaggcagccagcttctgtccgcatccccaccaggctcttagccgggcactgactgctgctaccctgctggccactgggctgggcaggacagtggtctctagcggtctctacgagtgggtaggcctttattcatcccaggtccctaagggcaggggccttgactcactgagcaagcactgcttcctcccagcactggctctgtgtagggcacacagtgggatgccagacaagtcaagggttaaggagttggcacacagccattaaaaatagggcggctgtagagatgctgatgggggaacaagatccgagatgcaccgagagcagacccgcagaccggtgtgatactctggtgctattcgtgttaaaacaggtgaaaaccacacatgtatatctccttgtgcatgtgtggactctccccagcaaggtgcgcaagaaactgtggactgtgcttgcctctaggaagagggtctgggggtcacgagtgaccaagaagattatttttcatggtactattttcactgtggtcttcttggaaatcatgcacgtgtactacctcattatttctttaatgagaaacaacgcaaagcaaaacttttttaaaaggacaaagaaggacctcatagtatccacggtccccatcagctatgccatccatgtcccccccatttaactcctaccttttttttttaaactcctaccttttaacttcccacgtgctctgccctaagttctgtgggcttgaccagggctgggagtgggtcagggctggtgagttagcccaggatccaggcaggcaggtgcaagtgggctgagcccagactgggaccaagggttgtggccccaacagagagcaagcccggctggcatcctggcctaagcatccccctcggtgtccctggcttggggcttggaaggagcttgtctcccccaggccatgtcccacctgacttccagatgtccaggtgggcgtgcagcacgtccccacccagaggtgagcgctggcggaactgctcctctgacatggcacacagctccttgccccccagctcctggaaggccttgcccacaggcggcagccggtactggtgctccgtccacaggagccacttctgcacgttgccagggctccagtccacggggtctgggcaagagatactccctcagttccacgagctacttgagggcaccacccaacctctggtggggtgcctgtgggaactggaagcagcctgtggccaggaccacttgcttctgggatgagaaggggccaggccagacaggaccttgaggaaccccgtggaggagggtgaaagggcagaggccctaaaggcaaacttggctcatggcagggcagcctggggcctctgcacgaccccacctcactgggacctcaggttcttcccacccttgcagtccctccaaaggatctttcaggaagccccagccctggaggggagagttaaaccagagacacctaagcttatcttccagctgcctcttgctttccccaaacccttcaaggagccagaaaacctgactaggaagtagtcctataaccccaacccccaacccctgctgtattttacagatgaggaaactgaggcacagagagctctagcccctagtcctatggtgtgcatagtagcttctcagtgtatctacactgcatgaatgaatggcaggacatcaagtgatcatggggcacctataggcctcagaggccaggaagagagtcactggctaggtcctgggtgtcttcctggggggctactctgggctgagcctggcagggcacgcggggaggaggccaggctgatgggcatggtcacaatgggcctccaagcagacaccgtggtcttagctggtgccccagctcagtgacctgcaggctgggctgccctcacttaataaacccattttccttcccagggtcaaagcaatttgtttctgtcctcattgttcaagggcaggcccttccctctccctgtgtgggaaaatctccaggggtgggagctggcatgggcattgggtaactggtagaggagggcagtagccgcttcagacgagggacaccagctgggatgggtggcgggagggcccggggcccgatgattctgatggggaggggctgaacctgggggacccctgaggacttttctgtatgaaagcagcactagacggcgatgcccagacaccaggacccagcatccccggagatgggtcaggcctgcccaaagctggagagatgatgcgtgaacagtgggctggagacccagcagcccctcgatccacagagtcagcgccatatccacatcttccgggtccctcagacacacatgtgcctggacccctgaagtccccccctcatcagagctctcctcactaccagaccagggacacattcatctacgtatctatgatccatttccctcactggcatgtcatgaaggaagaggcttttgtgttgcgttcaccgctcaactcccccatgctagagcagggcctggcatattaagaagttactgtttattgagcatctgtgatgtgccaggtgccttcttagggactgggtatatggaactgggcagtgaacaaaacaaatgaaaatccctgcccttggggtgtgtacattccagtgggggagacagacagcaaatacaataaatcaataaaatatgcagggtattagttcatgtgatgagggggaaaaggcagaataagatctggggttatggacataatttcaagagaggtgtcagggaaagcctcgtcaaaacaggcaaggcacgagcccagtaaatatttggaggaagaggattttagattgagagacagggagatgcaaaggtcctgaagtatgaatgtcatgggaacagcaaagagcaggtgtggctggagcagagtaaacgaggagagcatggagaggtgtccacggggacgtggtgggccagatggtgtagagctcggattccctgcctcccgtagtcggggctcagagagggtccaaccttcctaggctcacaactgttaggtgctatgggctgactgtatgtgcagaatcagcagcatccctggggctgtggatgcaggcccaggggtgaccagagtgctgtaggcagtaccttcgcctcccccttgtgacctcagccctgtttgtgccccgcctaggaggcgggcccgcgggagggctcacctgcagtgatgttgagcagcttacaggctgtctcgatgtccttaagcacctcgcccaccaccatggactgcacctgctccagggagtgctcctccagggtcagcccccccggtgccaagtccaggctgcccccaggagcttggctgtcgatgaccgggcactgctcagggtcctcagatggctcctcccgagcgctggccccggggcccttggcggcccagctactgtcctcagggtacagcatgtcaaagtaggagaggtagaaggtggacaggccctgctcaggtgtggcaggtgggctagggctccagtcccgtctctcaggggccactgcccccacggccgccttttccaggcctgtccgcagcaaggtgtcagggggcagcaggaggcggctgggggacacgctgctcaggccggggctggcgctgcccatgccgctgtcgcttgggccggtagctgtgtctacagaagtaagagagaacagagaatcaggctctggctgcttccccatccccctgggggccactaagctggttacggggatgaggggcccagtgggcagtggccaggcctgggagagagagctggggcttccgggtcattggacagttaggacagggctgggcggattggcttctggctgggaaagacagtgaggtacaagcagacagctccctcagtccccaaggaagccagcttggttggaagcagtgaatctttatgcatgtggtgtgccttagacaccttctgaggttcttggcctcactgaatcctcaccgtggaaggcatgattagccccatttggtagatgagcaaactgaggcctggacaaggagtctttaatgtccagccccagcccagatcccagtctgtggctctgtggaggaagttcctactgagagctaacctaaatctgtctcgctgtagcagagtttgtgttcttttattcttccttaaagaggatagagaagggagaaggtcaccatcaccttcacctgtcaggtgaaggaagaaaggagcaagagaggggtgtgacaggttagcatcttctcaccagtcggggaagccggccccttccccttccacggggccatctgggggccggatacatttccagctaaacacctctgaaggagtcaccgaacaacaccacaccaacccaagaggactttctggtccccatcccacctcatcctccccaaagatgctgcccccggccctcctggctcccggggccttctcctttccccttgtgctggaggaatgagggctgaggacctacaggtgagctggaggagggggtgctggtaggggtgcagagtgagagtgggagaggaggtcaggtgtggttagagggccatggtctagggagccacagaggcccccagcgattcagacacccactcttggggcacctggatagctcaattggttaagcggctgtcttcgactcaggtcatgatccaggagtcctggggttgggacccacatccctcagctccctgctcagggagcagtctgcttctccctctgcctcctttccttcctgctggctcactcactcactctctccctccctctcagacacccactcctcctgctgtcccaaggcccccagggggggcaccacaacacaggagctaaaggcctctttccccatcggtcatgcaggctctgctttgcctcccagccctctttctctgaaccccatattagagtaggtggctcaggagaggcaagggacccgggggatgtacatacaccatcacaccagggtttctgggactatttctgggacctgtgggcctgggacttcagaataaatcccagtggaaggttatcaataggctcccaataaaatcagtagggacaaaaggagcagataagggcaagtcaacgtgtgttcttaaagccgtgtttctttctcttttcctctatttttctgtttttaatttaaattcaattagccaatatatagtacatcattagttcagatttagagttcagtaatccatcgggtgtgtgtaacacccagtgctcatcacaacacgtgccctccttaatgcccaccacccagttaccccctccccccccctccagcaccccccagtgacagcacagagggtcataggggaagggagggaaaactggatgggaagtcatcagagagggagacaaaccatgagtgactcttaactagaggaaacaaactaaagccgtgtttctcacgacgtggtgcctcggaccaggaacaacaataccacctggaaacttggtaaaaatgcaaattctcaggcctgtctggaagctacaggatcagaagctcaggaaagcccagcgatgcatttcagtggggcttgtgggtgatcctaacacacgttcacatttgagaattgctgcttcagaagcctctggccagtaaaagggagaggctttaaccaaaggactggtaggctctactgggggcatttatggtgccacactgggacagagagggggctccctggcccattgcaagtcaccccatggtactgacccacttagcttcggtgtgtgtttgccctaaagaatccagttgggaagatacttctggcttctctagggctgcagctagccccttccacaccttcaaatatctcagcaaacagcgatctttctctctggatagcagtttggtgaatggagctcaaggggcatttcaactcccccttgtcccctccctgtgcagtagccaactttcctaactctacatggcagctgtgtagtttcctgtggcagagagaatgccagcaagagagaagggtgttccctttgatttcgattctccctttcaagggctccttcaagtgacaaggaaggaaaggtcagggtggggtagggtgagcagggaaggaggggggctgggattgcgggggacagagggcaggcctggaatcatttcaaggccttctgtgcaaacacacatgtgtgctgtgagcccaacattatttacccaggcagtgccaacagcccgctctgctcctgggttcccaccccggcctgtgcccacgccctaccccctaggaggccccaccccaggagagccccctctctgtctcccaccccttcctcatcacccctacctgcctcctgccccatccacgtccccagaactcccaggcctgccacgttaggacagtctctgccagcactctgggccatatgccagggagacggaagcttatccaagaagcaggagaacttgcttccctcatggcactcctgtttgcttggccacagccacaggtaggatgggaggcggctgctgtgtttcggggcacagcggcatgagggggtcagtgaggatgaatgggcagggcaggtggcagcatttgctaggcagggatgtgatgacacgtccctgacacgcagtgagcgtgcctccctgagagaagcagcccgggccttcttcacattcctgctccgtggagaggggagtgaaggtgcagaggactaagggatttgtatccaggcctttggactcctggcccagggcttcttcacctgcacagaattccctcctcctccccactccacagtctggcttcccctcaccttgctcctaaatgccaaggcacctgctcctaaccaaggcttgatcccggctcccgatacctccctgctgaaaaataggtcaacaattaaccatgaggtgggaggaaagatctgactgtctataagtggtggtggggaatgctctgaccccagcagcccacatctggggggattttggtttactggacagggagccagtggtttatgtgcctagcctgctagtctggagtcccctccaggctccagggttggactcaggagggaagagagaaccactcagtgtgtacatcctatgtctcaagcattcatgcccacatccccctaactacccacaaccctggggggacgtgggcctgtttcataggtgggaacagtgaggcttagagatcttacacagcttgcctgaagtcctcagctggccgcatgcaggctctgctcattgtaccacattccctcttaggcttctgctccggccggtccattttcccagggtcctgctcacttcttgactgggcaacttgaccctctaaagtccattcccacctcctggctgctcaatctaccccaccgtcaagctctttcctctttaacactccttcactgggcactcctgtgctcaagaacctcccatagctccccattgccagccttgcacaattccaatgactggtacccacctctaagcccacctcctctccagcccagataatcagagttggaaggaccatgcgttaacgtaatcattttatagatcacatatggggaagggattcgttggctggtcagtggcagggtctagaccagaaccagggatggactgacatcgtaacaatatccaggctctaagggcaatggcattttccccctggcctcagtgctgtgggtacaaagtggctattttctcttgtgctgccatccccctgcccagtgcatgccccttccctctcatcgaaattcagcccagagccctcctctcccaggaagtcctccttggcaggttccttctctgacttcccagctctccccatctgtgccacgtaattagccatgattatgttcacaggtgaccattcacccgagaagacacatatacactgggaaaaatgaggatctgagagtggcaaggacatgcccacagtcacagcagactaggaccaaactggggccctgctgaccctcaggcccctgctccataggcctggggccctgggacaagcctctgtgtttggcaggtccagggccttcagaaggcaggcccggccctcccaccggcctctgctgggcccgaggtgaggcccgtctcccgagcaatgccttcagctccgaaacctcgagttgatctcttctggattaaaccacatgtctggattaaggctcagcatgtcctggctccctcctgccccagaggctctggctcagacttcagacaaagaaagtttggtaacagctggtggaggccaaagcccaaatacagggcggaatcgacagggcagtggccagagggattagccaccttggggccccttctctcagcatctcccactcgctcgggaaggcagatcaaggagagagggcagagggaccccgagttaagagatttatagcagctgttccttgccgctgccaggtctgtggccctataactcccctccctcccgagttctcactcccaccctgacctggcaccagcaaaagatcccccgatatctcttgacggcacagcctcagagagatgcagttaccaaggaggtctttcctgaggccctgggctgtcacgggattggagcccgtctcccgtatcctgctcggtccaggctcccacatcttacccggcgagggattgtgggtggcacaaatgtcctcaagcccctctcaatcctgggaccaacctcagtctgccctgagctgaggaccctggctgcagaccccagtgagaagagcaccaagggagggtcggtggggcagggggtgacattgcctaccacggagctggcctttctccaccaaccagggcagccgtcctcaggcttcctcactgctcggccatggtcctggctggcagcccctccctgtccatgcaagggcctccttatgagggaggtggggacggcgggagggcagagtgggtaggggccacaggggccggccccccaggcccccagtcagcacctgcgagaggagccgggactgcccggagtggagtcgggggccagtgctcacgacctgcccgagcaactgtgtttggcttctctgaaccctccctgcctctcccctctaccttctcaccttccactcctcctactgtcccctcacttctcctcccacgctcctgctgccctccaggggcccccagcccccttgccctgtgaaattgctcttcaaacaagctggacccaagaaaattaccccgcctcctccttactgaccaggcttcgctgtccagagcaccgcctctctgcactggacaggcgactttcttgcccgggaagatgtccaggctcaacacctcgggcagctccagccttcctccagcaccccactggggccatccccacacacctgctgccccttggggtcttcaaggcaagaagaagggaggtgggtccggcgggggtgggcggtggctgggggagaactcacctgtcttgggttcagtgtaggagcaggggaggcaggtttcttctaggcctcctggctttctctcacctcctcagatcccagacacgtgcaggccactggcctgacggtccaggagccctgctccctggggggtgcactttgtggagccagtcagtgggcccaggaggtgggtgtaaagaatggggtgtgggggtgaggctagataggaatcagaggctgggtagggagtcgggacacagggccaggtggcaggagcagaaaggtcaagggaacttcaaggaaatctggtctagcctacttttcccatagttcccacaggcagccaggagcccaaaggcacatttgtatgagctacggctgccgtttgctccagctgcgtgagcaccgctggtgtccatccatgccgcctcactgacatcgcttgcaaccccttctgagaccaggtggaggccaactgagtaaactccttcgttgggctgtcccgtggggcacagcccgtgtcccgtggccccacagccatcccgtggggcagccactattactcccacctgacagatgcgggcgtgagtccgtggggactgagcacttctctctttatacatggtactgtgacttggcacctcccagcccctcaggtctcccctgctgcccacacctgtcaccactgccgaggccacccactgacccagccccttggaggtgccagccccacaagggccctgggtggcacggatgcctgcagcctggaggtgcaggaacccgcctcagcaccatgctttcccctgtatttgagtttgctccactggaaatgtgggtctctgtcctgctctgttcgcactgtacgtgaggccctgggcagcgcttggtgccctctgggccccggtctcctcttctgtgctccgaaggggtgagtcatctctcagggcttttctaaccccacggtgtctggattctacgatcccctgtccccatctcacccctcagcctggcttgaaaggtggatggtggagaaacagaggtggattccaggggctactttgacgagtagaaacataattcatggaggacatttgggcagaatgaaggatgtggccatgtctcctccctgcctcctctggagttggtgtccagggcctctgagagacttggtccggcctcctcacccagcaaggcccccgccaggctgcctcttgcctcacatatgaccctctgtgtggggtaccccccagcagcactgaagtgctgacacttcaggcccagagctctggcagtagctgtgggagtcagaggcaggaagaacctgctgccccagagtagagagacctaggcccccaccagtgtcactggtcctaggtgctgagaccctagctgggcagtcacccccagacccttctcctgaactccagagctagagcgagaaggaagggctcctcagttctggtggcggccagagacctcactgtccctctggaagatcctgggtgggctctggtcggactggtccccagcagagtcacactcaggtgcctggctagggaggagaggtcaggagggatgaggaggctcaccctcccccagtctggggccccactcagctgctgaaaggtgggaaaggagaatctggcagggggcgcctcctgagcagggatcatgcaaacgaggcaggggaaaggagcccagcattaaatgtcaggaagagcccagggcaaatcggcttgtgcaaagtttgctttgggaagagtggttctacctgacaggctgctggctaggctggggtgcagggtggggtgaagaaagggagggggtggggctggggcagggtcccagactaggtttgagccccagcccctggccgtctagctctgggactggtgtaagtcacttggcttcctcagagactcagtgatcctgtctgttaaatgggctgtcaagagcatgctttaaggagctataaagattgagggcatgaaggtggatgaaagttccgtgtgaactgagatgggcttaacattcaggaaggtggcacctgggagcagatgaggggatggggtaggaagaggagagggaatggcaatggggtgaagaatgagggtaacaaaggaagaagtagggggtgatggtcggtggagcctggggaggagttgaggttggcaacgagggaggcctgggccttacctgaggtcatcctgccctctaggtcagtcttgggcagctactggcctcactcacccctctctggcctctaggaggagccagagccaaagccagagccgcccgcctctccagacctgagcctaggggtcaaggctgggaaagcacacatcttcgagctctggcaaatccagccagctagccagcctccaccaactcctatacagcctgcaaaacccagctccagatgatcccttccaagaaagcctccttttacggaggagaccaccttgtctaaccttctcattacacagacaagggctacagggaggaagagtgacttggccaaggtcacacaccatgggccttaagcccatcccttcttgccctccacccagagcatctttgtctgcaggtcaatctgaaacgactttgcagattacactcaagcctcaccaagtcgcctgaggaaaaaatggggctctgactgtttcagggctattagctttacacctgcactgacctcagtggtaaaaagtgggttctcctggttttcctgcttattgccaacatcgcaattttagatcgccaactgagcgaacaccctgttccctcaagcttggtggacagagaggccctgtctcattcagggggtccttgtgaaaatcgaatggcatctcatttatatctcattttataagtggcattttatcacaggttgactcacagtaagcaggtctaagagggactgagttttggtctctggggccccccatagtgcctggggcagaggaaattattgtcatttctcaaaggagagggtggctccccatcctgagagaccatctctgctacacctcaacctttccaggggtcccgagtctgtaagtttggggtaatgagcccccacgctgggagtcctcggctctagccccacccccagttgggctagggcttggcacaggtccacacatatgctggggagtctcctgcccatcccatctgccacctcaggccccagggcagcctgatgcctgtttgttttgttactcagtggagcagctggtgctggggagatgcagctttattggggattcctgtgaagctgtttattggggtggtgggggcaggaaatgaggcctcgtcccagccttggccaaggaaagggagaaaggccatactgtcatacaggggacaggcctgtggcctggctctgggcctgcccactccccaacacacacacacagatgcccgtgcacctgcaagcacatacccatacacacacacacaggaatgcacatacatacataccccttgtccagcttcagggggaccccccaacatccagaccgttcagctctctatcccatcattaccactgtcacttccctctctccacagaaggcatctggcaaatcttaggggggtcttcagggacatcccatttccctgctagtgcactcagactggggcccacaggccatttgcttccctgggtccctgaacccccagcggttagctctgcagctccccagaccacctgggtcctgcacccaccactgccgcagcccaagccctggccctgggcctgtccccactgctcccagcctgagcttggccccgagcctccagccctcagcaagcccctggacacagtggcctggccccaggcagacccttcccttggcagagcagctgcagctggcagagcaaaaaggtcgcctgtgttttactagccaagcagaactggccgtgtcttaggggccgaggctctgcacctgcagagccgcctccctcaggctgcacagcccgggctcaaggtgtggccttgggggctcatgcaggctctggggtccacccagggaggcagatgggtggcaggggcaggggcttctgagggtgaaggacccagagcagagggccagcaatgcctgggaggccagttctgagctcacagaccatgcctccaagtcctgctctcccgtcacccacctccccacagctgcgaggaggacacccccgcaaggcactcagtgttcccaccagactcacccgttagctgcctcgtgccagggagtcgtccaccgcagcgccaaccttgggggaggccaggagaaggcggaggcagcgtgggccactgctggggttcagccaggcatctgggggaccagtgggacaggaggccagcagggctgggggcagaggtggtgctcgggtgggccgctggggacctggccaccctcaaggggtggccctctgagatcccggggccttgtgccctgcagggagccctctgcccccagccccagggccacctgttggcacggtggcaggacctactgaaggggcttacatggaggctgtggtgggctcagggcagtgtggacacgggcagagtgcaggaatgtgctgggaggaagtcaagcagccgtgagatgaagagttggccaggcctgatttcccattataagtaatccttccttatttacctgaacaaatacgctccctgcttacctcagaccacaggcgggctcctagttaacccttgcaggcctccttctcctcaaagggggagccacactctcgccgctagacaacccactcactcattcactcattaattcacttacacactcatgttcattagttgatgcatagttactgagcttatctagtatgtgcaaggcacagggggtacatctagagggacgtggggtagggccctgatagggaacagccaagattggggaacagccaagcaagctctgtggaaagtcagagccacccatgcctcctctccaacggaggtctgtggaagcacccagcaaggcaagtcagagaggacttcctggaggaggtgccatctggctctccaggcctgggatggagggaacttcagagaaccctgtggaaaaggaccagaagctcgtgagcccactcactgcgtgtggggccagtgttgtccgtgtccccccgggcctggtgcaggtctagcgtgcagtggtgctcaggaacgattggaagctcactgagccgggggtgggggtgacaggcagcagcagcttgctccccaacagcctctgaaggatgcaggtgaggaggtacccatgcttggcccctccacctccatgagtcccaggaggaccgcagagccgagctctccacttcctccccatcctgccaggtgggttgcgggatgtcccgggagggcaggggctggctcttccttcctttggatcaccctgggaaggcacccctactacccccgttctatcagatgagggcatcttagatgatgctcactgttgttttctgatttcaaaaggaaccatgtggctgctcacagtgagagtattctggggctgcaggaagattccaaggccctcggcactggccctctcaccgtaacggaggccccaattctccagcatctgcttggacccctcatcctggagagccctgtgcttggctgttatggtcgccggcaacttggtaaggatatttccatagtcagtccccagaaaaagtggaagcagcctgggctggagataaagataggtctttaggcaaaaacctaaaatggctacgggcgaccagcccagcccaccagggccaataaaaagaaagacctgtctctgcctgggtggctcagcagttgagcacctgtctgccttgggctcagggcgcgatcccagaatctgggatcgagtcccacgtcgggctccctgcatggaacctgcttctccctctgcctgtgtctctgcctctctccctgtgtctctcatgaatgagtaaatgaaatctttaaaaaagaaaaaaagaaaagaaaaaagaaagaacgaaagaaacaaagagacaaagaaagacagacctctttcgtcccaggcaggacctcctccagaatacctttcataccccattcccctgcctggcaggcagccttcctctccagtctcgcagaatcttgtgcccttctctgcactgtgacgcagtagtaataatgaccactgctcattattaagcacctactaggtgctgcttgacactcaggaaataagatattgatcatattatatatatataatattatatacatatatataaaatatgtactataacatgggtaagtacaaggactacccccaaaaatgctcgttgtttcttttttctttctttctttctttctttctttctttctttctttctttctttctttctttctttctttctttttttttttctttctttctttcaagattttacttatttattcatgggagacacagagagagaaaggcagagacacaggcagagggagaagcaggctccatgctgggagcccaacgtggggctcgatctcaggactccaggatcatgccctgggctgaaggcggcgctaaaccgctgagccacccagggacccccaaaatgctttttcagtggatggggtgtcagaaatagtcacccctattgtccattttccctatttcctcagaaacaagcccctaatttttgcctgggaacttggttacctggaataaagactatccagactccttcgcaaccagactgtgtgtccaggtccaagtttcatgtgccagtttctaacaatatctcttaaaggtaaactggcatgtaccatttgcccctttcttctggaaccttcctccatcttgctgcctggaatgcagctgtgatggagggaattctggttgccattttggaccatgaggaccaggtggtggatcagtgagctggatggagcccaggtctctgaggactgcataaaacctccatactggctctgctctgcgtgtcttggtaaatttattagagaaatagaccttatgctttttgttaagtgtggtctttaatattaaaagccaactttgatcctagctgagacaagaaaataggcagatgaagatagaacacacttggggcacctgggtggctcagtggttgagcgtctgcctctggttcaggtcgtgatcccaggatccaggatcgagtcccatgtcggtttccctgcatggagcctgcttctctctctgtctctgtctctgcctctctctctctctgtgtctctcatgaataaataagtaaaatctttaaaaaaaattaaaagagacagaaccctcttccagccagaagtgatatcccatggctgagtggcattgagaaggcacctggttgtgccacagacaatcttggccttgggaaggctggcctttgaatgccggatagccttactctggttgcaagggagcaccttgtaggtgtctccagggatgggtggacttgaatgggtggaccaggctaagctgtgctgagggtggacagtgattctatctgcccaagcctagagtatgtgcctctggaagctgggaagttccaagagggaaccaagagaagactttccatctgctcagctggggctcacatgggttaaggtactgagaggtgactctgagtgacttcagaggtgggttcaaggcagatttggtggtcactcaggacattctgctgggttccaggggaagggaggcccaattataagctatctgtaccccgtgaagggactctgggggacacacacctctcaacactttgatccatccaacatcatgctgtggcaccaactcagaaattgacccaactatacaatcaggttctttcactttccagcttcaggactttgtctaagtgtctgaagcctgctgaaaccccctctccccatccccagagaagtctcagagccactgtgggaagagatataatattggtgaatgtgttctgtgaatcgagacacctgtcccgatgtcttgctgcaccaaccacagcccccctatttgatgtgtgtcatctaactcctcatagcaacctctccatagatattgctatgtccattttccaggtgaagaaaatgaggctggaatgtgagaaatgtcttgcccaaggtcatgctgagaagcagactcaaactcaaatctggagtttccttgattgtgctgtgcctggtaggaccctgttactatcccttgtcccctcagggtcaagtctcaggtcccgggcatgagtcactgggtccactgggccatggccctcccccctctggctggtgtcctcctcaactctcctctggccagttcccatcaggtgaaacgtacctccttcatccacataccacccacctgttgtgggcaccctccagacctgaggcctgatgccacttcttggggttcttctccaactcactgagatagtgtattctctcttgccactgggagctctgagccccagccccagggacagtatgctgtgacagccccaggacaagaccccagtaggagcctctgctgagtcaacacccggatgaaccagtaacatcctttgtctgttgctcaaatggatttacgttgagtttcttctacttgggattactcctcatgcttcaagccccatctcaagagctggcacctccagaaggttttctcgtgttccctccagcccttgcagactccccatttcccatttccctgtactctaatgtctcccagtggttcttttctccctaagattctcacctgtccagggcaggggcccctgagctgtggcagcacaggagcctgcacacagattatgggtcctggtgccaacagcctgagccctctcccggggtgctcctgccaccactcacccatcacccatctgagagtgagagcacctagtgggggcagggcccatttactagcagggtgacgggaagccggctcaggcccctctgggcctcgcttacctcctctgttgtgtggagatcgtacttgccctgctgaccttgtgaatagagcaccgagatgtgtgagtggccgctgacattggcggctggaagtactgtggaaagggcagtcagtgttggtgggtcggttggtcagaacgtccccttcctagctttcttcccccatcctcccacctgggtcctcctaggaactgcagccttggggtgacggcagggtcaaggctgggcctcatgccagccagagagatggggctgtccctcccagttgacacaaggccctgagaaggagggaagactgccctgatgaggtgtagagagcctggggctggtccctcagatgggaccgcaggggctgatgggcaggaagcctggcctgccacccgccagagaccatgcagttttcgtggcacagtgggagactctgagaccagcgacgctggggcgcagacccaaggacacacaaaaggactgggataggagtccagcctccaactgtgctcctgtgtggtgtgtgccagctcatctaatcttttttttttttttaagattttatttatttatttgagatagagacagagagcacgagcagggatgtggggcagagagggaaaagcagactctccactgagcagggagcccaatgtggggtttgatctcaggaccctgggatcatgacctgagcccaaggcagatgcttcatccactgagtcacccaggtgtccctagctcatctaatcttaagaagtccagcacctgagtgctctgttggccttcttgtccacagatgaggaacaggggctccttaggcatcgccaaactcaaggctagaaagtggcagacgcaggactcgggctgggtctgttggagtctttccaggataccatgctttagccaaatagtggacaaggagaccaggaacggcgtggggtggcaactatgtcctaagcgaccacacaactaggcatttccactaactagagcatgtaggatgccacctcggtccaggggaggactgttgggcacccctgagccgtgacatgtttctctgttcaactggcacacatttcttgagcacctattctatgccaggctctgtgtggccagaaatagcctgtcgtcaaggagctcatggactgggggccacagtgtctctctgtctcagagggccccgatgcccctagcagccctccgaaggctagccatctgtggggctactggattcacaaacacctattacatgcaatgagctataatgcgtggccctctccattctacccagcttggggcctggttccccagactctgggcttcctcaccaatgctcctgctcctcttcagatggacgcctcagaaagagaccccagacccctaagggggaagttgagtggataggttgtatgtcacctccttccctgtggtttcagtcacccacccccatcatccattcacagctaggatcccatgtgaggaggcttcactccttcccagggccccctcagggtccccagagtttcctgtgaactgagccagaatgggctcttgccagaggtggtctccaaacctgaggaaccctgcaggcttgcagggggcagagagggtgtgcactacacacacacacacacacacacaccatcctccctactggttccagtgatgatagagcaggttgggtgtccccttggcccggtccctgccacatcaatccattcgctccacaaatacgtggcctcctggtctgcagtgggccaggcatggtgggtttcactgggttcacattctaaagggaaaagacagagtcaacagtaaaagtaataaatgagcacattataatagaactccagaaggtgatgaatgccatgaaaaagagggccaaggatgtcaggagtgccgggtggggcgtggggagcagtattcaagtcagtggtcagtgcggatccctttgaggtgaggtttgagcacaaacacggaggcgagggcgccgccgttatctgtaaacattccgggccccagagcttgagcaaaggccccgaggtgggcttgtgccctgggtgcttgtggagcaggcaggaggccggtccggctggggcagaaagagaaggcagtggaaggacatggggccagggaagcggtgtggctggggccagcgttcagggccttgaaggcccagcctcttcatttcccgggacctcacttacctgggctccggtgacccgggtgccaccgcttacagccattatttatttggtcatcttaagggccctttgaggtggcacccctagcaccagggagcctattttaacctgggggggaggggcctgggatgggggggggcggtgggtgggggagggggggggggtgggggggggggggggggggggggggggggctgggcgcgggacgggattggcagggctaggggggggggggggggggtgggggggagggggaggggggacaggcggggggggggttagggggccgggggggggggggggggggggggggggggggaggggggggggtagggggtggggtgggtggggggcggggggggggggagggggggagggggggggggggggaggacgcggggcgaggggggagcgcgagtggggggaggtgggggggggggtggagggggggggggggtagggggggggggggggggtgggggagaggggggtgggggggggggggcgcccggcggggggggggggggggggggggataatcggatcttgtgcggccgttgcaatgggcgccggagctgaaggttaagcgcggaatcagttaacggagacctcccaacacggggggggggggggggcgcagcagcggggcgctatcagcagccctgcccacccctgccccaggagcccctttgaaatttacccaccttatcggcgggctcccccagggccgcccgcactgcctttgtgcccagctgcggagggtgcctctgaggtgcctccccctggcccggcctctgccccagaccccgtgcggggggccggcaggaaggaggacctggccgtgggagtgcacagggccacctgcagggtgggcgccaccccccgcccccgccacacacccctgcaccaagcccgcaggactcagcgccctcacctctgtctccagacctctcagccagcgcctcctactcggtgccgggggagcacggcccccacctaccccccaacccatgcctgccccccccaggcacgccctcagcacatgtttattgagcagttactagggccaggccctgcacagaccaatctcattcctatggagctgtcgttcgcgggctgggagagaggagaaacacacacaaataagtaggacgtggagtgtgtcagaggtgacaagtgccgctacggggcataaagaaagcagaaacaaaaaaaaaaagaagaagaaagcagaaacacggaagtgctgggcacgattggtgtgtgcatgagggggtgatgcttgaatcaagatccgaaggatccttccttgctccccatcaatgcagttgttagaaccacagacacagggcagcccgggtggctcagcggttagcgccgccttcagccctgggcctgatcctggagacctggatcgagtcccacgtcgggcttcctgcatggagcctgcttcttcctctgcctctcataaataaaatcttaaaaaaaagaaccacagccacagaagggcagcaccaggagggcagagatcaactggtcctacagactcctttatttactgaggcttagagagggcagtgaggggcccaaggtcacacagcacaacagcagcagagcccaacaggcttagagcccagtgaggacacttcccgcccttccaggcatcccttgcctgggccactagcaggccctgggcaggatgctgtggccattgccgggcacctcgggggagcgggctaagcctgggccggcagatgctcagggccatatgacactgccttttgcagcccggggcctgcagggtcttcttggaggatgagtgtcatgccccgggcccagtgtcgcggtcctcccgcccagtgtcgcggtcctcccgctccctcaccgcccccatgtagtccccgtcttcgctggacgttggagtgcaccagctgcccgacctcaaggcgtgctcttctagaagctgccttctccggggcgggtccagcgcagcctcccactttctctgtgggcaggtagcacgtgggccgggggggccgggtgggcagacttgtgccggtcgggctctgtggggacaggtgaccggatggaagctgaaggtggctcgagctgcccggctgctgggcaggccatctccttggggcccggcttgtgggcatcagaggccctcaggccaccgttcccatgggactgaagaacccgaggcagttgggaaagagtctggagaccgagttcaaattccagctctgctgcactctcgttacatgaccttattgggcaaatcaggcaaatcgcttcccctctcagcctgtttctctcagtaagaggggaataaggcctccttcttcagagcgatgtcatgaggagcaaatgaggagagaggaagtgggagtacctggcatgcaggtgggcctgtccacagcgggctctcttccctgtggccctccactagacaatggccagagtttagggagcactccgcatgtgccaagcacttcagcggcttcttttttaggactcacattaatcggatttacggtaaatctgggtttatgacacacactcaccatgcatgcgtggccctcctttaatttttaataatataatgaacatggtgaacccactgccaacccagggtcaatgttattaccagcagtgatacatgtattaacttacttatttctcacatcagtccaatagtttatctctgaagtctcccccattttacaggtgaggaaaccaaggcacgattgagggtttagggcacctgccccactgggcaatgctggagatgcactgggtgctttcttccagttgacttccattctgggccccaggaagacggagctctggacaatgatgccatcacacaacccccaccctggccctgccaggttgggtagctctcctgaggggattatagccactggcagctccctttccatgcgggccccatctttcacctgggggagctgtgaggagcagcctgcctggtctgggggctccctgcgtcccggggcctccccaggccaactcttggcccctcaggggttccccccgacccagcccagctcaatgacacaagagcctcgtgctcctaacaaccctctgatgctctttcttggtggtagcccaaaaagaaagaaagaaatgaaatgaatgaatgaatgaggatgctagaagacggagaatgatattaaaacgaaaaatggaggagggagagatgggaagtgggcaaggtgggactcagcattgaaagctgcccctctgctaccgcctcacccctccggtggtggatgggacctttacatcctactgtctgggccctgaccctgagaccctgctccctcctctttggggacttcccagatgccaggacagccacagagttccccagaacctctttttttattttttaaaagattttatttatttattcatgagagacacacacacatagagagagagagagagagagagagagaggcagagacacaggcagagggagaagcaggctccacacagggagcccgatgcgggacttgatcccaggaccctgggatcatgccctgggctgaaggcagacgctcaaccactgagccacccaggaatccctcccataatgtcttaaaatgaatagagctaaagccactccaggagcctggggtgagggcggggcacccctgctgggcaggagcaccatcagccgggaagtgccaggtgcttggcctgctgctgggaacagccagccccccacatgggcttggggagggcttggcagagtcaggggtaggctgagattgaaaattctggggcccgaatcttttcagcagtatttagatgcaacatggtgcaggagctttcttcctcacacatgtgggtcttgacctacatggggaactggtcactcttgagagtgtgctgaaagctatagattcctcacctctgaacacacacagacacacacaagcacaccaattccaggggctcccagagcctctgaaacccctccatgaaccccagaataagagtctctgtcctggatggagggtaaatgctaccagaattgcctgatccacctcacagcaaaacatctggcatatagtaagtccttgctatgtgtttattcccccaaatcaaaggacatcagcttatcagatgaaggaaaggggagccatgggaactcatactggatccgagtcagagtcggggaagggaaaggaagtggggggcaggggaggctgttcctccattgcttactatcctcccatggctccccatggccctcagagaaagcggagccctgctggctctgccccgttgcctgtcttgctcctgcttgcaaccgcacgtgcagattcagctctaggagctgccggcagctctccttaaacacttgcttcttccagcgttgactgagcatctgttgtgtgccacactgttctagatcctggggccgccgcagggagtgaaacaggccttgcccttgcggggctgatggggctgatggggctgatgatggctctctcttcctggcttgctacgggcactcgtcctttgtgttcagaatccctgtgcatcatctctcccctgagaagcattccccgatcctgcccttcgcaggaccctgagatgacagcacacgtcccaccataccaattgtccttcttctggtctgtctcctgccctgagcaaggagtacatggagagagggctttgtcttatttgcccagcacatagctgtgcatggaataaaaggatggatggatggatggatggatggatggatggatggatggatggatggaatttgttggggatggggctatcaaccaggaagtgggatgggaacaggggctgagctgaggtaggtctgggaatgtccctggggtggacagagggtgtggggaaggtgcagggctgggttcccttctcttggttcccatgtgagacctaattgccccgacaacaatggccataggcgtgtgggaaggaaggtcagggaaggggtgacagagaacaggatttgtttcctcatctggggtttccagccactctaccccacctggcactccagtcagaggcacccttcccctgaagtgacttaagccctgccgagcagggaagactggaggcagggtgggcagtacaagacaccaccatccccccaccccatgtggggcctctgggggttagggatagtgagctcttacctccctgggttgtgacctctgtgtcaccagtgccaggaggggctgagaccttgtctgccccacactcagaactcaagacagcctcacagagaatacgggggctgcctggggtggcatagtgggccagggcttgactcagggcccctgctgtcttcattctcagccaaggtctacccaagctctgccaaaccatggaggggtttctttgagaatcaccccttcctagtggaagggcaagctgccttctgagggtccctacccagttggagaagagcagaggcgaggcctatccctgggacaccagtggggagcagaaacagggttgagggttggggggaaggggtagatctctctccttcccaccattccaacactgtgactgcctcccctacttccttccccgctagggccgccctcctttggctgccatctggaggataagaaaggagagagggagagagaacagcggctggggaggggtgctgttcttaggtgtgcaaggaccataaaattcccattttatgggtgttgtgtgagtgcagatgcttctgctccacgcaactatggatctcagagctgaaggagcttctggctaaactagtctaatgattcgttttacagggatttggcaaaggcccagagtggaaaaatagtcgctgaaggtcacacagcaccaactgctcagtttctggactgtttgctctggtaccaggcattctcccctgtgctttacccgtattaactcctgaatcctttcagtaaccttaggaggggggtgcactattataatccccattttacagatggagaaactgagatacaaagaggtcaagatggtggcctgccacgttgaagcaaatggtgggtatttgtcatttctaatagctgagtaatattccattgtatacataaaccacagcttctttatccattcatctttcgttggacaccgaggctccttccacagtttggctatcgtggccattgctgctagaaacatcggggtgcaggtgtcccggcgtttcattgcatttgtatctttggggtaaatccccaacagtgcaattgctgggtcgtagggcaggtatatttttaactctttgaggaacctccagcagttggggcctttcaaatataattggtgcctgtgtggaatttatttcccaggctgactgtgattgttatctccatgacatctacgagtcattcctggggagataaaatccaaactggagcccagctgccctggagcccaactccccaggactcaccggtggtgggtaagagagctttacagggcattctatagcctgccacgtcagaaaataatgactcaaaatcaggctaagaccagaaggggctagcagaagtcaacccatgagggttcaatggctgagattaatctggatccctcacctcttctcccctggactgttgaaatctgtccacttttcacaaactgaacttctttcaacaaagagcagctagttctcgactggagagcagcacatgcacagagccagactcagaccccgtaggacgtgctctttgaaaaaatgacttcaaggatagagacgcctgatttggggctaggagacactgcaagctaatgaacaccctccttcttgagatatggctaacagtaccccagcccccccccccactcagaaagtgggggattcctgccttcgagaagactctgcacttctccttagatggggaagagtatgagcagtgagggagagaaagcgaaaccacagcttgctgtgtgcccaccactccccgcccaagggccattgctctgcgtccccatcacgggttcctgcccgaaggctgaaggcctgcaggatgcatggtgaatgccgctactcacagctcccggttttccccttgcaccaaataacctgtgtgtgtgatttgtcatttccaaagtgaaaacgtatctctagctgctttaataatcccaacacatgggacgcctgggtggctcagtggttgagcctctgcctttggcttgggttgtgatccctgggtcctgggatcaagtcctgcgacgggctccctgcagggggcctgcttctccctctgcctgtgtctgcctctctctgtgtgtctctcatgaataaataaataaaatctttaaaaacaataataatcccttgagcagccccggtggcgcagcagtttagcgccgcctgcagcctggggtgtgatcctggagaccccggattgagtcccgcgtcggactccctgcgtggagtctgcttctttctctgcctgtgtctctgcctctctttcgctctctctgaataaataaatctttaaaaataataataatcatcatcatcatcatcccaacacgtgcttagttgctttggtttttttagggggtaatttctgtggctcctctccggctatttcttcaacctgtggcagatgcacagcccccagggcccattcatggttgggaatctgctcatggctctgcccattgctagctggacacctcctggtggagagcaggtaacttccaccctcctgacctcagtttcctcatctgcaaaggacagataaataatggccgctctcctaacctgatgaaggaggtcatgtagataaacacattagcagcatctttgtgcaagtttcagagggaaaatgtagtgattgaaacattccaatacagttttaacgttttaaaatgttcttatggtttaaaaaaacattattggatccttgggtggcgcagcggtttggcgcctgcctttggcccaggtcacgatcctggagacccgggatcgaatcccacgtcgggctcccggtgcatggagcctgcttctccctctgcctgtgtctctgcttctctctctctctgtctatcatgaataaataaataaaatcttttaaaaaaatttaaaaaaaaaaaaaaaaaaaaaaaagatggtggcctggagtcaacaggttgaatagcagtgctgacctttgagccgaggccgcctgtctcagtgcctcaggcagactcccaaggagtcttagtcagggggcctgggtggcttagtcagttgagcatctgcctttggctcaggtcatgatcccgggtcctgagatcgagccccacatctggctccctgctcagcagggagtctgcttccccctctgcctctagctctaccccctgctcatgctcgccctctctctcaaataaataaataaaacttaaaaaaagggggggggaatctcggtctgtccttggttctccctgctgtgtgacttcaattcagttttttatggtctctgtgcatttattctaataaatatattaatcacattactatgcgtttattggacgctttctgtgatctgcgaataaacgccctctctacataacgtccttccccttcgcacaatcccgtgggtaggtagcataacctccgtttgcaggcgaggagaccaaggcccagagaagttaattgattgaaaaaagataataataaaagaaaagaaaaaagaaaaaaagaaaagcaaagcagttaattgacttgccagttcacacggccgactgtactgggtcgtgagtcctcctaggaagtcgttctgtccagcccctccctccgcctttggaggcctcctgccatgcgtgcccttcgctggccccagccgcctgcgccctcccgccccactgatgacccttgccctctcctgccacccgacgccactcctgcgtcatgtcagggaagccagcatcccgcgcccagtctgggacgtggttggcagcggctgcaggaagcggcctccgggcatctcaggtgtcgccccaccggcctcgctccctccctcctcggcctcctgggcctcccctcggggcgcccagggcgcttggcaaggcccccagggcagaaggggggttcgcagagctgcggggctcagggcaggggcgcagcgccagggcccggagggggcagctgggatgcagccggcggggagggaacacacatgctgagcaaaccacaaccccatgtggtgctgtgctcggtgcttctcacttgggaggcagggagcgagtcatgggggagtggcctcccctccccgggtgtcaggacgactgtgggtggaggtgaggaggggcctggctcctcagatccagcggaggagagcccgtagtgcgtgctgtgagaggggcctgggccctgctgggccctcacaaccctgtgggggtcctctgggtcctcttctgattcccatttcggagataaaccagctgagggggcagagggaaggcagcccgcctgtggctgagccaaagcagagctgattggaagggggctggccagggtgactgggaagtcgggggtggggggtggggggtagcaccaaagcaggggggccgggagccaagggagctcaagacctagctctgccttggacttgctgtgcaacctccacacgttcctttctctctcggggcttcagcccggtcttctgaaagccaagcggctggattagaccgtctggctctcccagtacctgcccaccagccctgtggttgtggggagggactcccaatcttcccctcactggatttattctccatcgccatccccgacactgccactctggtcaggtagaccctttacgtatgtcgtttcatttcatccccccacacccttgagaggaccctttcatttccagtttagggctgaagaaactgacacccagagaagggaagtgggcagaaggaggagcctgacctccatgcctctgcctctccacctgggttaggtggtcacccagccccgtggagaccaggaccacctccagcccaacagacccaagggcggccagtttcaggatggggtgcctctcactcctcctggggctgctcaggcctcagcagggatggggcacgggggtgctggcagcccatccacacgcaagggctggctgtatgcattgtggtaacagttgctctttctctgcgctgctccgtctgggagcttccctgcgtgccctctgggaagaggccccattctcactaagtggacaaaataccaacgagaccgtgcacagaccctcaaaattctcaacactttatatattttaactgttgaagtcgcacatcaagcctaggaggcgggcactatcaccaaacctgttctacaaatgaggaaactgaggcagaggacaggttacatgacctcccagggagcgcagctggcacgcacagaatgaggatttaaaccctggcagcttggctccagaaccaccatgctctaccccctcccgatgtgcacaggaaacaaaggaaaacaattgtggacaggcaatctgtaattaccaatttacctgtacgggacagactctccctgcccgagagaagggagtggggagcagatcaaagtttcccagaagaaagcctgagtcctggtgaccggggaatgggaaggggtgggtcagggtcgaggcctgggtcttctggtgacggggtttgaccctgggtctctgtcccctaggcaccaggccctcttcttccagcccccgcctggccccacgcccaccctgacactcccattgcacagggcaaaaccaagattcaccgagggtggagggtgagttcctgggggcccaggaggaggggctgagggtcctgagccccagctccccaggcttctcccggcccacctggggaaggatcctctcctccccttcccttctccctgcgccgccaaggtaggtgggcgctgggctggtgggaggccagcgtctttcagccttcacagccccccaaggaagggggccatttcacagagggacacacttagagctctctgagtttcagtcttgcccacggtcacaccagctgattggaagtgggtcagtctgcctctctcgagagtggggaggaagggtggaaaacagagaggagaagagagggttgggggttgctccggtgtcctgggcccggctctcacagcttgccccagcttctgtctccctggctggcttccctcctcccccccaggaaggacagaccttagcctcagcccccaggcaagagtgaggcatggtgggagggcgggaggggattgtcctgatgagggttccagtggggtgtggcctcctgggaggggccggggagggactgtttgttcccgggtggcccaggcttgaggatggctttatggtgccatctggaagatgtggcatgggtgggcctagctggcacggggccagggcaaggaagggggcacaggggcagagtggggactgcccccggctgttgcctggtcccaagaggagggtggaggcccctggtgagcatgagctcagcggagtcggacgaagattctgtgaagtgggaactagtcccagttcatgagtggggacactgaggccagcagatccgtgaactgcccaaggccacacctggccgggtatgaatgacattggagcccatgtgctgcccgcacacctggctctcggcactgccacacaggcactgggcatctagaggcaagcctggaaccagaggacctggcccagacactctgaaacctggggcacgggtctctacctccacagggctcagtttcccgtgctgtacaacggggtaacacgccttctgggttgatcagtgggagaagctgagatagtatctgcgaacactgccggaagcgtaaaagcaaagtggtcccagggatggatgtgggtgtgcttttttatcgtggggctgtatagggggtgtatcgtgggggtgtatagtgagcagtgctcactgctgccgcaggtatccgagaccttgactgcaggatccggttctgcccctgttacttccctctgggggagtctgagcatgtgtactcctgtctctgagcctcggagttcttctgtgtcaggtggcagcgggcggggggtggggtggggggcagacaacacgctctacagagggcccaagggaagctccaggaagcccctgtatgagaaaatgcatcacatgcacacatagggtgtaattactgaataacaataataacagattattattcagataataatcactgaataacagtggggacccagtaagcagtatcagtccttagctcctcagtgaggggtttcttcagtcttcctaagggtctcagcgacatcacagtgagacacaaggtctcctgcagcaggacttgcagaaagagacaatttggggcaccagctcatttttacgcctctcctagtgccctgacacagctttctccgtggagaagtatgctttgggcttaggggctctgcccttggtggtgaaagttactgctcttatatggctagtttgagggtagggctggctcccttccaagcccagtgagaggccaggagggtctgcctggggatgtggggatctgaggggagggaggccccgtctctgttgtcaggtgtccactgtacaaccacacacacgggacccaacccactagaggggaccactcaggggccccacccagacaagtcttggacctccagcatgtgctaggtgtctacaccagcagctcctctgcacagcctcaggattgctgtagggcctcctgcccacaccccgctgtgattctttctgtcccttctccaggctagggccagcctctgggctgagggtcctagcacctgccacctgccttgggcctttccatccggagctgtgttctatcacctgcccctcaagggtctacagcctttggattctgggccaccttcctgggggctgcccacatttattcacacacacttaatgtcagccatgtgcctgctgcttcttgatcatctggttcatcactatctaccgcctttccctggtttatcttcttggtacttagaggagcctgaaaagaccttctttaggttttggtctgtgtccccctcagatctgtgtccccctcagaatgtcagctcagggcagcctgggtggctcagcagtttagcacctgccttcagcccagggcatggtcctggagacccaggatcgagtcccatgttgggctccctgcatggagctgcttctccttctgcctgtgtctctctacctttctctctctcataaataaataaataaataaataaataaataaataaataaataaataaatatttttttaaaaaaccacacaaaacagaatgtcagctcctagaggcagggactggacctaccttgtccactgctgtctctggttctggtccctgctatgcaagcgaatggggaggccctgcgcttctctgctgatggacatcataggctggtgctccttgttcttataagtaactccatcctccctccccttttactcaagcaaccctgggggatttctgttactggcaaccctaatgggttcagaaaatgtgctgtaggctccttatccgagaatagaagggtgggggggaacacctggctttattaaggcacagaaatggaagagtgcagggcatacatagggaagacagtgctagttgtctccctaatatccactctcttttcttactaatggaatcctaattttcctggatagaatattaccagcattccttgcagacagaaggaatagtttaccaagttctggctaatgggatatacatgaagttgttaggcagggatgccaggatggttccttagaaaggggacttggtctttcctcctttctgcctggaactaggatgtgttggctggagctgtggtggctacattgtgatcatgaagaggccttgaagatggaagccagccctgtaattgcctttggactttacatttaatgagagaaaataaatccctatcttgttgaagccactgtccctcaggactatgttacttgcagcagaatgcaattcctaaatcatttaagagggtctatcaatatctccttctttgccatctcctttgtctaggtggtcttgggtaccatttcccttaaggaggcctttgagaagcaaaggggatgaagggagggggaacagggcctagatgtggagccaatcctgggaggagatgggggtggacaggagataggtcctctggagatgagccatgcctgggagtgtccagggaggctggagtctgaagggaccctaaactcagttctcatccactgttcctctcaacaataaatttgcagagatgacatccaagtcacatacaaatctccagtaccggggcacctgggtggctcagtgattgagcatctgcctttggctcaagccgtgatcccggggatcctgggattgagttctgcattgggctccccacagggagcctgcttctccctctgcctgtgtctctgcctctctctctgtgtctctcatgaataaataaataaaatctttaaaaaaaaaagcaaacaaaaaactccaataccaccacctcattcttccaaatgcacagagccaatatttgaaagtgctctaatagccaggaactacgccaggctctcttttatggcagccctgcccactgcattttagaagggtcagggccagggactgaggctgtggccagcccggggagtgagagcagccaggccagaggccgtgagcagacctgggcgtgagcacagatgctattcttctggctgggccaggcccttgaggacagagtgctcaggtggacactgcagcacattagctcccatcatgtgggtgaagagacagcccagagaggggggctggttccagcagtcacacagccccaaaggcgggaccaggtgaaatgccagagtctacctttcacagaatccaccccggcctctaaaatacaacaggtatctctgtcattttcccttttatggctgttctccctttctggaatgctcttttcccagacatcacaatgatcactccctcggctgcttcacctctttcttcaaacatcatcactttctcagtggggacctcccattcagagtcgcgcttcaccttcccttcactatccccttctgagtctccatgtccctcctcttcatcccatatactatatatttcacgtttctcagccccacgattttagtctgtctcactgctgcctcctcagcatggaagactgggctgggcccaaggtagggaagtgcccaatacttatttattaacagggtgaataaaagaagaaacatcaagcttcaccagtagtgcttccacagatggagggcacgatgaagatgcttgaacggcctctacctgtgcagaagtgacctccaatgcgtcctctgcccccacggacaccacaagccccagggcaggagctgcagcccctgggagcacagcccagcccagcacagcacacagctcgcccagtctttgtgagccaagaagcaccctttcaagggccgattgaaaacaaagcttaaattgtctctgctgctttcctcatggaaaaaacaaaataggcccttccaccccttttgtgaccacagccctctctgcatgtgagagtgtgcacgtgtgcgttgcggggtatttaggcaacgtggtagtctggggtcgaacagctgccagcctggccatttctcagcgtgggactccgtttccccaccgcttaaatgggaataatagcggtgcttaccctatcagagtagtagggtttcttgtgcaggctgttgattgggagggtgcaccggacgtgctctggaccttggcctgcgtgatggtgacgcagggcgttgataggaacgagttcatcaagctgcacctgtatgctttgtgttctttatgtatgtaagatatacgacagtaacagaatagcagtgaggctgagcagagcaacttcaaatacgcctgaacgatagcaaaaactagtaaaaaaaaaaaccaactatgaagtacggacatgtgcaggtgggcatgtggtggtgtgagcttgcatgccccaaggggtggtaacgggtgggcacctgtgtcagtatgtgcctgcacgtgtgtggtgtgcatgcgttcctgcgtgagcggagccagcggtgcacaggtacgctggatcacacgcttgtgaatgtgcttgtgcacactcaggtgttagaggctctgttccttggactccaaacactgagcctgtgggactgggatgcagtggtgctcttcacaccaggtaaggcggaggctggctggcacagggcctattcccccatacccaccccatgcagggggtggcaggcaactgaaggcctggccaagggctcccggccacccttcccttcccatagctgtaacttctcaaagatgcaaattcctcttcactccatgcaaaagagtcctgagagccaaggctgcctcccctcaggcccaaccactgccactatgattggaccccaccggatgcctggctgcccagcttgaggatccgagccagctggagtcggttcctgtttcccagtcaccgattctttctctcccctgggggaccttggctgtctctgctggctcaggtgtcctggagagagcccgggctgggtgtggccatgctggctgtgggactctggggaaggccagtgccctctctgactaggctctacccctcttcctggtctcatgattgggatgctctggaatggtcactgtccccaacccaaggctgctggggagaggcctggctgtcccagactctcctgcactgtgtattcactgtgggacccactcacaggacttggcctatccagtggcccactggtgctcacttttcctgtctcctaggtcctgtctccccacagggacatgtgtcttcatcaaccctgggtgacacacaatggggggttgctgggaagggagcaatagatacacagactgcccttctgacctggcttggtaacaactgcccccaatccaagccttcacccccatggcttctggataaagcatgctcaactatcaggaagccaggttgtgtgggaggaaaggggtcagagccagagatggtcagagatttctgcactctctgacaccagcaaatcccacgaggatggggtgcaaacaccattgcagtgcccacctgtggcctggcctccatccctggccctggtattgatatgggcccttgaaggcacctggaagcaaacgtgtcagccccactgctccaccctcggaagtggtaaaccacagtggccaaaccagttctcaggcataagtttcaagctgtcattctcaacctcaggcacacctgtgataccctctccctctaggagccctaccatcgtctggggtctgagctgggctgggctgggcagtgtccacctccagaaaccaggccagtcgcaaggctgcctctcctacacacttatttttttctccactcaacaaaggtgtgttgggagcctactgcctgcaactgtggacagagcctcttagaattaggatctcctagactcctttccagaatgatcctttcctgcaacccagcccctaccccagaccaagaaacggccacaaggatttgcttgaaataagagctgtggtgcagggagactcccgctcaggttgtggattttctagactctgtctgccaaatgcccagcgtcccagtcccctctcctcaggagcctggacctcccacctctgacgggtcacaaaaatataacaacagcttcatgggacacttaccatgtgccaggtatatggtgctggctaaacttctgtgatgggtttcaattctcatgacacctctggagctgtcctcattacagaccgagacagtgaggctgtcagagcataccctgaccgggcccaccatggaagagcagcagagcctcaatccaagactcaagctcacctacctgcaatggagagcaggggccacatgccctggagcagtgcggatctgggaaacatactttcaggggagccagcctagggcagcatgacatccctctggacaaggcctgggccacagggcgccctctgctggccttgggcccaaccccacaccagctccaaggtggctccactcccaggccccaaggatacggatcctgttccctacacgcccccctagagggccttcctcgtggttcagctgcaatccctccctggcacttgctgtcgcactgccctccacactgcactgccttccaaccgtctggggggcctcggctgctcagaagcccaagtagtgatagcccagcctttcagggatcttgggggtcccagctgctgacctggcctggggtcccccactcagacatagcccccatcttctccacacttccctgtcccacagcctggcaggaggaactcctagaacttgactccgggccctggactctccttgggaggaggggaccacgggaatgaagttacaacccactggggcccttgcatcacctggctcctgggtgaggccaccccggcctggacagcctgcagccgcacatgcctctacccgcatctgcaggaacgatgagcacagagagctggacagaagggaccgttgagacgggacaagtcaactgcagactcggagctctgggtcaaggaggatcatcacaagggagtgggggcaacgagctggcttggagggggtgtgcggacagatgaggtcagagctgggggcactcctgtgatggacatctctagtcctgcagctcgactcctgcctcgtctccgacccccccgtctccctagcacgtggcagacctgcgtctccacctggctgctccgcgcatcctacagatgccaacgggcacaggtgtgcacctgcctcagagccgacctgcgagctgctcctcaggcagtcctctgtctcggggagcagcgatgcccccatctggcacaccatccctctcccagcactcggcatcctatccgaggcacagactctcggctctgcttcccaagtgttctgagaacctaaccacttctcaccatcccactgacagcacccggtcaacactggggcccctcgcttctgcccttgtctacacctacagtgtagtctcttttagaggatgtgctcaccgccctccgtctcctccagtgaaagccaaagccatgtcagtcacctcaaagccccacctgacttcacacccctcacttttctgacctcattttgaaagtttctattgatttgagagaagaggtggtagtggagggctcatgaccctgagatcatgacctgggccaaaaccaagagtcacttaaccaactgtaccgcccaggcgccccttacctcattttcttttctttttttttttttttttaagattttatttattcatgagagacagagagagagagaggcagagacacaggcagagggagaagcaggctccacgcagggagcccaatgcaggattcgatcccaggattccaggatcatgccctgggccgaaagcaactgctgagccacccaggtgccttcatttcttactactcttattgctcagtctgcaactaccatgttcccacctcagggcccttgcatttgctgttctctctgcctggaaccttcttcctccacatatccacaagatgctcttcatgcatcttcttagcgaaggcctctctggccttctctagcagtcctttctcccacaccagcactccctgtcctttctttctctctccccatagcacccgtcacctcttgacataccgcatctgtgtttcttgtctgttaaccctggctggagtgttggctctatgagactagggactttcgtctcttttggccactgccctatctctagcacctagactagtgcattgcatataagcaatgctcagtaagagtgaatacatgaagtgcacaggggtgagggcagcagagctctcccaagcagtgactgggaaggccatccttcttcctctcctcaagatacaaacggggccacaggaaggaacacacagaggcgctgatctcctgtcaggggctcagcatactaccctctccccaaccttcccacagacggcttcatccactcccttcccaatcctccatcctcaagttgggctgaagtgccacttcctcccaggcacccctggactaagtgggggtacatgctttgtggtgcctgcacttctgtttcgtgagtggtgacacttaggagtttcttgttcacaaaatgagcatcagactggcctgccttgcactgtctcacgcttgtgaggattcaatgaattcatgtaaatagttttaataggagttggtcaacagcagtcagccaatatagccacatttacagtggacactctgacatttgctgtttgtgacaaaggcaatacactagaaggaacgtgtaagccagaagtcacagccttggataatccctgggaaatgctggggaaccatggcccacattttgagtatcactgttctagattctgagtattactgttcaacacccccaaattctagtgggtctggccaccacagccctggctagctctagctcgatctcacagcttgcagcaggtggggggcttgcgatcccttcacgccattctctactgtccccatgcaaactccagtccccagagggagcagtgtctgctcacctgggagcttgttagacatgtagaatcttgcctgcttccccaatatttgctaaatcagaagttgcatttaatacattcaacttgtgaagcactgccctagattacagcatctcaaagggctaagaaggatattaagcacctcacccccaccccccagagctccatctaagtcctggcttttaaacatggccatggacgttttacaaaagagaaggcatctgcgatccatcagtcatgttaacctgtcagaatccattctctggacaccctgacccccaaactcgaacacactctcaggctcaaagcagccttgcctgcttgctactccactcccatgagtgcccagggcgccttgctctcttggccgccacacagggctggacaccagttggcgtctgggaaagcagccgagtcacagcaagcaggtgagggaggggccttctggagaacagggtgggaggcacccaggttcaacctgagctagggcagggaagtggcctgaggacctgtttgctctgcaggagggccgggcccggaccactgcaacggcctccccagcacctccgcccccaccccaggcaagagccccctccctgtcacccagcccccgtgggaatagcttgagccagaagccgccatcaaagctgctcccctctcccagggcctggtcacttcttgacaggttacagccccaaagacaaacagattccgccaagcaaataggtgtccagtggtaggggtgtcgagtagggcctgggagtgggtctgcgctgccagatacccaggttcagggtgggggccctcccctgaagagaacaaacagcctggggcgcctggaaggaagcaggacgctggtgtactgtcacgcaccacgtgggggcggggctgagggcacccaccactggggtctctgggccaggcgcccacaccttgaggctctggtatcaggctaagtagagacactcctcgagtcctgtatttaggcccttggagcagaggccagttctgttgtggcacccccatttctctcatgaatctagggccacccgttccttcactgagctgtctacagggaaatggcctcaccatcatttaggacacacagctttgccagccaagggtgaaggccaatttgaggatctgcaattaagtgaaattaatgccagaatctgggagacaaggccatgggtctgagcctgtacgattcaagcaacccccccctctgatctcatctcttcaccacaggggtgattgtgactaaggacaaacttgagttctgagctcttaaaagtgctaccgacatgaagagatggatccagtgaatccaccatttgccatcatgccagttaagtcgtcaaatagctttacatgctatctgacgacaaggtaaccataggcctgtatcacttttaagtactgggggaagattccaagcttgtttgccaattgcctagaacatggtccctacctgactctcagattgccaggccagtccacaaaaacttatctaattcattatatgccagaagcagtgcctagaccaccaaagaactataacccaaccaccatgggaaccaccttaagagaagatgcattccctcttctatctaaatctaggatgccaggggcccagctaggactgaggacgactcctcaactaagccttgtcttttttccccgtagggaagatgcccgtgatgctctgcatttccctgtgctattcctacacctgtgctatgtacccaacacacagtaaatgcccaaacaatgtctgctggcagatcaacactaacttggctggtgcttatgtgctggggatagcaagatgctcaatagatgcacagtactctgtggacctaaaggccgttggaaagagcttcctcaccattttggtcactgaagctaggaaggcagtagatctaattataaccccagggctaatcagttttcccatttgcaaaaagaagacccagggactaaaaagcacatatcacagagtcactgtgggggtgagcagtacatggcgagtagcagttgacagcacgataaaaataacacacatgaaaacaggattttgtgtgtgtgtgtgttaatttaatcatacaaatattcatttatacagtaaggaaaaacctccccatcttcagctcctcccaggcaccaagaggccccaccacaaacacccacccagcctgcttgctacacaccactgtccaggttggacgggcagccactgctgctccagcactcaaccaaggaaatgaaggaaaggcaaggcagggtggggtggggaatcagcttgcacttctgagccctggcaaccccaccgtcctctcctgctggggctccggctgaatttggggatcccatcttggccatcctcaagccacacaagctgtcttggtgaggttctatgatgagcttaaggttacagccaatccttactgggggagagaaggctgtttcttgtagaaaaataccccaaattcaactgtccccatggcaaaaagaaaaaaaaaggcatgcacgcgtacacacatccacacacacctcactccatgcacacaataggttcttcccaggcctgagtctctctgcctccctcgctgggctcaggcccctaaggatgctgctgtctgcctcctctcacgggtgccagacactggtggtcctgcctagaggcagcctgacttttggggaagagtccaagaggagcagagcacactggggctgagagagtcacttctatcaccacactaggcaggggaggagaaggggctccaggcactgctcagaactcagactagtgagaggggactgaatggtcctggggcagccatggaatcccttactcctatcgcatggcttatgcttgctctggccctctgcaaggagctcacctctccaaggatgtgtacagaaatggtttgctcttgggaggggagtcaacgtgcttgggacagtcaccttgcctccaagcaagaggaggagtgggatgcctctggcagggtcagactcactaatggtgacctactaaagccccagctgaatcaagccagacagcctctcctgggaagtggggaagggacacctggtgtggggctgatgaggaagctaagaaaccaggtgatgtaaagcctcccatgatcctgccagcagtagctggagacgtgctgtcttgagggccatcaaaccaggagaatggctggggtgtctgtgggctccagggtggcagtgtcccaggaggttggcaccaacagtagtggcaatctgggcctcagagggccctcagacaaaaagccatggtgagcccctggcttgggccggtgatggcctgggcacccagagggacttccctctgttcaggagcggggcacttgtgtgcactggaagcggctgcttggggtgagccgtagtttcaccccagacccagctgcactgctctccttggcaggctggccccaccttcccccagcacttttccactggaccaaagcttatccttttattttctgggaggtggggaggtaaagggggaacttcatacaagcttttctcccacagtcaagctttaaaaaacaacagtctcagaagaggatgaggaggaacaaacaacacacatttttggaactcagacactcaagagacagacaggcaggcagaccctcacccacacccaggctatatgaccccttgcagccgctcatcacctggtctctctgcttgtctctcacccctggggtggatggaggtgtgagaacaggcaggtgaccctgcaaccgcaccctagatccacatccccgactatcacaccaaccaagactcaagggaaggagggggtgagaaaaaaagagaagagggactttgcatattcttgtatctttggcagacagctgttctagcctggttcgagcatcccatggagaggtccacatctcaatctgcttgggatccacaggatgccagtggggccacatgcccaagtgggcagccagccgatcatcttctgctctggctgggctgcccctcgcccaccacctcccaagagccaagcattctgctgagggtgggggtgctctcatttcatcaaagtgtggtctcccaaatcacatagtcagtaactgtggcccttccccatggtcaattccccatctggggctgtaacttcatatgttaacagctcagcctccactaacaggctgtgaaaatagcacaaaagacaatgggagggaaacaagggaagggagtttgttaacaacagagaagcttggacacctttccacctgcctgccgcatgtttgctggtgagctgcaccaacactcgtgtgtgtgtgtgtgcatgtggcacacacacacacagaggcactgtttccagcgcgaacggggagccactgtgtatgaagaatccaaaagagcagtaagcgtgatggcatttctctctgccaagagaaacatggaaaaaagcaatctgaattgttgtgtgtgcagaaggacacctctcggcctcagaaacttccatgttgcccaagatctgtcttcaagacttcctctgctggccacacagggaagtttggtcttcagagaggttctgatggtaacaagccacagggttgatgaatacaaatgtcaaaggtgtaaatcaacagaagattaagcagaaaagaagaggaaaagggtgataactcattggctgatgccattaaaaacaaatggggtcagagactgctggagtcaggtggcacaggagatgtccacctgtagcacagacccacagagtccccaaacatgccacaccagcttgtaacctgaatcgcttccagagcaagcagctattctagaaagggtatattatcccttaccttaaaaaaaaaaagaaaaaaagaaaaaaagagtggggaaagagggaaaaaaattaacgtgtgctcaaaactacaacctgtttgtaggcaaagtaatttttgtttaaaaagatggctttttttcccccatttgaaactttgttttccttcccaagtgacctaatgacttgttagactgatgcctaataaacaaaacccaaggcggctgcatgggtttcttcttagtagcctcaacaccattcctgcgattcagcattcacacatgcatactgagtttactcaaaactagtctgttttgcttcttcctcttcttccaggattgggggagaggggggtcagagccaggggtccatgcggtatggtctgcaatccagaggaaccccctgccctcccccccaccccaaagtcaggccttctgtcttttgttaatttttcttcttgccggtgtccgtttaagactggccgaaggggtaaggcccgtggagcccctggaagagagtgaacatagtcagtgatgataaacaaagcaggtacaacttgacaattaaaccaagttaaagaatctatggtccccagtgagccagaaggaagccccaaggcatagacaaagcctgagggttgtccttgctacccaaaacctcaaggggccacatatcagcatttctgcccttaagtgttcccactccatcacaccaaccaaagagatgggaggcagtgggggcagtcctcatctttcaactgctacatcaatcagtgtcaactttcctccatccaggtcacaaagccttcctttctgctggacaacaacgtctcaacctttctgctaaagatcccagtgcaccattttctgcaccttaaccttctggctaatgccccttataccaacaacagcactgcagcagaaatggcaactgtctaagcacgtagataacaggcatggtactagcagctttgcacacattgtctttaaaccttacctgaaagccaggtgagtattacgacgctcatttaactcgggcccatctgactgcagagagtaaaagacctactccaagtcacatgggtagaataaggcagagccaaggtttaaaactaagtctgatttttgctctcccacactgcctctcccttgccacgtgataataaggtttattctctattcccaaagttattttcagtactgtttgggtggaaaaagcttcatagtctcacttttcccttatattcagaatgagacaccaagatgtgccgacaccaaaaagcagcggcatgaacttgctggaggatgccctgtgactccctccaccttcccaccctcctcctggagtgtgttctttggaaagagttggtcaatgccaagacctaggagggcaaaagctaactggtgaccagcctccctagggtcctacaccctaaagtggcctatgggcagctggacccttggaccaaatggaccaaaggggtacaaagagcagatgcctcaaccataactgtgacaaatgactggagagtgttgatgcttgacaactaggttaagaatcctgaaactaggcacaaccgagagtgagaaggcacaagaatgactgacatgaaatttcctattagcttgatgggatatgggcagtcagaatttgattgtcttaaaaaaaaaaatgacacagaggcaccagggtgactcagtggttgagcatctgcctttggctcaggtcatgatctcttggggtcctgggatcaagtcctgcactgggctccccacagggagcctgcttctccctctgtctgtgtctctgcctctctctgtgtctctcatgaataaataaaatctttaaaaaaaataaaaataaattaaaaaaattaaaatatgacacatttctttgaggagggaaaacagtgtctgcttgctgggttggcagtgattagaatcctttttggtataactttgtcctgtttgcttccatctccccagcatctagcatgatgcctggcccaagaggtacccaataaacatttgttgaattaataactaaaagaggacaggtatttcccagactactatctggagtgtcagacacctctgagtcgaaggaatattggccattccaaatccaagttttaaaatagctgcttaggcctggcgacacaagtgcctgggggtcataccatctatctggtcacagtctcctaggtcccaagagaggcagggctctctgaaggtagttagcttggagatgcaagaccctccctgtttccactgctgtgggatgtaggccgctcagaactgggaggaggggatctgggttctactcccagttttgcaccagctcacaaagtgaccataaggtcctttctcctcagagggtctcgggttcctctctgaatctttccaggatttcaagctctaggagtattgactcaatatactgcctggctcaagagactgaaaaataggactctaagaaaggatgccctttggtcatgtttaggccagaggtcaaagatgacaagaatagggaacatgagattaaagtttctatagtgttttcagtggaaggcactgaaactgctttcgcttttttcccctcccctacataatgcctcaaaagaccgggagtatgtctctagctgcttggtggttatcactgaacaaaaaatcctgaccaggtgaatttggaggatgggcaggccttcatggattgagcatcaactacacacgagatgctgctggggcactttaacatattctctgtaattcttgcaaagattcactgagacaaaccaagatctccaaactcagagaggtgaccaacttcaagggcacataactggtaagagcagtggtgtttaaaatggccacatgtttgccagtccccaagtgaactacattccagcaggtaggctaaggctgtaaccatctcagctaccatggtacaacctgattaacaagggtgggctggggagccaaagggctctcagactccattctgtagggcctggttggaggtcacacacaccattagtagaaagtatagaaagcttacaacaaggtgtcctcagtacttcccagtatttgttcatctggaataacccaaggaaagcagtaacggccttgattcctacaagagttagaaccaatacaatgctcaaaggtctctgtgcaggaaaaaatgcacagacaaaagaaaaaccgaaagacaccaaaagacaaacagcatttgctttctatgaaatattttcccctaaatttaactgtcttccagaccaaacctccacacacttcaacatgggccttaatatccaaccaatagccgtgtgacttgcctggaatgcttggagaagggagttcgtgaccttgctaaggagctgttgcacattcccattttacagataaatagaatgggtcctgggcaaccggcagagggaggaacaaaagcacgatgagcattttcagacttccacttttgactgccttggcccttggacattcagtgtggtatataactagcttagattatggatttgttggcctttagcttggtggctgaagttctgtgtcttttggggaaaaaaaatgctacctaatccctttttacccagagaatggcatattggaagttgttgatgttttattggtgcagaaaggtggcttgaagaacaaactctagtcccacccaccctacccttcaaattaactaccatcacttccaggaagggagagggaaccaattctatttcaaaaccactttatcatctagactccccacacgcaggattataggtgtcatagatggatcacagaacacaggcaatgcattactagtggtggaggaaaagcctggcagagattccaagaacagcttgttcagggcatccaatggcaggaggccaagcaggaggctacgcaggaagtgcctttcctagcagtgggatggaggtatatttgaaacaggaggcccatccacatttcaggttccactggagttccaaggcccagtgtaacaggttttagtggctcatgtctccaaccccagcctaaaagcagggtttggcaatagagataacgttcattctcttctgggcctagcaactcttcaacctccatccagaggaacaagaaactggcttcaactgacacctctcctaaaacagctgtgactctactaataagaaaaacagggacagaggcatcaggtggtagttagtacagagccctgaattaaaccaactcaagtgaaaattgtggccatcagcatgattgcaaagctcaggagtctggtgcagaaggctgcccttctctctctgaggaatcactcctcatcacacagagaccaaccacaaggctggatttatccatgctaagagagggtatgaataatcaaaccctgaaaagaagtcctgtatctgactccaagtctaaaggccagttccccagggcctatttgagttgcacagttttcaaggctttcaaaggctacatctgttaaggggacaggaaagttttcctggcaaaggagagacagcctttaggtccacagggactgaggtgttgcctgtgtgcttcagccttccctaagcccttcactgcacagctgcagtagctatgagccctgggacctaaattctacttggctccagggcaggcaagctctcttaaagcacagaagctccatacccaccagctaagacagaggtgcctctctgttccttggtgtctgggaaaaagacctcggcctcaggccagctgaatcatcacagtagttggaccaggtcctgaactgaacttccatgatggaaaaactactgagagccataacttagctaaaattctaaaatatttttaaatatttttagaagacaacatttatggacaaaacataactcagtcccatttaccacaatctcctaaaaaagacaatttaagatccagtacttgtgatctgttctcaaacaaacctaaaaataatctgtgatttttcacaatagtttatagttgccccctgtggactagcagagtcactctcagccagtgatctggttatcactaatcttatgtgagtgtggacctgcaaaagttctcttaaaatacagagaaatcaaagtaactttttgaagagtactaaaaattgtcactcagagaaaacattaactctatgttaaggtactaaaaagacaggacacgagttctgtttcagctggactatttttaaaaagtttcctcatcaattttcaacagtaggaagtatggggctatgaggagagtaagttgcccttgaagagggtggaacctgcttctgccaattctttatgccttccatacagttaagtctcaaatagcagcaacacaaatgagtgaatgacggtgaactactctgcactgatgagccatttggtttttaacattccagggagaaaaaaaggaggctgaaaaacctactgaaacaacggtgtgtcttacaagggttttttggggtacaccttttctatttggaagttagttgtgtagataaagcaccacaacatggacactttcacatacctgtctttattttgcttttatttgtgatttaaataaataaaaaggttcacacacattaacaaaaaggagcgtatgctgcagggctgtgaaataacatgctctcccggtgtatactgatggcagcatcagataacatcgggagagccctcctccgccttactgcctgagccagtcctggtcagcgctgcttctgcctagtgctccttttgtatcactaactacactgaatgcaaacacagaagaatacaagatttagtactaagttctgtcctgatcctgtactgcaaacatggtgtggtggggccctgctcacaaggctggcttgactgaccacgccctgatcaaacctgttcttctcttattaattagaaataaagtctctattggaataatgggcagagtaatgaggactctctcaagaaaattcaaaccaggatccttccctcaatggcggctgactgctccaggaggtttcctactggaagagcagggccacgtgagcaggagaggtacttctgtagatgcttccacactggtgttcaagccactttcatgtggcagtcctcaaaatttcaaagatatatttgatgcactggctgaggatgagtatgagaaccagccaaaggaaagaaaataaacctatttttatgcatgagggctgatcatggggcaggctcagttcacagccttctgcttgtgccaaagctgctcaaagcttgactcagtcgaagtgtgatgattttttttttaaagccctgcaaaaccaattttttatacttatctctgtaacagtttttctgttgctcttaactaacttctacaatcctgctggggacctggtcatctatccatccattctccctctacccatccatccaacccttcatcatgcaactctttttttaaaaaaatattttattattcattcatgagagacacacagatacagagacatagagggagaagcaggcttcctgcgagagcctgatatgggacttgatcccaggatcccagaattaggacctgagccaaaggcaggggttcaaccactgagccagccacccaggtgcccctcatcatgcaactcttattcttcctctcttcatcatccctcttcccatcctccctccagtcttcctcctatctatctagagctccctatggccaaaggcaactctcagagcattcacctaccctactgtgtggcaactcaagaaaatcaccataaagaataaaactcaaacaagattgtgaattaaacatataatttatagttctaaaacaaggagatgaagaacactggctgggtttgactttccctttcagtaaagacttcagaaaaagttatttacaatttggcattctagctgccaaatcccatgtaacagcaggtgtgttagaatccagttggggggctagcacacagagctttctcatggtcacctcctagggcggaggaacttcctaaacaggaagaaagaactgacaggagtctcactggggagggcacccaaagggagagaagcttactcaagttcctagccctctcaccattggtgctggctgcactgcggggattctgctgtagcactgggggaggcggctggtcccatttcctcttagaatttccttccaaatttctgtaacctgtcaactatacccttccttacaggctactgcagtctcccacctcttttacaattaattcacagaatcacttgccgccctccagtgtctggctaactgaggtaggaaaacaaatggtctctccttggtctcattcagccatacttgctgtcatcttgccatgatcctgctcaagagtgttgctgttactctgcttctttccacattaaacattggctctcctttgcttggctttcaaaggtcttccttcaaaattcgccccaccctctttaagcacaccgtactctgcagcaggctggccggtgtcccgtgaacacacaccacctgtggatgcctctgggccttcctacgtgtgattcctcttcctccaattcagtttgaacctaacaagtaccaaggtaccagtgccttctccgtcctcaaaattcatatgaacacttacttaaaagtcaagtggaactcaatatactcctttactagctgttattctttcccatgagctagtcacatgtatgtaatcagacagtaaatactttgaagataaggattagcatgggttgagcactcatttatgaactaaatagtatcaaagctatctctctgtataaagcagttttaattggtctttgggcaatgaaatcacagcaaaaagttcaagattctcaggccttgcaagtggatgtgtccaaagctttggaaaaaacctcccttgcagctgaactctaaggaagcccccatttcccctgaagtccaacagctcccagcttctaaccttgaattccccacctgtcctgctagaacacagttacagcagacttagctgagaacacaccagggggaaatttctcacacttctgaatttcgcttatctgtttgaacctgtgatttcactagtcctacactttgagaacttccatcagaaattaaaatgctaaattcagaacataggaaagaaaaacaccctcataaccaaaataaaatattctggcaatcctgggaacactggctgcattttagctacaagactgcccagcatcaaaccagtttaaaacaatgctcagagccccaaagcaaataaaatggagctgaacaactttgaagctcttgagggacaaaggggagagttcctggagatactttttattttcagtcagacagtaacgttacaaacaacaaaagacattttctaaggctcatagtgtttgcttaatttatttttaaaatgcacacatgacccatgccaatgcaaacaccagcagggctgggaggactttcctggctcctctgggttttcaaaagagagtcatggtaatatcattaaaccagagtttcctgacaattcccttctggtacagaatgtactaattgggcaatgaacaggacaggttcctcagttttgcactgcttcctccctggtcataaattcttttggagctccaaaagatgaacgggaaagtccctacgacctgacagtaagtgtagactactttcagtgaacaaccaatggtcgttgcttctgccagcaaacctcatcatagtgtggtctagaagaacactagactcaaactgggttcctgggttccagcccatgccccacccctaatctgctatgtgagggtgaacaagtcacttacaacttccctattttgtcaaatgaagggtgtaactacagaagtcatgagactgttacaaattgagaataagtacagtaaatgtgctttgaataacatgaagtagtttgtttaaatgttagacagtattaagcccagtccggtctttggacctcttctctacctgtaccaatgattcacaagtagggagattttgtcatcttcctgcccaagggacagttgacaatgtttggagatatttttggttgttacacttggggttgggaaggtactactgccatgtactgggactgggtaaaggccaggaatgctgctaaatatcttacaatgcatttagacaccccctcctactccccacctcaagacagatctggcctaaaatgtcaatagtcttagtacttcagctgagaaatcctgctctacactcatcacttagtggactgcagccagtcttatagcattacatataatccgtatgtcacaattctcagatttgtatctccacccagacctttctcctaaactttaaatgcaacctggatatacaacagcccacttgacatctccatttggatatttaaagaaatctccagtgtgcctcaaatggacctcctgacttctccccatttctaccatagtcttttccctttccattgatggcaattccatccttttagttgcttagaccaaaaaccttggtgtcatctttactccactgtcttttacaacccccttccaaaggcaaggggtttatttatcacccctctgctcaaaaccctttaatggtttcctctgctcctaagagagaaagcccaaagctttggaagggcccacaaagcccccccacgatctagtttccatcctctgacttcatatttctctactctccttcacctccactctgttccttaaacaaaccaggtaaacttcaacctcagggtgtgtactggctatccctttgcctaaaatatgctttctctagatagcttttacagaaataaaatctgactttaaagggaataagcatgttcaaaaagagattttaaattcattccagaaaagtaaaacttcagagactatatctttaggccataatagaggaatacagacaggttttgtggcttcaagacggtacagatgttgccgtcacaagagtgatttaatggaaatttcaatgtcagcaaagatctaaacccaagtaactatggagggtctagggaatctttttctttgggaggctagagagaaaaactggtttctacagtttccataagagcttgtgaggggagagggtttagtagtagagaagtcacataatatttagttaataactggcttgatcctcatttgaaatgtagcactatagtatagaaagcattctctcctaacccactgctgttagctaaactggtaagaatatgtacttgaacactatttatgatttatgaatgcagtacactgttaagaaagcaggctcaagagtcaaagacaattgcttttgttcagatcctagttttaccatttcctagctgcatgaccttgagcaaatcatggaacctgtgtacttcaagtctctgcaactgcaaaggagggaagagagcaatccctgaaccatggtactgttgtgtgcactaaatgaagtaatgcatatcaaacattgagcctgctgcctctgaggagcaaatgctgggggtggggaggaagggaggcgaccagtgtttttgtaataaactttgtagaactacttggctctttaaactatatacattgataattttaacaaaaattaaatttaaaaagttctcggcacagtgcctggacatagtaagtgctcaataaatggtagttttatagctctaattacggcattctgattggcctctacctgagtgtcctgtgcttttgctacctgtcccctgccaaaagaaaacaaaaactggataaaatatcaagtgactcaagttttccttctagtttctctctgaatcatctctaaacctttcacaaaagggtaggcatctgagagcgaaaactcaagtcccatggcagtgggaaggtcacactgccctctactccctcacaaaaccaattatcccagctatagacaccaaccacctgccttctggtcaaattcagggccctctgctctgggcaaatgttgaacccaattccattatgtcaccccaaactcaccccctattattatgttaaactggctacttcaaaatagataagaagatccatcactcttatatcctcaggcccacatagcaaaagatttgccttttccaaacctccccaggcaacctctactaagatttctaaactctcacctaaatggagggaaaataactcctctatgccttagtcaacatagattgtagcagatctagagagagctgacttccgatgtaataaaagcagactgactcctgctctatctccagagccaaaacatactaaaggttggctgtcagagagagataggaagagaagcaggtgggaatgtgggcaggcagggcagatggcgctcggcagtggctgacactggaggagcacgatgaacctccccacaaagataataacaagtttctccttctgaaccagcacttggcggaagtaataacagtggctcagactgtaatccagtttaaaggaggagtatatgacatataccagctccaaacattttttaaagtaagaacaaatacaaaataagagccataggccaagtaacaaaataaatgaatctgggattcttttcagctccctcagtgtaaattattacttttttaagagaaaggaagtgaagcatttggccttccttaagaacagccccttggtttttgacagccacacgcctattaccatctgtcctgcatcagactgtttggcgtgcttttcctctgtaagaaagccttcttagaaaacatttagatattaaaaaaattactggcaaataagggggaaaagccatctaattttaacaggacttttctccttccacacctctataaaaaaaaatttttttttttaatttatttatgatagttacacacagagagagagagagagaggcagagacacaggcagagggagaagcaggctccatgcaccgggagcccgacgtgggattcgatcccgggtcttcaggatcgcgccctgggccaaaggcaggcgctaaaccgctgcgccacccagggatcccaaaaaaaatttttttttaaactattctcacactgtccaaacagaagctatcctggcctccagagatgagtcagagagctagaatgcatggcaacactagccttgagtcaacagagtaagcacctatcctactgtgactgtttgtcctcagaggctcttgagctaatcacataaaaagggttcactataacagcacctaaccttcatcaatacttgatctgactgttcacatgggacaggtcagccacaattgagcaatgagaccagctaatttctaacaaaaagcagggagtcagatttatgaatatttggaggaggtcagcatatacttacttttctgactctctttgacagctctcacacagggaggggccaggccttctgagttgtgggatggaactagagctggcattctcacccagagcttccccccagacatggagcactgagtccagagagcttatgattattcaagtacagctggggaagggctcctggggtgtccagttcctgacactgccatatgtgtcattatgatgacatacctatgcagccctcctagagcagatgcatgaagcaatcttttcatttcatcctaccaacctcaccaagttaaactgtaactatggaggcagtaggaaaccgtatctattatagttgtggtcatgggcttccaagagcatcatgttctttcccagccttaatgggaggcagggagtaagtcaaatctactgtttactctgatccctgacatgggggcatcaggtactcctcctccctatccaataaaggtggcacctggggtgaactgcaaacacacaacccaagtctaaagcccagaggttcccttcattctttccactcatttaataaacaaaagggtgctaatcattataaacaccacaaaggttttgcaccctaagttcttatttttattaaccaggaaaactactttaaagacaaacaagggaactcttcaaaaagaagatgccacaggcaattttcagtttacattagagccactgatcttatttcaactctgctttttttcactctttgatgataccgatcatcaactcagtaaatgctttaaccaaatacagcctccagcccaacaggaggatctagggagagcccaggtttacctactaatactacattttaataatgtggcaccttggattggaattccaactctgcctctcaatagctatgtaatattgagcaagttactgagtcccttggagctttgttttcttgtccaaaaaatgagatcaaacatgtaaagtacgtggcaacacacttgccatataggaatagttagaacataactttggtatacccaatctcatcactgtgtcaagcatactctcgagctgactcaagcatgcctgccttcaaaaataaataaatctggaggtgccatgttagtatacattatgtatattataatgtatagtatacattaactcagttaagtgtctgccttcaccttcggcttgggtcataatcccagggtcctgggatagcgcctgcatcaggctccctgctcagcagggagtctgcttctccctccccctctgcctgcagctcccccctgcttgtgctctgtgtcaaacaaacaaataaagataaatctgtattctcaagccaaacacaaatgtttagcattatgaataagctctgctttaagatatccatttaagtacagtctcaattcttttcaaagccatttatgactatttcatccactgctcctcaaagaaaagcaccgcaacctgaacccatctctgtcacccacatctcctgagaacatgtctcttactcattctgccctcagcacttaaagtgttcttcactgtccttcctctttccaaatctatcctttgaaaagaccaactcaatctcttcttcctctctgccctaaatttaatccacagccatacacacaaactgcacattttgactgtttttgtctctccatacttaactaaattgtttcctaattgctgtatgcatatttcatctcccctactgcactgtatgctgctagttgataggggtaagttcttttattcttcaagtctccatctgaacaatgtacactgatctaaaatgtgcacagatgtgttaataaatacttagtgatgtctgtctataccctatcctgttctcttactgccttaagaggtggagctgactcaactttaaccagaaatcctttcagagcaattgctagatgcacacataaatgcattctgaataagattctccttaaattaagaaacaagaagggtgcctgagtggtgcagtcagttaagtgactgacttttgatttcagctcaggtcatgatctcagggtcatgagactgagccctacactggctccctgctcagtgagaacggaggtctgcttgtttctctccttcctcctctcctctgcccttcccttaaccttaaaaatcaatcaatcaaccaatcaatcaatcaatctttaaggaaggaaggaaaaaaagagagaaagaaacaaggaggctccagtttttctttgggacctaagtgccacattctcaatgcattatagccaatagtcttcttgaatatcatctccaatgagaaccttttcactgtggttcttgcaaatattacttctaaatgatcctacagagttcatggaaaaaaaaaaaaaaggcaacataccatgaattcatcaacctcatcaacctcaagaaatctcaatagtctctaccctcaccatagcctagtccttcaaagaaaaaaaaaaaaagacaacatggtaggacctcaactaaggctggtaggtaatccactctgaccccttgccaatcccaccctagctcccaccccctaggcctgggcaatcaccacagaattggcgaaaaggcatcagtccctaaaggagtggcaaacaactaacagtttcacaacttaggacgatgaatgcagtgctgtggccaagaacagccgcctccttaaaccacaggaactactgatccaagtaattcacagttgggagaggggcttgtattatacaaagcaccaaagcaactcgttttgcctcctctgactctcatcttcccattgaattcaactgcaaattccaattctaacaggacatgcttaccctagggcttggctcacttaactacctggaatggttatactctggagggttaaatttaaggaggaaaatctggagaaataggagcttagaggaaaaaaccttttattatagtgttacaatatgaagtcttaactcaaatacaggcattttactgtcttgccaattgacttctcttatatcctgtgcaactaacatgactccacagaatcctttatgacaaccattcaaacaacaaaaaaaattaatcctctgttacaccactactgaatgaagtctctcttactaactagaatgtgtggagaaataggattcacatcaccaggtttcttttcttaatttgcctcttgatctgaaccatatataaagcattagtcagaaaaataccattcttacaacagacaatttgtcctcaaataaacatcaattttatttttcaaaatttgagggtaaatcccaacatgatgcaagggcagacttaacagttatatgattgtatagggtggggtgctgggcctaatacatagcattgttaaccagagaagaatgaaaaggaatgctcacaggcccgtaccatatgaaacatctgtaactgtgagcgctcagcatcaagactttactcaaccaaccaaaaccaacaaccaagaaccatcatcaccttagcagagggtagaagacactgtttaatcagctagcaaggagaagcagatcaataaatcaaacacagagaagagtgtctcagaactatcaaaatatttaaattcatggtgaactcaacaattctctcacttactgtcccacacataaaaagtcaaaatatcacttgggccactctgggttgtgggtgaggaggtagacaggccgtaatagactgaaaatacatcaacaagaagacatgcaaataaggtaaataaagcgaaagcccaacaacaatatttaggatatataattgagtttgtctttgttccttggaaaaatgaaagccccacccaaagccaaagtaaaaacataaacaaaaacaacaaagcaggaagagattccaaaggcatgtggtctaggtttagtatacatttacactggaaggacagttggtgatattttgactttatttttttaaatgctaaatgtaaaaaactttgttctttcaacacccaaaccagagcagagagacagtagtaaattataaatgtggataaagtaatccacaggacatgaagatgggggagggggaggggagaaggggtaggtttttgtattgttgctgttggcaggagagctaagcagtcttaaagaacattctaggcttctaggtttgccatgaaagggtatcacaaatcccaaggcccaccacctaccccttctcctcttctccgagggcacctaccttactgtaagtcactactgataagttgtttgcgtgactgctgggggacagatttacagagttctgtgagagtctattctcatcttgctcggtttggtcaggagcaggagcccatgtgtttttgctgatcgagtcgaacccggaacccccagggtcttttaagttgttttcatctgattgtcggttcttttggggagaggcaaacgggttgaagtttccttctaccttgcgatgtggctgtgtgttgaactccgtttcaaaagatgacagctgctgcgttactcctaaaagtccacccacctccacactgagaatcacccagatgacatctgaaacaaaagggcaattcatgtcagtgacaggcattccttcaagacccaaagcagccaccaccattactccaaaatgcctctcaaagccacccaaatcttaggaaggaatgtcctttaaaagctggctgacaaagtagtccagtacatttgcactgcatgcatttctacatttttgataatatcacattcaaactccagtacacattcagtataggtctatggtaagacctgtgaaagtatctgttaaaaggttaccagttgatcctgatgcacagccatatttggaaatcactgttccagagaacaatgatctatagatagaaacctaaaaactattttcccagaattataagctcgtggttttgctttggtttgaatgtatgtaactagaaaactcagggcagaggtgcctgagtggctcagtcagttaagtgtctgccttccacttcatcctggggtccagggattgggctctgtgttgagctccctgctcagcgaggcgtctgcttctccttctccctctccccttctcccccaccctgtgctctctctctctctcactctgtctcactctctctcccttgaataaattcattttaaaacaatcttaaaaaaaaaatagaaaactcagggcaggcataattcttgagccaaaaaatgcttataattactaaaattgcaacttatcaactacctcctctctacttctttgagcaatttagaatgacaacatactgtccaaataggacaacggagagtaaagaggggagctagtaataatgaccaccaggacacacatgtaaaccagcattaaccatgagtatattaagacaaatatcacttggggtgttttctttttctaatgatctatgtgatcaaaagataccaaaaattcagtatgcccagactttctaaaataatccaatttaacaccaactttgcctttgtcatatagaagccttaccatctacattgaaaccataaggatgtgtcttaaaaagaggacttttggtcgtaattcagttatttttctcaactgccaaagcaaaaggttcaaatagaagagtaaagagttccctttgatgttctgcacctcaattcagagaacagtgacatcaactttcctgctaggaaggcctttaaaaagcaagctacagaaaggtcaagaagcttttaagtatgaatccagctgaagcaaatgtgaaaagttatccaaagctcctgaataactgctaaatggttgatacaaaaaggctaataaattccattagttactcacacagaaattcagataatattaagaatagggaaccccccgccctaccaatactaaaaggaatagtgaaagaaactggggaaaacactcttgggctgtgcttaatctcaattttcaatctgggttctgtgtctgatgaaggccataaataccccatttgcattaggtggtttgggagcttcattaaacagctaggagccagaacccagctaggagccagaactgtagtaagcagagatgcagtgacatctgctgttgacttctggaattagcacctctgcagccactagctgcactagcaggactcctaggaatgggaatccattccagacacaatttttcattaaagcaaatgtgaatcctcatgtaaacttgtgccagaaaagttcaatctgttgattaacacaggatatgcagcatgccacttcatttggaaatatgggatggtgctaggtcagaggactttgattcagagctcttaagtcaatctcataaaccaacatgacgtaggccttaaagaacaattcagtggcaggcagctaaggaagattcattccatgctttcctagcctatctttctaaccaaagtcaacattttttcactttattttttgtttttctcaaacagatatgccctatcttacagtacattaattcgtactacttctctttcacccatctattttccaaagttcttttaagcacatgatatgtttcacatactcagttacaggtcatacacttccttcattttgctcaggaaactaaatgcttacaagcagagaaaagatagtcttctgaagactattatcagtatataagactaatgacatcttctcccctggctttaagaactaaaacttctttcgtgtaactcattgggccatatcatacgtaagccactgcactctctttactgtggctattcttccatactgttcacagattttacattgtagctataaagagagggtcatttaagaaaccactgatttataaacatccaacaatgaacactccagctctgatcctcccaagttattattaccatgatgggtcattatgaacagcaaagtacaccttctacatggtataatctaagccatctaaataagcactactagcccgcatgtttcttttttttttttaagatttatttatttatttattcatgatagagagagagagagagaatgagagagagagagagaggcccacacaggaggagggagaagcaggctccatgccaggagcccgacgcgggactcgatcctgggactccaggatcacgccctgggccaaaggcaggcgctaaactgctgagccacccagggatccccagccctcatgtttcaaaatgtgttcgtcccatgcagaatgtgcgagaatgagcgtgtgttaaacaaagagaaaaaagtgatcaaaatggaccaaataagcttgtttcagagaggctgaccaccgattcttgccagaatgccttacttactgaggtaagaactgccagccatgtattttactacttgtgatggaaggaatcgtaggggtcatcaaatgaaaggctacaccttctagatacaggattcgaggtctggagacagaaatgatggacccgatatcagtcttcaagttaaacgccaacttgtactgatgactaagaacactcaactctcagaatagcttttccaactcatacttatttctcctcaacaggaacttgggaatccaagaactcagggaactacagctatattaagtcagtcccatttcccaggctataatatctttaccaacaaacatatatgatttttggtaccaataacaagaatgagccaacaggatgtcctagaaaagtagccaataaagtagaatcaagtgccaagcctatactttatgggttagtaaagccaatggagaaactgattttagaatgtcttgccttaaggtgttttacaaaaagaatctgagccaggacttttgagataaatggtactataaatagtttcattcagcttgtcccttttacatataaaacctttaataagtatataactttaataataagtataaacttccttttgtagaaatgtatgatcaattactaaagagagtacacaaactttgtacttctttttttttttttggtaatttttatttatttatgatagtcacacagagagagagagagagagagagagagaggcagagacataggcagagggagaagcaggctccatgcaccgggagcccgacgtgggattcgatcccgggtctccaggatcacgccctgggccaaaggcaggcgctaaaccgctgcgccacccagggatccctgtacttctttagtttagatttattagaaatgcagagcaaaaggaaagtattttggggtgcctgaatggctcagtcagttgggcatccaaatcttgatctcagcttaggtcctgaactcagagttatgagttcaagccccatgtttagggaaaaaaaaaaaaaaaaaaaagaggaaaatactttacttgaagcccaactccataatcttaaggaaccatactgatgtacaaagacatctcagattatggtaggaatgttagaaacattgcatacgtctaaaggctggcatcacagatcaaatcacgtgataataaaaaaatcagtacaatattcgaactggtaagtttgttccttgtagggttatgggttataatacatgcatagcatgggtacatgttaactggagttgaataagtaaatgaattgtgaaatgtgggagagcaaggtttctcattgttgaagaaggatattacagatgatcaagaaaggaacattctaaaatgaactctgtggtaccggattaaagtcagagacagaagtataaactcatgtttatcttaatatatatacagatgaggaaacacagaaacaaggatagatatgtctgtttacagaggttaggatgtatacacacatgacctagctctgtctgctgagaaggcctagaagtaataacagcccagtagtactgaacatatccagtgcccagtggtttctgaatagcattcgctaatagaaaaagagaaatggctgattctgggctaagacatggaaaatataagatgagcctggaatatctttgtaatatcagaaactaagaaagtgttcaaaaaaacactttcaaaaaaaaggatagaagtatgtcacagggatacaggtgcaacctgaaagagctccttctggccaaagctggaacaatttaggcaataaaataacatagtactggattataactcaaaatataaaatagatattagatacacatgagtccatagtgatacaaataaatgacttaatgggtaagtagagataaatttctttacataagaactccaaataatatatgtagttacttccccttctacaagatggagtttaattctatatatcccccaatccatattgaatgtgggacagacttagtgatttgcttccaaggaacagaacagggagaaagacgcctggtggttcagcggttgagcgtctgccttgggctcccttcaagattgagtcccgcatcgggctcctttcaaggagcctgcttttccctctgcctatgtctctgcctctctctctgtgtctctcatgaataaatattaaaaaaaaaaaaaaaagaatagggaaagagaaaaacagtaactttacaatggagaaactggcaacaaacaatttaatcaagtgacccatgttaatatcaccagtgatgttatgtatatatcaggtgccccctggtaaggtacttcatctctgtagtattccccaaatctataacattagtctaaataaatttaagaaaacatcagaagaagctcaaattggggtatgttatgaaggatacctgccattattcctccaaacagtcatgggtcatgaaaacagaaaagactctgagaaactgtcacaggtcaagagactaaagccaagataactacatgtcatgtggtgccatagaccagatgctgggaacagaaagtcatgaatggaacgatgaaataaaatctaaagaaagataaaatctaaagaaagtctatgctcacttcagcaatacatccatgaaaactagaatgttatagacattagcatggcccctgcacaaggatgatatgcaaattcatgaagcggtccatatttttaaaaaatctaaataaagtctggagttcagttaatagtaactcaacatgtgccacagtgttgaggtcttcattctaacaagttgtccattcaaactagacacaggagttcactcctatatgcagtgtgatggctcttttcttcctgggctaccctatttcagtacagcagtaagggccagtcaacagtcttcaaacagatgtaacagcaacagctatacaaatgagccatcaccttgatgtgcatgttgggctgaagctgcccaatgacttccagagcatgcctctggcatgcataaaatacaaacgcaagtcacttgaagaaagcaataatgtgccatatcagtatgctccacttgggtctaggcttcccaagggacaaggctaggggacttgagaaagcacaacttttacaaactcagtttacgaagacacctcaaaatggttcaaactgtgcctcggactgaaatctgatgggcttctgatccccagagcaaatgccctgggcgtgtcccagggagcaatgagaccagagggccccaacaccaggagacacatcctggcttctgtcagcatgcacatggaagactacgatggaggtcacacctaggtttgggagtgctagattcaaatccttcctaaagctccacccatcttctaagcatgacagaaactcacatttgccctgaggattaagaaacaacttggaaaaaaaaaaaaaagaaacaacttggatccagacaggtgcacaggctccagtcaactgctcagctaaaggctgtaggctcacatttcatctcccacaggaaggctggatatgtactgcctagtctgagcactgctagtctatgcctgaaacattcccagacagtaagtagtgcaaaggacagcattatgagcaagtctcaacatatttgtgtctgtctcttggaactactaaggcggcagtgtttgtgtaccactgggaaaagaaggtacttccaattgtcagcactaatctaactagtctcaacttccagtctacatttccacactatttattcaacacagagctcccatgacaatggccaggcacttagacactcactatatctatcaacacaccacctacctaccttggcattgaagggagaagagggtagaactgggctccatccagttcatgaggtgctccgagtgacacctgaaggactgcctctgctcaaactctgttccctacccacccttactccccacctcatcttaacacaaatgcattaaaaccttgttcctggatttcagtattattctcaggaatttccaattaaaatgcaaatgcccctcaaaggaatatagtaagctaccttaaactcattatcaaatcaaccactaggcccaagttcacataggggaaaagaaaaaggcctaagagcaatgaaagcctggatgagacgagacagtgatgggtccctggggcccctaatagggatagaggtccacaaagaaaagttgaaatggcaacaacaaagtaactattcctacttcacaattttcctaaatcatgccctatttaaaaattatgagcttctaccttgatttggggataggatgggggactacagtgatcatttaaccatttaattactggcttcagttttaggaaacaagaatttcaacctctcaaatctaggaaatcagtgccatagaagttaaagagtcaaaacatatctgagatcaaagatgaaaatcagggtgcctgggtgccttagttggttgagcatctgcctttggctcaggtcgtgatcctggagtcttgggatagaggactgcgtggggcatcctgctcagccagagagcctgcttctccctctccctctgcccctccccttgctcgtgctctcactctcatttactctcttaaataaaacctttaaaaaatattttttaaaaagatgaaaataagctcagaatgaaaaagaaaaaaacaaccctattaactgggctggaaggacagacacttatttacaaaggcaggtgcaaagttaagagaaaacatgatttctcccaagatcatgtagctgctataaaatgctctaacaaccctcggattgactactgctttcttaccaacgatacccccagactcattttgttgtagcatcaattactgaggattgttgattgttaaaatgcccctgcctcaagatagcacccaaaccttaattaatcctcccttctaatcctgcctcagaaatagcaaccaatccaaaattgatccccactttccgttgagccctctcagaatccttcagcaggaacccaaactgtatgaagactgcttcccttctccctctcgttgtgtggcattccacaattccccctagaaagcctgccctcaccgaattacattaataaattctggttgtatcaggctaggggcttgtttcaggtgacctttgaaaccttctggctttctctttcccctcccagcttcaacttctagatgcagactccatcccttcctacttcccttctcttacagactgccctctcatgaagtgggccaggttggcccagccatcagctgataccacaggaaagaggaatgcattcattcaatgataagagggtcagagaaaagagagaaggaacagcctcaagagtagagaaaacccaggagtatatggtgttctagaagcctagtcacaagcgtttcatcaattgggtccagtgcagctaataatccaagtaaggctgagaagtgagaacaaagcattggaggtagcattatgtaagtctactggtactgaaaagagcagtttcagtggagtggtgggggcagaagcctgatggaaagaattcaggagtacagaaatcaagaggtggggatagtcattactgacacaaaatattccaaggagttttgctatgaaggagagcagcaaaatgggagagaagctggaggaaataacagcattatattatatgtaacagcaagaaatttttagaaacttgaatgtccatcagtagtgaccggctggaaaaatgatgacacatcgacccgagaggggacactccacagccataaaaagtaatgaagatttctagagtggggcacctgggtggttcagttaagtgtctgtctttggctcaggtcatgatctgaaggtcctgggatgaaccccacatcaggccccctgctcagtggggagcgtgcttctttctccctctctctctgctactcccttgcttgtgctttctgtcaaataaataattaaatttttaaaaaaggtttctagggaatccctgggtggctcagcggtttggcgcctgcctttggcccagagcgtgatcctggggtcccgggatcaagtcccatgtcgggctctctgcatggagcctgcttctctctctgtgtctctcatgaataaataaataaaatatttaaaataaataaataaataataaaaaaataaaaaaggtttctagagcgatctctagaatatattattaagtggggagaaaaagatgcagatcagtatctatcgttatgggacttttgtgtaagcatagggtcagacttacatatattggctagcatttgaaagacaaagcaaaacaacagtgtacagataaaccataaatgaataaataaaaatgggtatctcgttgaaggaggcagtaatgggagactcttctaattatatcattagtaaattgtgacttaagattagtagaaatgccctagatactgaaaaaacaaacaacaaacaacaaaaagaaaacagaaaaaaaaaaaaaagaaaacagaaacaaaaaaacctaggtcaaaaggagatggaataagcgctggagataaattttgcaggatggtgattggcataggataggagcacaataaacagccaattatttacacaacactacttgcattaaaaaacaaacaaaaaaatgtttattttgttgccctgttggaagtcagtcaatgttaagagtaactatagctgaaggattgtaacaatgacagttaacaaaaagcagaaaagaccttatttaagcaagttaacatttaatgccgtaatttaaaaatcaaatactttggtaagattgggcattatcttgtcagtgaacacctcctgtggtatggaagacaacacaacaaaacagtaaacagttttcaattgataatgtaactttataagcagtctgctctgcagaccacctatatcaagaccatgtggggggcagccctggtggctcggcggtttagcgccgcctttagtccagggtctgatccgggagacccgggatcaagtcccacgtggggctccctgtatggagcttgcatctccctctgcctgtgtctctgcctctctctgtctctctctctctctcatgaataaataaataaaatcttaaaaaaaaaaaagaccatgtggtttgtatgtgaaaaatacagattcctgggtccctaactacaatgaactaaaatgggtttcatatatgaaatctaagtgtttatgatatctctaagaagggtatataaccctttaacttttaatcctcacgtattagtttcactgaaagcaatcagagcaccaactccttcctctaaaaactggcaattaaaggtaaagaatttaacctagccttattataaaaacatgaatttcaagttgtcattgttgatgaaaaaaaatttactttttttttaaaattttatttattcattcatgagagacacacagagagacataggcagagggagaagcaggctccctgtagggagcctgatgccgaaatcaatcccaggatctcgggatcgtgacccaagccaaaggcagatgttcaaccactgagtcaacccaggtgccccataaaatttttctttttatcccagaactactccagctaatgtatgaggaagacataatcacattgtgacccctgatgaaatgattccggcagtaattatcaatgaatgaaaaccattagggaaaaggttggttgacagggaggacctctgcaactgaaggatcaggctatcactacctaaaacctttgattacttttagcatcactcaaaccctaacaattttcaatagccaaaacaatttgaaaaagaaggaagttggaagtctcacatttcctgatttcaaaacttattatagcactacagtaatcaaaacagtgtggtattgttaaaaagatggacagaccaatagaagagaagagagagttcagaagcaaaccctcacatatatggtcaaatggttactgacaaaactagaaaggccattcaaaggggaaaggacagccttttcaacaagtggtgctgggaaaactgaacatcatatgcaaaagaataaagttggacccttacttcacaccatatacaaaaattgactcaaaattgatcaaagacctaaacatcacagcctaaactataaaactcttagaagaaaacactgagatgaagcttcatgacactagacttggaaatcatttcttggacatgaccaaaaaaaaaaaaaaaaaaaacacaggcaaccaaagaaaaaataaattggactacatcaaaattaaaacttttgtgcatcaaaggacacaacagtgaaaaggcaacccgcagaataaagaaagtatatgcaaactgtatatctcataaggagttaatactcagaatatataaagaactcctacttaaaaaacaaacaaacaaacaaacaaacaaaaccaaagcctggggtgcctgggtggctcagtcagttaagtatctatctgcctctgggtcgagtcatgatcctagggtcctgggatggagcctgacatcagactccctactcaatagtgagtctgtttctccctctccctctattcctctacccacttgtgctcacttgctctctctcaaataaataaaatcttaaaaaaatgaaaaatgtgattaaaaaatggcttgaattgacaagctgaatgaccaaaaagcacatgaaaagatgctcaacatcaccaaccattagggaaatgcaaatcaaaactgtaaaacttactacccattaggacggctactatcaaaaaaacagaaaataacaagtgttggcagggaggggagaaatgggaattcttgtgcactgttgatgggagagtaaaatggtacagccactatggaaaacagtatggcggttcctcaaaaaattaaaaatacaactgtcacatggtctagcaattccacttctagatggatacccaagagaactaaaagtaggctctcaaagaaatatttctatacccttgttcatagcagcatcattcatagtactaaaaggcagaagcaatccaagtatccattgatgtatgaatgcattctaaaagtgcagtataggcagcccgggtggctcaggggtttagggctgccttcagtccagggtgtgatcctggagacctgggatcgagtcctgcatcaggctctctgcaaggagcctgcttctccctctgcctgtgtctctgcccctctctctctctctcatgaataaataaaatctttaaaaataaataaatagggatccctgggtggcgcagcggtttggcgcctgcctttggcccagggcgcgatactgcagacccgggatcgaatcccacatcgggctcccggtgcatggagcctgcttctccctctgcctgtgtctctgcgcctctctctctctctctctgtggctatcataaataaataaaaatttaaaaaaaaaataaataaaaataaataaataaaataaaagtgttgtatatacatataattgaatattattcagccttaaaaaagaaggaaattctgatccatgctacaatttggatgaaccttcaggacattatgctaagtgaaataaggcagtcaccaaaagacaaatcctataatactgtatgaaaccacttatatgaggtacctagaggtgtcaaatttatacagacagaaagtaggatggtgatgtcaagggctggagagagagagagaaatgagaagttattatttcatgggtacagagtttcagtttcacaagataaaaatactagaagtggatagtgatgatggttgaataacaacgtgaaagcacttaatgccactgaatcatatacttataaatggttaagatgataaattttgttatgtgtatttcaccacaattaaaacatacaaaaaataccctgaagcccagtaactttaagttagtcctccaaggggcacctgggtgcatggctcaattggagagcctgcttctacctctgcacctccccctgcttgttctttctctatctctatctctctctctctcaaataaataaaatcttttaaaaaccctaaaaccttagttcttcaaggccaaatcagtaatacattatgtggcagaatgaaaaacaaaaacagaagtcagctatttttaatcctaatctagtgcttatctataataccatgtagcactcccatccctggtcagttttgaatgttccaccaatcaggaaagagataacagttaacacagacaactattcctggcaaaaaaaagatggaaatattaacattctcattatttaaacttctatagcctacaaataaagcataatctgagtgggtaacagcacaactgcaggaaattaagatagattacaagtacactgaagcaacttaaaatactaatttgagtacagttaagtttaagaataatgcagggaatcaaaactacagctacagcaccaagagccaaacttatgcaagtggcataaaaatacagattaaacggacattttaacaatcattttggcagttatgttgaaaagcacttaaacataatgctggataaaaaggacttaatatttaaatattatccattttatatgcaaataggtagaaagatagctggtgttttttttttgttttgttttgttttttgttttttttttttgttgttttttaaatgatagtcacacagagagagagaggcagagacacaggcagagggagaagcaggctccacgcaccgggagcctgacgtgggactcgtctccaggatcgcgccccgggccaaaggcaggcgctaaaccgctgcgccacccagggatccctggtgttctttttctttcactactactgctgaatttctcaaccagtttgactagcacacacttggaacttcttgctatctgtagtattttcatcaaaggacaatttaaaatagaatatttaagcagaaatacttccaactaagtatttagttcatcagaaagtcaaatttatttttttaatttatttaattaattaatttatttttatggtagtcacagagagagagagagagagaggcagagacacaggcagagggagaagcaggctccacgcaacgggagcctgacgtgggactcgatcccgggtctccaagatcgcaccctgggccaaaggcaggcgccaaaccgttgcgccacccagggatccccagaaagtcaaatttaaaccactgatttacctaattcaaacttaaatatacatatatttttaaaaaggccattcctctttgtacacatgcttctaagatgaagtttaatttaggactatgatacctttctatagagttactatgtatgttctgaatacttaaaggcataacaagacataggccccatttgtcttttttagaaattcaaatcttgtatctttgacataattatggacaaaaagtagtaaacagcattacagatgacaattagttattcctggtgaaagcttttctgtcctagagatctggtaacacactacattaactctgttctcccttccccctcctcctaaaagaggacaggctttgtttctggcttcagagaaactgctgccagtcaacatcaccatccaagcaggaccaatgcaagaactagcaaaacaaaaccccttcctcctcaatgttctctccagaattacattacagacctcacattcactgacaagtcagagtcaaagacagtgacaaagcagaacttcctaaatgtttcttcattctcctcctcacatttttactttctccttcatttctttggtctggcatatcttgcacaagcaccctgtcctctttcatttcctattgcagcctcctaataggccaaattattttcctggctcaaatctgggcacagacctttggagaaatgaataagtactcattcctaagctgaagaaggtctagcaaaatccacacatgtgggatcttagggttcacttatgaccatctggacttgtcaatcctctaaaagaaagtcaatctcactactcacacacatttgaggtgtacagcatatacagacgcctctcctaggtcccttagtctgggccatgatagctgctactcatctctcttccagatgactgatggtgtaaatattcctcagagtactatcacctccaatccattttccattctttcccacacaaaattctcactcatgtcaaactgcacaagtcacacttaaccagagtttatgcttacttattgcagtctgaaaatgtgatgccttgtccctgtcaccaatctgaatccatttagttcaaataccacatattagggcaagcctttctagaccatttgatctagaaagtttttttctaatatttattattgaagagaagtatttttaatagactttatttttcaagattttatttttagaacagtttttaggttcacagcaacaccgagaagatgcatatatcctctctacctccatctatgtacaacctcctccactatcaacatccctcaccaagggaatatttgttataatcaatgaacctacacaggcacatcattatgttccaagtccatacttcatattagaggttactcttggtgttgtacattctgtgggttttgataaatgcataatgatgtgcatccaccactatggtatcatacagaataatcttactgccctaaaaatcctctgcactctgcctattcatccctccctcccctggccttcactgatctttttactgtctccagttttgccttttccagaatgtcatataggaatcatacaggatgtagccttttcaaatcggcttctttcacttaagagatatgcattagggggattcctgggtggctcagtggtttagcgcctggcttcggcctagggcatgaccctggagtccccggatcgaatcccacatcgggctccctgcatggagcctgcttctccctctgcctgtgtctctgcctctctgtgtgtctctcatgaataaataaataaaaattaaaaaaaaaaaagatacgcattaaaaatttctccatgccttttcatggaataagtgctcatttctttttagtgctagaagtattccattgtctggatgtaccagtttatttacccatttacctattgataacatcttggttgcgttcaattttttgcaattatgaataaaacagttataaacacagcaagagtatttgttttataagaaactttcaaacagtcttccaaagtgactaactataccatcttgcactcacgttcacagtaaatgacagttcctgtggctccacattctcaccagcacttggtggtgtcaatgttctggatttggtgcatttaataggtaaagagtaactatcatgttttaatttaattggcaattctccaatgatgtgataatgacaacttttcaaatgcttatttgctatctatatatcttctctggtgcaatgtcttttttacatttagatttatgatccattttgagttcatttttgccaaggatatataagatctgtgtctagattcacttttttttttttttaatgatactcacagagagagagagagaggggggcagagacacaggcagagggagaagcaggctccatgcactgggagcccgttgtgggattcgatcccgggtctccaggatcgcgccctgggccaaaggcaggcaccaaaccgctgcgccacccagggatccctagattcacttctttgcatgtagatatctagttgattcagcaccatttgttgaaaagactatcttttctccattgtctttgcttttaaagatttatttatttgacagagaaagagagagcaagcatgcacaagcagggggaatggcaggcagagggagaagcaggccccccatggagtagggagcctgatgcagggctcaatcccaggaccacgggatcatgacctgagttgaaagcagacacttaactgactgagctgcccaggcgcccctgtctttgcttctttatgaaagatcagctgactgtatctgtatccatttctggaccttctattctgttgttctatcaaactattagtttattctttcaccaataccacgtggtcttgattactgtagctttatataataagtcttgaagtcagggagtatcatttcttcacctttgtctttctctaatatgagttggctactctgggtagcatcttcacaaaaaatttagaatcaatcagttgatatcgacacaaaaacctgccgtaattctgactgggaatgtgttgaatctattgatcaagatgggaagaaataacatcttgacaacactgtcttcctacctgtgaacatggaaaacctttcctcttacttaattctttgatttctttcatcagagttgtattgttttccctcatataaatcttgttcatattgtgacagatttatactttggtatttcattttggagggatgctaacataatttcaaattcaagttgttcattgctagtgttacaggaaagtgattgacttttacatattaactttgtataattgcttattagttccaggagttttagtcattttttaaattatctatatagatagtcatctgcaaaaaagtacagttttagctcttctttcccaatctatataccttatttcctttatttgtgttatcacattagctataacttccactatgatgctgaaaagcagtggtcttttccttgccttatttctgatcttagagggaaagtttctaatttctcaccattatttttttttaagatttatttattcatgagagagagagagagagagagagagagagagagaggcagagacacaggcagagggagaagcaggctccatgcaggaagcccgacgtgggactcgatcccaggtccccaggatcaggccctgggctgaaggcggcgctaaaccgctgagttacccgggctgcccaaggataaatttctttaaaagataaaagcctattcatattttctacttcttcctgtgtaagctttggcagattacatctttcaaagaactggtccattacatctaggcacagagttgctcataatatgcctttattatccttttaatgttcacaggttctgtagtaatgtcccttctttcatttcttattttagtaatttgggtcttgtcttagcctatctagaggcttactgatttatttatttttttatttatttatgatagtcacacagagggcggggggggcagagacacaggcagagggagaagcaggctccatgcactgggagcccgacgtgggattcgatcccgggtctccaggattacgccctgggccaaaggcaggcgccaaaccgctgcaccacccagggatcccaaggcttactgatttaaatgatcttttcaaagaaccagtttctggttttgctgattttctctattgactttctatttgtaatttcattgattcttgatctaatttttattatttttcttctgtgtactttggatttaacttgctcttctttttctagtttcttaagataaaagcttttaagattatagattttaggccttttttcacattaagctgaatattcttctgccttgggtattcaacacaaatgttcaacacctttctgattttaggacctagaatctccgacttcaccattaagatcccacgagaactccaaaaacaaaacaaaacaaaacaaaaaacaaaaaacagatccctgggatatctgagatgacagaagccttaaggaatctttactaagtagttaatacaaaacaagttaacagttgaggagtgactactgtactacaggtttcacaatatagtcaggtcttttaataataataacaaaatgctaaaataataacagcatctaacaattaatgcttatcatgccagatgctggtttataaacttttacatgcattaactctctaattccctcaaaatcctatgaagtaggtactgttttccttattttatagattaaaaaaatctgtcactaagagataaaataatttcctaccagtcatattcctaattactattaaccagaagtcaaaaccagatggtatgatttcagagcccacactacgactctattgccctatatgttactaatataaaatttatgaatttaactataagtaagccaaaaaagttatgttttactcattcttagcaagcagcccagattctattattcagatggctgtctaatacatctattattttatcattatttatacactttgccccacctcagcaaaaagaattagcaacccacagagacagaaggcacattagttgttgccagaggctatgacaatagggagtgattgtttaatgggcatggggtttccttttggtgtaataagaatgtgtgggagctaaatagatgacaattgtacaatattgcaaatgtactaaatgccacagagttgtacactttaacattttaccacaatatatatatatatttatttattattatttatttaaatgggacatctttttttttcttttcttttttttttttttaaagatttattcatgagatacacagagagaggcagaaacagaagcagagggagaagctggctcaatgcagggaggccgtatacaggactcgaaccctgggactgcgggatcacgccctgagccgaaggcagacgctcaaccgctaagttacccaggcatcccttaccacaattttttaaaagaagaattatctagggcaggctgggtggctcaactggttaagtgtcgaactctgcaccgggcatggagtctgcttaggattctctctcccactgcccttccctgaccctgtctctctctttccctcttgaaagcaagcaagcaagcaaccaagaaggaaataagagaaaagaaaagaattatctacaatattttgattaataataatccaatggaatgatattcaactcctaaaaattgtgtttttgaagagtatttaacaaggggaaagatcctaaaatattagtgagtagggaaaaaagtaggttacacaactgtgtagcataacatcaaatttgaaaaataaatttttatttttatttatttatttttttgaaaaataaatttttaaaaaaatatttggacacatacattaacagtgtttatatccatatagaagagtaaatattttgttttcttctttatattttttgtatattctaagttctatatttcttttattatcagaaaaaatacacttataaaagaatttaattgcaaatacctaataagtttagtgatataacagacttaaaagtccctcaaataagagaacacaaaacatataaaatgattgaaataaattcaaatatatcaataaacattaaatgtgagtaatctaaatataccaattagaagacagagatgatcagactgggtgaaaagttagtctaactatatgctgtctccaagaaactccaaatatatagacacaggtaggttgaaagtaaaaggctggaaaaggatatatcacgtaaacactaatcaaagaaagctagaatggctctattaatatcaaagtagacttcagagtgaagaaaattatcagggaaaagggggacattacacaaaaataaatgggtcattcacctagaagacataattttaaatgtgtatgcacctaacaactgaccttcaaaataaatggaccaaacactgacagaactgaaagaagaaatacgcaaatccaaagctgtaggtagagacttcaacacttcattttcaataatagatagaactattagactaaaacaagcaaatgataaagacacagagaaattgaaaaaccaataccaaccaactggatctaactgacagttatacaacactccactcaagataccagaacactcttttgaagtatgcataaaatattcacgaacaacccccccccccaaaaaaaaaatattcacaaacaagacagacaatatcttctgggacaaaaacatcttaacaaattcaaagaaccaaaatcaaaataaattgtgttctctgaccataatggaatgaaactagaaatgattaaataaggtaatgggaaaaccatcaaacatttggaaatttaacaacacatttctatataacccatggctcaaagagaaatttctcaagagaaattagaaaatatttttgagtgaataaaaataaaaacacaatatttcaaaatttgtgctatgtagctaaaagtaatgcttagagggaaatttacagttgctataaagtaagtgtttatgcccccatccccaaattcttatgttgaaacctaatctccaatgtgattgtatttggcagtggggccttaggaagatgattaggttgagggtagagtcttcaagaatgggttaagaatgctcttaagaaaaaacaaacaaccaccgagagagcccttactctctgccttgtgagaacatagaagacagccttctatgaactaagaagcaaacagcagacacccaatctgctggagttttgacctcagacttcccaacctctagaactgtgggaaataaatttgtttacaacacacttcatctataataggtttgttacagcagcccaaatgggctaagaaaatagttttaaacacctatattataaaagaaaggtctcgggtcaaccttagcttccatcttaagatggaagggctaaacaattaaaagcagaaatacaataactgaaaacagaaaaataaagaaaaatcaatgaaactaaagactggttctctgaaaataccaataaaattaagaaatctagcaagaaaaaaggagagaagtggtgcctgggtggctcagtcggttaagcatctgcctttggttcagtcatgataccagggtcctgggatccagccctgcactgggctccctgatcaatgggagcctggttctccctctcctccctggtttgtgctctctcaataaaataaataaaatctctttttttaaaaaaaaagcaaaaagaaaaaaggacaaaaaacataaaacatcaagaatgagagaagagggggcgcctgggtggttcaatagttaagcatctgacttgatttcggctcgggtcatgatctccaggttgtggaaccaagctgcacgtgggcctctgagcctggtgtggagtatgcctatccttctccctctgctcctcccccccccaggtgcgtccacacacgcatgagctccctctctctcaggaaggaagggagggagggaaagaaagaaagaagaaagaaaaccttaaaaaaaaaaaaaaaaaagaatgagagaagagattattactactgacagaaggcattaaaacaataacaaaggtactacaaacaactctacacacaaaaatttgacaatttagtgaaaaggaccaattccttgaaattaaccaaagtcatccaagatgaaatagacaacttgaacagatctataactatgacaatatactgtagtaattttaattccaaagagaaccctcccagatgatttcactggcaaatttcttaaaagaaaaacacccccatttctatacaatttcttaaaggaaaaaaaaattagcacaacatattagtttatagaactgcattgtccatgaggcaggctactggccacagacagatagctattgattaccaaaaatgtggctacagcctcatgttgaaatgaccctattttggctatcctaacataaaatatattactttgaacatttttaaaagtcctcacataagatttaggtcagaggtaggatctgttttcttaatcacttctgatttctaaacataaaacagaaactaaaactaaaaagaaaaaatgactttgaagtggctactaagccacagcttaactcactctagaattcaattgctctcaaaatcatctcaaaacaaagtacaagcaaaactcttagaaatcaagtgggaggggggaacgcctgagtggtgcagttggttgagtgtctgactcgtggcttcagtttggtcatgatctcagtgtgggatccatgctcaatgtggagcctgcttgggattctctctccctccctccctgcttgtgttctctttctctcacaaatacataaatacaccttaaaaaaaaaaaagaaaaaagaaagaaatcaagaggaactggaagaacactgatcactacaaatcaaaatccagaggttaacaggtacacatagcattcctttctagagccccaaggtccaatactgacaactctctttgtaaagaaagggaagtacaagctctttagagataaaaggagaaaaataaagaaagctttaaaaaatgtaatttttttttagaatgaactgatttctaaatgacaagtatctttgctgtttcagggaaaaaccccttagagtattatggggctagagtcaaagcatcatttacaggaacagaatgcatttgcttttcagtaaggagacacccttttcaaagactcccacctttaactacaagactaatgggaggtttctaaaaatacagtaatggctacattctgagcagtaattgaggaatataaattccatctgaaaaactaagatatcagataaagcttaagagaccaatacatggatcattttagacactaatcatcaatctgttacaaaataaccacacaattttcagcaggtttatagcacatactgataaagtaggtattcacgatttgaatggaaagcaattatgcttgcttccttacttttataagagatatgatctggcctaattcagtagaaactgcacacaatggcacttactaaaacttcccatcatatgataatccagtaaaaccttaagaatttctcacgtgaaacaatttcaacatatatggacatattttttttttgagaagtggaaatatacatatcccgtcatgtccttttttcctcatttttattatttctgaaattaaaagtatcatataatcaaatgtgttcatttaatataatggctctaccctcccctccctgcaagaaaggtaatcattaaatgaatgatgtatattaaaattgctatcacataagatcaaagaaatgcagtttttacgtgttttactatgatagggttatgctaagtaacaacactttttaaaaaaaatattttctatctgacttttttttaaagatttttatttatttattcatgagaaacacacagagagagagagagagagagaggcagagacacaggcagaaggagtagcagactccatgcaggaagcctgacatgggactcgatcccaggtctccgggatcacagcctggaccgaaggcggcgctaaactgctgagccacagggctgccctaactaaaaacacttttaaactagatccagcccccagctacagcccttaccaatgcatacacacaaaagagggattctatatacgtattttttttaaagatttatttatttatgatagacatagagagaggcagagacacagacagagggagaagcaggctccatgctgggagccctatgcgggactcaatcccgagactccaggatcgcgccctgggccaaaggcaggcgcgaaaccgctgagccacccagggattccctatatacatatttttttaaaagcaaattatgcttaagtatttaatctttaaaattgtcagggattttataactattttctttttaataagaaatatattcatattttaagaaagaattatatttggttaaaaacatttttaagggggctcttgagtggctcagtggttgagtgtctgcctttggctcaggtgtgatctcagggtcctgggatcagcttgccacagggagcctacttctccctatgcgtatgtctctgtctctgtctgtgtgtttctcataaataaataaataagatctttaaaatcaaaataaaacaacattttttaaggaactgtcatgtcaatccctaaattttgaatccttgaaacctaacattctagatcagagaagtttctgttaacaacaaaagggctttagctaccataagaaaaatagatgctgctttcaaattatattttgcccttctatcaaacatatatacacacacacacacatatatgtattaaacgtatatatatacatatatatatgtatattcttctgatttcttgattttctatgttccaaacaggttcatgacacatatgtgcattttagaggctaatctgaacactacagccattttacattgccttcgactcatttggaactacctagacacaaccaccaaataattaccaccatctggtaacactaccaccaacagtaggctttcttctctgaagctgaaatagcaaatcacctgatagacttaatattaatcttacaacataaacatatttaaggattccagattcatttacatttgagacgtcccttctaataaaaacatttcctacacaagtcacaatcagcttaggctagaagggctactcatatttctgatattacagaattctagagaccagaatccaaacaaagaatgccttactgaggatcttctagaagcaaatgaggcaaccttttgagtataacatataaaagagaaaagttctaatggtaaggtcaactaaatagacatttttccaaagatatctagatggctaacagacacatgaaaagatgctcagtaacaccaatcatcaggaaaatgaaaattaaaaccaaaatgtaataccatctcgcacctgtcagaatggttattatcaaaagataagaaatatcaaggctttttgttttttgtaaagtaggctccatgcccaacattgggctcaaactcacgacctcaagtcattctttaactggagaagatgtaagaactttaaaaagttttaggaaataaactgtggtttatatagagcacccaataagtttcctagcatgtgggacttattatggcttaggaacttaataaggtaagttccaggggcacctgggtggcacagtcggttaagcatctgactcttggtttcgactcaggtcgtgatctcagggtggtgaggagccccgcatcaggctccctactcagcaagaagtctgctggagatcttctttttctctcttcctctctctctcccacacctgctctccctaaaataaatacttctggttaaaaaatgaggaaagttccatttctacctcagaaaaatgaaatgaataacatgtaagtatttaatgtacatttgcaatgtccctaggaacccatgtgaactattaaaaagaagagctacttcaagcgggagaaaccttcattagcagatgatgaccacactattacttcatcttagcttacttcacaaccagaatgcctgcacaggagtaaatctctcttacagaactgggaagagggtactctattattggaagagaggaagcatattactgttggtatcaagactaaaatggtgacaaccactcatgctgcttactgcttcccaagagtcaagtgtcctaagtgttcttaagaagtgtgccatctgggatctctgggtggcgcagcagtttggcgcctgcctttggcccagggcgcgatcctggagacctgggatcgaatcccacgtcgggctcccagtgcatggagcctgcttctccctctgcctgtgtctttgcctctctctctctctctctgtgtgtgtgtgactatcattaaaaaaaaaaaaaaaagtgtgccatcttctagaaggcaggaactcctttgaagaacactgatatttacccaactacctaagagtcgcctcaccaatattaatcccatcctcatccctaacttactctagaaatgtagagaagacttggggactaataccccatctaccctaagctctgacaggaaccaataccctgcagtcaaagtttctttgtgaaccccatgtagtagtgaagaccaaattaatgacaaagatcattttatcaaaatgataaaactacttttcttaatttatagctataatttataacttttactgaacaccatattattatctcttgtcttcagtttcctcatccataaaatgtagccaatacttcctttataaaaagtaatttatatgtacacagcccaatacagtgtctgacatacagcaggtattaaataacaggttgcttttatctaaaaagcaaatctgtaaaagaagataaaagaaaatatttgggtttgaaaataaagctgccaggaatcagatatgattagaaatgtgtgcggtcaaaaaggattgctggtaaagataaatatgtgaagctaaggtatttagtaagggccaagggccatatacacacaccccacataatgaagaactgtccatacaacacaccaacagcacctctcttgagagattctcagagcacagccaactgaaaatgggtaggtgccccactttataaattattcaatatagcaaaaattccctttgaggacaagaaatgaactgaaacaacagaagtcttattataaaaaataaagaaaattattctttctagagaagaccatctaaagactgtagaagagaccacccaccaaaaacaaaacaaataaactttgctgttaagacaggaagatgagacccaaggtagttacctaacttgtacaagtttgtgtccaggcaacctaggcctactttccaaacactttccactatactatactctatgagcttacaaggtgagagcagaaaaactgggaagggtaaagaatgcttaacaaggcaggttttttttcatgtgctcatagctatggttttatgtatactatatcacattctgccagcaatctaccatgtctgctatcagcatgtattatgatcaatagtaatctggattcagtgaaatattgtaatattacagaattatattctttactagagaagatgaaccgtttacaaactctaggtcacacagcaccagaggtcatcagagaaggcaagaaggcaaacaaagcttaaggaggctcctaattcaacaagatcagtttcatttttaggttttccctttttttgaaggggcattcataaatgctcttataaaggaaagggttctactgatttttttaaaatgctttgaaaatcatggaagtaaatcaattattaagatctcttgaaggtattagatttcacaaagtcctgagaaacaattcacagattatatgaccacaaaaggctttaaattctttattgcctccaaagctagtatatttatacctacctctagaattgatgacagatgttataggtacaaattttaatgtcccacatagtgataatttttatattaccactaaaacacaccacacgaccagagttttgaaacactagagaacagtaagaagcagtatctttgcatcaaagggattttttttaaagtcacatccctcccttaaaaacactgacattcatttaaaaaaaatctccactctgctttgggctcagctttctgaagttacaaaataaataagacatgtatcaccttacgttttaaaggtatgtgagggattcatcgaatttaattgggtagaaagaggaaaaatgccaaagagacgtaagggggtaagtgcagagaaactgcaatggctggcggggagaaaatgcaaatgggatctcagcagtggaagaagctagttgatccttgaacaacataggtttgaactgcccagatccacttatacatggatttttttaaaaataaatatagcgcagtactgtaaatgtattttctcaattttctgaaaaacagcttactttaccagaacagaacagcacagtatataatacatataactacaaaacatgtgttaattagctgttaatattattggtaaggtttctggtcaacaggctattagtaaagttttcggggagtcaaaaacttatgggggcatctgggtggctcagttggttgagcatctgccttcagctcaagtcatgattcaggggtcctaggatggagccctacatcaggctccttgctcagcaggggagtctctctctctctctctctcgttctctctcaaaataaataaataaaatcttaaaaaaaaagttatgctggattttcacatgtcagcatccccaaccccctatgctgttcaagggttaactgtacaggtacaaaggttcttagaaaaagtagcctgaaaagggagtccagagggaaaaaacaagtaatttctgcattctgatacatgattgcatattcatttgtcattcaacaaatagttcacagtctagcaggagagaaggatgagtaaaaagtaaacaaacacctaaaatacaatgtgtcaagcgtaataacaagctcgtgcataatattaatgaaaaaaggagggatgaatttccatggggtagtgaggagagtaagcaaggagggaaggaggaatggtgacttcatccctgaggatgaatttactggaaagagaaaagatatttctggcgataggaacaacatgagcaaggacatggtgaagtgaaagcatgtggtgtctttggggactggctgtgggggagtaaagaggagactgacaatgaaagtgaaaatgaggccagatcgtgagcagctttaagccccacgccaaggaactgggcttcaggacagtaagcagggaggtttcaggcaaagaatgatgtcatataagcactatgagacaccctttctaacattaagattttttttttgaggctactaaaaatatgtagtttcccctggttgcaaaaacacagagacgaacattaattccaggaccccttgaaatcactccaaaggccccactggccttgggtccagttaggagctcccagagggtgggaactattcactatatatatttttttggattaccaggacatgggatatagtggaaccaagaagaaccagtttgtgacaaaggacggttaagactgaacaaaatatgactccaaggttcctgactgatcacctcggtggggtgttgttgagaagaatgtaagttttgcctggaagataataagattcagaaatctacaagatgtctacatgttctgtccaaaagcagttaaaacatagggttggagctccaaaaagagtttgcagacacagagatgaatctgaacattgccatgtacactgaactggtgacagctgaacctacatggatggatgaggtcactgagcatgaagaggacccagctcagacactagcaatcctggggcaaagatgaaactagacagagagagatcattcagaagaggagaaacaagacaggtatcatgtgagcctaggaagatatagatttcaaaaaacacttggagcaggtgccaaatgacagaggggtaagctagtatgaagactacgtggctgctgaatttggaaactgggtagtctctgattttcatttctctagagtggagaaagaatagactaggttgaagaacaaatgaaaaagggaagaagaggcagtttagcttactctgctcaaaaagtatacccataaagagtggagagaggtgtcgtcaggtcctcaggttgggagaagtacacacattatgcattatcttttttaggacttatatctagagactctgagaacaaggactgcctttagcatttctatagcacctactagattatataataaaaagagcagaactactaaatcattgtttagaatgcacaatagatatatatctatatatctatatctatctatatatatatctcacacactatctatatatatatctcacacacttcactaaattttaactaaactgctagtgtaaaagggagagcactagactgaatctgttagatagtcactgaatgaaaatcatttacctgcatggggtgactgtttaaaagaggtcatgccttgttatgtaatttgacaggctctgtgagcaacactgggaatgctgtaagatattaccttaattccttcaccccgggctgcataagaacatactcacctccatagtagagtcctgtagcagtgcacatccgccactgtccctgatacattcctgctctgctggggctgcacatctggacgctgacatctgcaatctcctggggctctagcgatctcaccatcaccatgttcacatgtccaaattggtctcccccgacatatttaagacaaacccctggaggccaggcctctgcccctgagttcaagcaaaagaaaaaaatgttaggcaattagtggtcctatgctgggtgcagttcattacaaaactgtagaagagccctttttctctttcacacatacgtgaacctagccacatatccttgagctataaaatgtcacaagactgaccagaaggaattatcagagttaacaacctctgaccaacagtctatccctaagataaggcacatatgaccaaagcaaggcagttcctcaagaaaatgtgttttaagagaccccaggaaaggccacccatcacaccgaatctgcagaacctaactaagaatgatgtctgcgaagagctgtggaaatgaagcataggccacatctttggaggcctgctttcttcactaaggttacttacacatgcccattttcactagaactttttaagctaattctaagtaaaaacatatttgattgtcaccagtttttctatcaaggcaagctgatgaaacacatgaggaataatttctatattatgttctttttaaaacttttcccctgatgtatgacttttccttctggagtccttaactatgaaaagaccaaggtgcaaatgaccctacaagttcgagagagaggagtcaagtgaaagtttcattttcaggttcaaacaagtagtggggaaaacaggaacagtggggtgaactcccctggtaacaacacactgatctgtggtctcagaggtgaatgacaccagcaagaggtacctgcacaaagagtaggaatagcaatacaaagacaaggcacgggcagaaacgtctttccttctttggtctttcctcctttggaagtgacaaagatcttatttgggtacctcctcctgtgtacctgtaaactaatccaaaataagcaatccatatatggactagttctgagagccaaagggccacacagtgactagaggctatctttctggtgaaatctctccagtatactcttttttactacagacagaaacctctatatatcttttgggggggatacataaattcactataaaaaataaatcactgtgaaaaaatgggcatggcaggactctaggacaaagcatgcttgaaatgtaactcctgagagcattctaggatgcctcaataccttgttctcaaagtgtgagactggttttgatatactcgatgacttactactgaaaagggaatcacagagaaaggtaactacagctctactgctgagatctcagtcccataacgaatggcacattctgtggctcttggatctgaaggggtagcagatgaaacagtaagcacaatgttttgtcagaccctcttaaaaacatacctgctagcaaagtgctctccttaagttaacattataaagggcaaccactgctggtggaaagcttgtgatgataccctggcaatacatgcaaattgtttctcatttctggagcccatggtcttggcaaaagcgtatttgtctgaggtcaagaatagtagcagctggcatggagcaccttggaaattgccagtctctttaaagaccaagatccaagagaaaagttaagctgctatattagggttgaattcacaattattctttcaaacacacacacgtacacatgcacacacctgtaacaagacatgttagtatgaaaacccaagaatgtctgattttgaacttctaagaaaatgaaaaccaagactgggtgtgggaaatacttggctgtcctgcacagacaaccataagcagctgagatggacagagctctcagctatgcaaaagaggagtgccaatattctctagggagactgcgttagttggtaaacatgaagcgattaacaaattatgcagctactgtcctgatcttttttaatatgccagatactctattcgtatggtgcctggggagcttgttggagaaaaaaagttgatgagttatccaccatcaaccctaaagtattaatttactataaagtgaagaaccaatcatttaccttataagaattaccaatagtgtttactaagacatttagttcttacagcctggtaagtcatgtaactctaaaaaggtcaaagatactagttcttaacacagaaggaaaggaaatactggtaaggggcatggaccaccagcatatctaaaatctagatttgagaagtataatacaacagaccttcatattaagtctcagttacaaattggcttaatggagggtagatacatctaaaagaaaagaaagaccaatctgtgttttatgacttaagtatcacaagcacacatttgatcaaggctatgattctccagttatcatagaatataattttattcaaaaaaattaaaagtaaaaacaaaacaaaaaatcctgacatatggcaacttgagatgatagagaacacggcaaaaaatgaaataaaagtccaccagttccagaaagcctggatttactaggtataagtgattacagaaacagttggaagatagtaaggaacatccagagaccaatgaggaagacaaaccttgataaagacctattctttttaagccctaaaagtctggagactacatttcaaattaagctgcatgtgaacagggaccttcattgatcttgtcactattttcttcctgtacttgatataaagtgactggaatataataaaatttgctgaatggatgaagcagaattgccttttctatagtcgtcctgaagagaaaggcagaaattaactgttttaaggagccaaaagaaaaatggaggaaacagttgttctttcttaagttcttttctcaactcttatgttcacaaataaagttgactgtgaagccactttctcatacaacaatcacacatactttgccaaagtccaagaaacaccagagttatactcagcttaacattcactatgactggaaaacagagcatggttgtaaaaactcagaagctaaagtattggtaaagaaaactgtctattttcaccttggagaggcagtttcaaatttttactttcaattttgattataagacttcctgttcaagtttcccaagcttctaatactcatatagtgccaaaagtctggatcctgggattctgcatctatgtcatgaaatgtctgacttctgtttttgcatggtctgtatctaaggatttaaacaatattaaaagttgaattttaaacaatgtgtaacatttatcttctttggggaaactgctgggacagctatatgcaattcctttacatctcatctgttgtatatttgaatgcctgacatgcctgaaacatgacagcagagagataccatgaaaattatttatgaaactatttcagtgagcacttctctcgtggagaaggttatgaatgaaagtaaaagagccaaaggagaaatagctaaggcctgccctatttctgttactatatttccaggaagaactcaggccagattaggatgacgccgatgccagtacacgtgcatgctttccctctttaatatctattacttagttatggaaggtcagtttctccttaatcgaatggaaagcatgcagcttatagatacaaaactatttaaaaatggatgaacaatttccaaaaggataaaaaaaatctttgtgttcaaagtaacttaaatggtaaaaactccagccaactgttgcccaaactcttcaaaaagtgttcaggcacaagaatggcctttcaaagaacaaacaatgcagacccagaggctgttttaaactggagttaccatgcaaaagcaggcggaaagagcagcgagccccaccgatacagattttctccaagtcaaggtgaaagaaaggcaggctctttggggttctgatctgacatttaacaattttatatcaacccctcccaattccccattaactcaaggagctgtgtggtaagtgaatggatgtatcaagaggatgtttgacatacaaatcggtttctgcaaaaaagagtagctcaaatatttcagtggtactctcagaacttttaatatttaaaaacactataaagaattcacagcaagccagactattttcagtagtttcactataaataaacaaggtcttaattttttaaaaaataaaactgaattcatgaataagcttcaaaagcagttttgagcagcaactagcacgttttagtaattcaaagaagaaacatgatgaacagaagctgaactaaagagactgttttaggggcacctgggcatctgactcttgatttcggttcaggtcatgatctgggatcaaaggatcaagtctcacattgagctctgtgctcagcacagagtctacttgggattctctctctcttcctctgtccctccccatgtaagctcattctcactcgctctaaaaaataaatgaaatctttaaaaaagaaattgttttaatacttttaaaagcctacaacactgggacgcctgggtagctcagcagttgagcatcttccttgggctcagggtgtgatcccggggtcctgggagccagtcccacatcgggctccctgcagggagcctgcttctccctctgcctatgtctctgtcccctctctgtgtctttcatgaataaataaataaaaatcttaaaaaaaaaaagggcctacaacattaagaaaagaaagaaagaaatcagaccaataaaagggaaagaaatcaggcaaaaataattaagctttgaaaaaaagcttcttttttggaaaaaaaaaagaatttcaagaaaaacagaaaacatggctattttcccataccaccatgtgtccctcaaactaacaatgccctacacagttacaaccaaaagggaaaagaagctaatgaaaattttataaagccatggatatctccagtcatctacaacatcgggtcaatccggattatacactgaactttcatccaaaggagagttactcctaaaaaagtcagaaaaactaagaataaaactttggtacattagttagtatataaggggatccctgggtggcgcagcggtttagcgcctgcctttggcccagggcgcgatcctggagacccaggattgagtcccacgtcgggctcccagtgcatggagcctgcttctccctctgcctgtgtctctgcctctctctctctctctgtgactatcataaataaataaaaattaaaaaagaaaatgctagcttagccagtctttccccatcattagaaaattacagtacaaaaacttaaaagtaaacagtcaataaaaggtcacttttacaggtttatttgagccctgagagttttttttatcacgtcacatcagatcaccttgctagacagagttcccccacatacacagatttttagctaaatatgccttctgccaagattcccaactctcagaatttctctgttaagtcctcagtaacaaggaagttaaagcgccctgatctagtcagccgcatgaataactactgcatgaaaaaagcaatactaactccactcaaatttaaagtcattaaaaagaattttactagcaaaaggaataattgttaccagacatatactcagatcctattttcaaagaactatcactaacttatttttaatttttcttaaagtcggcagtacattacaacaatgcttcaaaaaaatttctcaatctttccatatttcccattctgagcaaatgtccacacctcttaccctatttttcaaagtggtattaacatttcagagagatatctcaatgaaatttcataaagaaaaaaaaaaagaaatttcataaagaatcatccctgtggtttcaaagaaatgagctttcaaaagagcagatgctcacagctctttctaaccaccttgttctattcaaggatgtacctcctctagccttctggaaagaactggaagattaattagagcagaattaaaatgacagagtagaactgtacaggtggagataatactaccaccacacacaggcttagttgctggtatcaaatgaatactgaattgtttagaggccatcaagacctggaaaaaaaaaaagaaagaaagaaaaagatctaaatcatttttcctgatccatggcaggggacctttcattgatttctcgtcatcacaccagtataaaaaagtactacatcagggtgcctgggtggctcagccagttaaacgtctgccttcggctcagatcatgatcctggggtcctaggatcaagccctgcattgagctccctgctcaatggggagcctgcttctccctcttctctgcctctgcccccacccccaccctccatttgtgctctctgtcaaataaataaaatctttaaaaaaagtactacatcatatataagaaaaagttcagttacaaaagcacataacttaagctaaaacatttccttatttcttttactactaaaaaaaaaagaaaactgggcaatgaagaattgaccattatgtatttaccagaattctggatccgccatgtttttataaattgagtatcaggaggtatcgactccccttctcctatggtgacatcttcaacaaatgacatagagggcacactgatgtttgggctctcaaagtcgtaataggcgccaattgctgcttgtaggttcctacaaacaaaaagaaaaggcaaaagactttactttagtcctggccagagtatatgatcctgattgtcaaaataaatgaaaaaagcctttttcttagggtttggaatagaacttaaggctcctggtatataaatcttcagagccactgattctggctgaggcacgcctgggactgataaacttatgcatcactttcctcctaaggtgtgcacacaaaaaataagaaacattagcaccatcagcaacatctcctcttacccacaaggagagcaagtatgggtaaggaagtcaattaagagagggctccctctacaaccttttgactggaattctaaaaacccctctattttaaaagacaagctaattatttaattttttgaaaaggcaacacatgcagatagtttaaagagttttgtaaaatgaaaagtaatcatcttgtctcttctttcctacacacacacatacacacacacgtaactgctcatattactttcttcagtaaccttccagaacttcctcatgaatatacaagcaaatgatatatattcttacttctcccccttttatacaattagtgacatattatacacttccctttgctttattctcgtgaagatattccctgtcagtacataatgaatatcctgtttttaatagctgtatccattgtacagatacatcattatttatgtaaccagtccacttgcgagtttgttttcagtctttagttcttccataaataagcttaaacacatattgtttttataaacatgcaagtgtatctgtaggataaattcctctaagagatagtgctgggtcaaagagtatatatttgtgttttttttgttttttttttttaagattttacttatttatttatttatggtagacatagagagagagaggcagagacacaggaggagggagaaacaggctccatgctgggagcccgacgtgggactcgatccagaactccaggatcgcgccctgggccaaaggcaggtgctaaaccgctgagccacccagggatcccccatatttgtggttttaatagatatatcctaaaccttcctccataaagttgtacacttactgctcccatcaagaatgtatcagagtgtctatttccccatttgctcatcaacagtgttcatccaaagttttggatttgtgtcaatctgataggtaaaaaataagatctcagtgagcccttaaaatggttttctcttgttacataaaaggttaagtatcttttacctgtttaggagccatttgaagtttctgttttagaaccaccattttgtaaatgttagtgttctttttaattactcataaacccccttatgtcagaaggaactaccaaccacacaaatcgagtctctaattaaactgaaacacatgattgacagcaggttcattcatgccagaaaccaaaggccactaagggttagtttaagcaagctgtgttcattagagagaccaaagaaattgctagtaattacattaactgctcctcttaaggtcttacttaaactagtgacatcatctccagtccccacagtagacagcaatacaaattgaatttttctaaacataacccaaccataagccaatggatccagtgggttgtttttaattatgcataaacatagcatgaaaaaagctccaacagtagtatacaattgttcaacagacatattattgacagcaaatactttctgctgggggcctgcctgttcctccaggtgtttgcagctgccagaaaggaaggctatatttagagcagctgcctcaggtcaagcctcacgcaatggtggcccgtcatattagtcagtaataactagaattacaccactaacaactgcctgcctgttgtgtgtgtactagataaaatttacatggagctgagctgggccaggggccaaactgcctgtttgcttgactattcaataggaaggcttggactttagtcttcccagcaacttccttctctagctgtgatgcaaaatgagtaatgtgactggccaaacttggggacgcccagccactaccacccacaaacaggccataggagtgtatctgaaaccagccatacacttaggaatcagggaatgaaaaaatgaaatgtaagcccagtttgccttttgttcttctaaaaactcttcataaaagctatgtgtctatcattttataaagataattttctgctgcaggaacttcagcaaacagcctgctgaattgttttctgttcacttggctgtaaaatatgcttgggaggaagaaactatttgtgcactcaggacaattgccaattctcatccccagcatgtatcatatttcaccacttggctctgcctgatatcagaaaggacttcaagaccactccagtagaaacataagcacattcagctaccctactgagacagagctggccccctcctcaaatcctgtttcacacagcccaactcatcccatggccaagccaacaaaactacttatttgtacctgtattatataggtaattcatccagagaaagattaagaagcacttttaaagcccaaaatgaaaccaaaagtagtgaactggacttctggcaggaagcaggagtggaggatgacaaagcaaattaatttcccaagtacaaagccaagtgtggacttcagcccaatgctgctctaacccatccggcaggtacacagcttaaaatgtgggtacgcagctttttggcacttaaatcacttatatcactgccgtgctgggccaagcaatggcagaaatagaccaaacagctccaattcagtgtgagaacaagtagatatgagagcatgtatccccgttcaaatcaacatactcagttattattagccaacaagaaattctacatgaaacagagctggctgaggaaatgggaaaaggaagaacacagactctgtattcaacccaagctgaaagtttaaactttcaggttcctccagcatttttgctcagaaaaagtctttaatctgatttcagattaaaccaagagcaccctaaagaacaaaggaaggcagtgtaactgaggaaaaaggcacaggccaagacgatggtgatggctatgaatatgcttaatgccacagaacggtacactgaaaaatggttaaaatagtaaaatttaaaatggctctgaggcagctcctatgcctggctgtggggttttgaacaagtggctaggaatctatgtcatcttactcatctacaaaactgagttttctgttatcagaaggctggcttatattacaaagttggcacgataaggttagctgcaaagactgtatgagacaatgtgtgtaaaagccctagggctggcattcaaccaatatttaactaataatgagcatttatccacatgttaagcactcaaacagagactaggggacagaacagataggaagacaggcaaggcccctctacacagcttagtttagcagacttcacaaacaagggacattcagaaagggtaactcccaactgtctctcacactgaggtaatttatcagcccaaggcagcttttcctactgtgtgaaaaacgggcttggtgcacaaaacagtctctactgcactgataatcaggttaacctgattcagagtagaaaaatttggtgatgttgatatgtgttccctgatgaaatgcaattttgtaactcagaagcaatactgtccaacattaattttatagaggaggctacaaatccagtaacaggtaaataacctgtctcatgctagactattagaagatttattcaaagacataaaacttcacttacctagaactttccaattatctaataaccttccgaacacctgattttcttaagaacataataattaccatcatgaattttttttaagattttacttatttattaactttaaagtaaataaagagagagagcccgtatgagtggaggaaggggcagaggaagaaagaaagaatctcaagcagactcctcactgagcatggagcccaatgcaggacttgatctcatcaccctgaggtcatgacctgagccgaaatcaagagtcagacacttaacgaaataagccacccagtcacccccaccatcatgaattctatgaacaaattagttgtaaccttcccttaagctgaattatggccaagtatctaatcctgcaaaaattcacaaacacagaacatttatttttgtactatgtatacatatttaggtcagattactgatcttatgaggaaaaataatctatttgctgaatgtatatgagagtagaaaagagttaagaaaatcaggaaatcagaattaaagagggaatgtcagaagactaagaattagcttagattctaaggaaaataaaatcagataccttctctttctgttctctgaacaagaattcaaaaagacccaaattatttatgaggtggaaaaaaaaaaaaactacccaaattttggacacaaatgaaaatgggaaatcagaataatgaaccgaaccagttaagcacaaacaacagcatctttgggctgtgagccatgattattccaaaccacaagaagcttctctcacctctggacaggctgctgctaaggccacaagcccagtggcagtctctgatgtaactgaaaaaccaaactagaaaaaggatcagcaaaatagagaaggttcttactagggctttccaacatcaactcgacaggaatcaaatgtggaagaccagaaagagaagtcaaaaaataagtacttgtgactatatgaagaaactgagaatttcatgaaacgagaaagatgactgcaggtaggcaacaggagatgggctgaagaaagctcagtatttttaaacctaaaaaataactcaaggaagatactatttaacatgttaagattggtggggtagtggaagaacttgtgaaaagtttcatcaaaaggagcaagttcacaccagcattcacccacttcttagagccctagtaagttcaagatcatttcttctctcttttttttcctggctatttattgatccattaattttattacttttagaactgatccttctaactagcatcagtagttatactttttccaaaaagaaagtaaagaacaagcattgggccatgaaaaggcaaggtggatgattttttttaagattttttttttttttttaaattcatgagagacagagaggtagaggcagacataagcagagagagaagcaggctccctctggggagcctgatatgggacttgatcccagaaccacaggatcacgacctgagccaaaggcagagagccacccaggcacccagcactagatttaaagggatgtaaccaccaaacacaacacatggtcttgaagtccttgattgaattcagactctttaaaaacacaaaagaaggttataaaagatacatttggggacaactaaggaaatttaaacatggactagataatttttactagtaaaaaatttttgtaaattatcttcatatcttagtatgtggttatttaagagaatgcctatttttaagagaagcatgctgaaatctttaaggatgaagagttgtgatgtctacaactttcaaatgattaaaaaaaagtttatacagagaaaacaaattatgacaaaaatgtttaccactgttgaatctaggtaaacactacaattcttcaaaattttctgtaggtttgaaaagtttatgataaaaaggccaatggaaaaaagagagagagaaggggagagaaggtatccttttgtcctgccactggaagataccaagaaaattcagtgaacagaattactgcaactatcttcagaacatgaagagatccagcaggagcctcagggtacctaatgaggatgtggctgatatacaaaaagtaaccatccagaaagagggaaaaactgttgtgtccttgaagatataaaccactaaattaaatctggcaactctagagccatgttacattgggtattcttgtcatcttgagataattaaactggctaattgtttaaaaaagcagattccaaggacacagaaaattcaacactggcattgtagaagtttagtatctaagtgcctttgactaataggtcataatcaaacgacttttccttttttaaaaaattgaggtgcgattagcatagcaaattaactactttaaagtatataattcgggggcatttagtattttcacaatgttgcacaaccactgcctctccagctccaaaactttttcatcacctaatacctattgagaacaccctatacccgttaagtaatcattactcattcctccttctccctattcccccctattccttggcaactattaatcttctctacaaatctgcctattatggataacttagataaagggaatcatacaatatgagaccctctgtgtctcgcttctttcacttacacaatgttttccagattcatctagaattgtagcatgttaatcagtatttcattccttttaatggctgaataatattccatgatatgtacacactacattttgtttatccatgcatctgttgacgggcatttcggttgtttctactttttgattatgagtaatgctgctatggacatttatatacactatctttgtgagtatatggcttcatttctttaagtatacacctataagtaaacctgctaggttatatggtaattcaatgcttaagtcttggatgaaccaccaaactgttttctatagttgcagaaccattttacttttccaccaacaatgtataagtgttcctatttctccacaaccttgctaacacttttctttttttccaattataattatcctaccaggtgcaaactgatatctgatggttttgatttgcatttccttaatgattaatgaccttaaacatttttttcttgtactttttggccatttgtatagcctcttcagagaaatgtctgctcaaatcctttgttcattttttgactaagctgcttactatcctgctgctaacctgtaagagttctctatatattctggacagtagaccttatcaaatagatgatttgcaaacaggctggtttttctttttcttaataataatgtccttgaggacactagtacctgggtggcttagtcagttaagcatctgactcttgatttcagctcaggtcatgatctcagggttgtgagattaagccctgcatctggcttcaggctcagcatggctctctctccttctgatctgctccctcccccgccagctcatgcacactctctcaaatagataaaatctttaaaaataataatattgtcctttgataaccaaaagctttaattttgatgaaatccaatttatctagtttttcttttgtgactcatgcttttgtcatcaaatccaaggtcatacagatttaacccttaaccctctctgcttctaaacagcttattttagcttttatatttaatatttttatttatttttgagggaaagcatacatgcacacaagcagggggaggggcagagggagaagcagactccccgctgagcaagaagcccaatgcaggattgatcccaggaccctgggatcatgacctgagctgaaggcagatgcttaaccactgagctacccagcttttatatttaaaccattgatccattttagttactttttatataggagtaaggtaggggttgaacttaattcttttgcctttggttatccagttgtcccagcaccacatgttgaagaaaatcaaacatttttaagagaaaaaaaagctggacaaactcttgggtatgggtggaatcctgctctatttaagatcatagctcttggtgacacttacaggacaagtccaatcaacagtgtgaagctcagatttgggaaatcaagtgggagaacaagttgagacatgcatggcacctcatcttaagtattgtaatccttatgctcaagatcaccctaaatggtatttcctgttcccaccagtttctaggactaaaggaagcaacaacatatatctaaggatcaaactacattataagcactaagtttttccctctctgcctatcagtatagaatatttactcatttattttttgacttattcatgattgtaggtactgaaaacataaagataaataagacaaagtatttgcaaagtctattaagaaagatttgggaacaattaatcacaattcagtgtgataaatgtcagaggagaaatataactaacaactatgaaagtacagaggaggaaatacctaattcaaactaaggcatcgagagaaagcttcatcagccaggtagtatcaaaactgatagactcattaatcacctagaggagaagtaaagaggcagttagatggagaatgtgcaaaggcacacagatgaagaaaaatcaccaataaagtcctgataagagactgaagtattgcaaaagtgacaaacccaaaatgtgtcacaaagttaaagtgaaatggggcttcctccatctcaggctgggaaacctagcagtcctgttgtaggtatagcaaaacagttggttacactccaaaggagctttggacaaaaaaaaagaaattgctcacagaagtttgtgctaacctcagtaaggttctgcaaaacaatccaatctgcaaaacacaatccagcccaatcctgcctactagagagctgtgacacataagacaagaatataacaattaagcaaagccctttctgctaaagccagagatccaaaacctctaatggtcaaataattactttgctgaatttcagcaactgaattctttgtgccactaagagactgagactctggataaatacaatgtagacagccccgttcagaacactgaggtgttctgaaagggttccccttaactgctataccctctcatcataaagtattttttaagattttatttattcatgagagacacagagagagaggtagaaacataggtggagggagaagcaggctctctgtagggagtctgatgtgggactcgatcccaggactccaggatcacgaactgagcagaaggcagatgctcaccactgagcaacccaagcgtgtcccccacctccccccatcataaagtattatctgacagaaatgcagctggggaggggggacaattattcagggctgactccacagaagacttgagaaaactctaaatccagaatttttcacctatgccctgaggtagaaagataagcaaaactaaggagaattaaacctggtcctagttattctcttcagcaatcttagagatgaaaaagcctaaatactactggagttggttatcaaagggaatgatccaatatgaaataggtgagcagtggactacagttttaaaggagtctatcagcaggaggctgtaattattatactcctggtcaaaccctaggtccaaaaggttgcatcttattggaaggggaaaaaagctaaaccagcatggccctcataaaaggaacaatcttccactctgtccttctatcccctgtgctcctctcaagggtggtcctgaagaatatcagacatggggaatcttctggggcaagccaggctaaagccttcaatcctctgccagtgaaatgagttaacaggggaccatgaaacttgctgattgtattatactgctcctgccctgtagaagacagtatatgctctgttttcttctgcttatataccccaggttgagaatagtgcctgacacacaaaaggtgcttaataaatgaaataaactagaaaccaaaatatagtatttttcctttctcctttttatctggtcttcctctcaagattatatactgggactatatgacagaggccagaggaatgacgagaaccaaaaaaatctatgagttaggggtgcctgggtagctcggcaggttaggataggcatctgcctttcagctcaggttgtgatcctgtggtcctgggactgagccccgcatccagctccctgctcagcagggagcctgcttctccctctccctctgcctgtgttgtctatctcaaataaataaatgaaatcttaaaaaaaaaaaatctatcagcccacaagctgcaggatcatgcaagtgtttatctggaccaatcaagaccaaactagggaaagcaaagctatcatcctgagaccttcagctggtgggatggggtacctttgaaggtaagtcaccatgtgatagctggacctgactaggtaggagtcatctcccattggggagggagatgagagaatctgtagctgttacttgtttagccaaatggcctcacttccacatatgactccttagggacagagtgaggtcactgcacagttaacagaagggtgagggcaccctggaatttggaaccgagagtttttcccatagtgtctgggctgcaaatgacacatctgggagcttctgacagtgatggttttcttcagcagagatagaagaccactgaaaacctacacagaacatacataaaaggaaacctgagggggtgcctggctggctcagtgttggaacatacaacccttgatctcagggatgtgagttcaagccccatgttggacgtggggcctaattttaaaaaagaaaaagaaaaagaaaaagagaaagaaacctaagatatttaaagtccagtttttcctaaagcccaaacacattccagtctttgggttctgtgtaacatagcgacatccttaaaatacctccccccactccaacacacacatctttagcattatctagtctgaagtgagtttgttacctgcaacataataggcccagatgaattcaaaattacatagtgtgtccagggatagaatctgtatgtaggggcaaagtgtctgttataagaggcagaagaggagctggaaagataaattaaaactcaattcaaatcctgtaatcccacatttgggtatatatatccaaaagaactgaaagtagagtctcaaagagatatgtacacatcaatgctgagagcattattcataacagctgaaaggtagaagcaacttaagtgtccatctgaacaggtgaatgggtgaataaaaatagtatatgcatacaatggagtgttattaagtcttaaaaaggaaaatcagtcacatgctaaaacatagatgaacttggattacaataagccataacaaaaaaacaagtactttatcattccactgatatgaggtatctagagtagtcaaattcatagaaacaaagtagaaggatgactaacaggggctgatgggaggggggagatggagaattactgtctaatgagtatagagtttcagttttacaagatgaaaaagttctgaaggttggttgtacaacatgcttaacactactgaactatatacttaaaaatgattactatggttatgttttgtcacaatttttaaaaatttaattagtatgaaaccattatgtttcattaagaaatttggacttctagggatacctgggtggctcagtcagttaagtgcctgcctttggctcagatcaggatcccagggttctgggatggagccccatgtcgggctctctgctcaacagggagtctgcttttccccctccctctgaatctcctcgccacctgtgctttctctgtctcaaaaaaataaataaaatcttaaaagaaaataaatttggagttctaaaagcaaaggagaaaagctaaaggtttaaaaaaaaacttcatggaaatataatttacatagtataaaattcacccatttcaactgtaaatataataattttctagtaaagttactgaattgtaaaaccatcaccatgttttagaacactttcatcaaccccaaaatgtcctactctctgtaacatgtaaaagttaaggtatgtgaattaaggctgctaatcagctgacctgaaaatggggcaattatcctggattatccaggggaactcaatgtagtcacttctctaagagaggactgagggaactggaagagagaaccagggtgatagccacatgaggacactcaaagcatgctggctttgaagatggaaaaatgagaccataagctgaggaacgcatgcggcctctggatgcggggaaaaggtaatgaaatggattctccagcaagaacacagctctgataacaccttaattttagcccagtaagacccattttggacttctgaacttcataattgtaaaataataaactgatatatttttaaaccactaagtttgtgataatatattacagtagcaaaaaactatgaatggctggctatttgtcttattattctttctcctttactatatatttgaaaatactcattaaagaaaaaaaactatgaatatgaaaggagactaaagaaagatcacaataaggtactgagtcatttctttcatcataactctgctttcaagaactcaactaaccattaaagatgtatatttagaaataactcccatttttctggcccccaatttaacagtcatgaatagttcctgaaaaggtaacaatcactagtttcagcgctaactgaaatttctgaagatacttaactagaacagcccagaggagacatgaaaatgtatgatatctgaaaagtcccagaatgacaaacaaaaatggtgattcaaagatagacaaagctatcttcataaacaaaacatctgtggtttattgttattcacgaaactttctttgggacataattttaagtagcagttatgaaatgatcaggtaaatctataagtaagtatggttttcaaaagcatgtttacctaacaggaaacttacaatacaccagcagtggtcaaatgtgtcttatcctgtagcctagtcagagagctaatactagaacttatggggtttttatttttaaaaaaaaggacaaagggcctagaggctaaattgtaaatattctattctcaaatctagttttgtttccacatacaaaagaaaatgcatgaactttgaagagaaatactacacatctttttatatacactattgattaaaatgctctatacctaagtgtcttgcctttgatatatttttttaagattttatttattcatgagacacacacacacatacagaggcagagacacaggcagagggagaagcagggtccatgcagggagcctgatatgggactcaatcctcggtctccaggatcatgccttgggctgaaggcggtgctaaagccttcacctgggctgcccaacctttgagatttcttaatggcatgctaccaaggccagcttcaaagccttttcagtttcatctcccctaatgaacaatgccaaccataccatctttggagataattcaaaagaagacctcggtatacctcatctccaaaaacacatactgaagacacatctaagagagaatctaaagcccttatgttatcaatcttactttttcccgtaagaacaaaaaggtacataaaccttgactaagttctgtgtaacatgataaacaaaaccaatgcaatgttatcatcactaccaaaaaatgctacatagcgttaatgccaactctactcttcaaccaacccatctccaaaactctatggctacatttggctactccctggtacatatgagataggtacctttaaaacgctatttacatacttacagctaggagactaaattaaatggaacttgtagaaatatgataaaggtagattttatgatagctcacaaacctgagaagacctttttcttttacacaataataaaatgacagtataaatatgtcagagattgctgccatttttcagtaactaatcacagagaacaagaaagtaagacaacatttaaagacaatttcctgggcagcccgggtggctcagcagtttagagctgcctccagcccaggctgtgatcctggagacctgggatcaagtcccatgtcaggctccctgcatggagcctgcttctccctctgcctgtgtctctgcctctctcatgaataaataaaatctttaaaaaaataaataaataaagacaatttcctttaaaagtcctaggacactggcaaacaatctcacatattctattaatatttcaatgttctgggcaactagctacaaatgacaagtagtcaagtctagacagctcatccaaatatggcatttcttatacattacgaaagaaaagtatttttaaaaatagctacttacatgacactgcatacttgctaccagttagactgttatcaaaaatagtcataaaatgatgaaagaagaaagaaagaaagaaagaaagaaagaaagaaagaagagagaaagaaagaaaaagaaaaaagaaaagaaaacaaaacaaaacaaaacaaaacaaaaccaggggaaagaaatcgacctgattggtttacaaagaaaaagtaataaaaacagaaaaaaatctttctgtagctttttctgattctttctaaaaaaagagtggtctctcaaagagagaaaagcaagcaaacacaccaaaataataacacagtacaggagtttatgtatttctggctttacaaaaatcaaggagatctgtctctctgcagcaccttttctttggatcctctgtggctgatggcaaagcaaatacacttctttccacactattaacacacactaaaaaacaaccaaaaattttgttcattcagcataaaatccttcacgactctatttttctaagttccacttaaaaatcagcagtatcaggatccctgggtggcacagcggtttggcgcctgcctttggcccagggcgcaatcctggagacccgggatcgaatcccacatcgggtgcacccacctggtgcatggagcctgcttctccctctgcctgtgtctctgcctctctctctctctctctgtgtgactatcataaataaataaaaatttttaaaaaatcagcaatatctttacaaaagatttgccaactaataaatcaagtaacaaaagaattagaaatttacctttttgcaacccactcaggcaataaactcagggcaaggatcatcaatggatactaatacacctgggagggcagccctggtggctcagcggtttagtgcctgccttcagcccaaggcctgatcctggagacccaggattgagtcccgtttcgggctccctgcgtggagcctgcttctccctctgcctgtgtctctgcctctctctctctctctctctctctctctgtgtgtctatcatgaataaataaaatcttaaaaaaaaaatacacctgggagaaagattgatggggaaaaggatattttctgtcaaagactacttattaattacaaaggaaaaaaaaaagaaaaaattacaaaggaaaaaaaaagaggtagatgtgggactcgatcccaggactccggaatcacatcctgagccaaaggcagatgctcaaccgctgagccacccaggagtccctcatgcattatttctaacaacaacaacaaaagtgtttgacctgaacctaattgtgaggaaacaatcagactaatcaagacaggacaaatggaatcttaaaaatttttaatgtcataaaacatccaaacgacaaaggtgacggatacattttctaggttgatggcaactaaagagacatgacaaccaaatataacatgagatgtttgagaagatcctggatttaaacaaaaacacaaagtaaacacattataaataaagagtatttggggaataggaaaatctacatatggcatatatattggattaatactacagtttcctcactaaattcctagagaatgacaataatattgcagcaatgtaatgatgtcactgttcttaacagatatttgctgaagggccaagggttgaaataccatgctatctgcagtttatctcaaatgattcaagagatacagagagaattctcatatattgctggtgggaatgtaaatggttacatttcgaaagagactggcagtttcataaaaagttaaatacaaaatagcaatccattcctaagtatctactcaaaagaaattaaaacctacatccacacaaagtcttcctagagaatgttcacagcaattttattcatacagccaaaaatagaaacaatccaaatgtccatcaactggtaaatgaataaacaaaatgctacatatctatacaatggaatactgctcagaaataaaaatgaaatactgatacataaagggatgcctcacaagcattatgctaagtaagaaaagccagatacaaaagatcacatattatatgattctactgatataaaagtgaagaaagaaggaacccctgagtggctcagtggttgagcgtccgcctggctcaaggcatgatcctgggagtcctggaatcaagtcccaaatagggctccctgcagggagcctgcttctccctttgcctgtgtctctgcttctctctctctcattaataaataaaatgtttaaaaaaaaaaaaaagtggagaaaaacactacttagagacagaaaaaagatcagtggctgcctgaggttggggggtagtaatgagaattaacagtaaataggcaggggtacccagctcagttggtggaacttgtgacttttgatcttgggcttgtgagttccagccccatgttgggtatagagattactcaaaaataaaattcttggggatctctgggtggcgcagtggtttggcgcctgcctttggcccagggcacgatcctggagacccgggatcgaatcccacgtcaggctcccggtgcatggagccagcttctccctctgcctgtgtctctgcctctctctctctctgtgtgtgtgactatcataaataaataaaaaataaataaaataaaataaaataaaataaaataaaataaaataaaataaaataaaattctttaagattttatttatttgacagggagagaggcaacaaaagcaaggggagtggggaaagggagaagcagactccacaccaagcagagagtctgatgcagggctcaatcccagtatcccaggatcatgacccatgctgaaggcagctgcttaaccaactgagccaccaggagtccctaaaattaaaattttaaagaaaaaaaaaaaaaaacaaaaacagaaaacagacaaaactcttactggagtgatgaaagtattattcaactggattatactgatagttgctcaattcttactaaaaatcattcaattattaaatgggttatttatagtatgtaaattatgcttcagtaaaggtatataaaaataaaacaagtgtggtaaaatggtgattatataggtattcattgtgctagtctttcaacttttctacaattttgaaattcttcaaaataaaaagttaagggttagattagaatgaattctgcaaaacacacacactcaaaatttagtgtttgtaactgcagattacctaaaggaagtaaaggacatgtgtaccacaactgtgataaatttaggattaaagtatttaactgtgtaaaaaagaacacagtatgttgaaatctagggccaatttttatccaaggatttgattaataatttttctcaacttaggtgttcttttttcctaattacacaagtaatgcatatttattgtagaaattaaagtgaaaaggaaagatttagaattaaagtataaaaaagaaaataaaagctaactataatctcatagccaaagataactattaataatttgttcctcagctttcaggtgtaacagttccatttcagcaaaagcaagctatctatatatgacatcatcacaacttgatcaattggcatgctgaaattttatatcgcacccaatcacataaatcataataagaatgaaaaggcaaaataaaaaaatttagatggaaatccaatgcttcctttcagttttcaattaaaaaaatgcatacactgggacgcctgggtggcttagcggtttgagcatctgcctttggctctgggcatgatcccagagttccaggatcaagtcccacatcgggctggctccctatagggagcctccttctccctctgcctatgtctctgtctctctctctcatgaataaagaaataaaatctttaaaaaattaatgcatgtactagcctcaggtctccccccaaacccttctaaaatacagatatgatgctgcagattgtaacaatgtacatttgtaacccccaaaattcacatattgaaacctaacccccaatgtgacagttttaggaggtggagcctttggggatgattaggtcatatgggtggagccctcataaatgagataagagagctccctcaccccctccaccatgtgggatttcaataagaagtcagccatctatgaaccaggatcaggccctcactagacatcaaatatgctggcaccttgatctgggacttccaagcctctagatcttgtgagaaataaatttctgggctttataaaccacacagtctatgatgttgttacagcagcccgaacaaactaagacaaatcagagaaaaagtcataaattcacaaggacaaaatgaacaagtgaggaagctatatttggggccctggaaggtagacagacaagtggtaaatgacttagccaacctgagaaagctgaatcctcctcagccagcagtggggaaaagtagagaagcaacaacccgacttaaaatgaagattcccaataggttcaggaattaacagcaccggtaccctacaagtgaaggtgaagatatggataaaaacaggagagattatgcatttacctaaacccaacaggtagacctgtctaaacactgtgtatgcagcctggtgaatgcctcaccctggaggaaacgggtgggttttttttaagctctcacttaacaaaaactatgttcaggtccaacagcttccaattcactttctgtgtccgatttttaaatagaagtagataaacaaaaacaagcaaatacttaaggtaaagaagacatcgaatgtgaaagaaaaagactataacaagcacacagaaatggaaacttgaagaaacaacactgagatctcccagaaaacagcaacaaaacaaaaaccgtcagaagctgaaaagagaaaagatagagagacaaccagaccagaaggtccaatctaaaaatagaagatctaagaaaagagaacacagaaaacgaaaagaagaaaattaaaggattaactcaagaaatctcccaagaacaagaggaggacagtttccagattgaaagggctccctaaagctgagcacaggtaagaaaatacatgttgaaatgtatcaccatcaaacttcaggacaccaggacacagcaaagttaccaaaagcttccagagagggaaaagacaggattcatacaaagaacaaagaatcagaacagcatcacatttcaacgtttctactgagaaacagaagataaaggaacaatgccttcaaaattctgagaaaaatatttccaaccttaaaattgctacctaaccaaaactgggataccaactaagcatcagagtaaaatatagtttcagaatataaaagtctcaaattttatctcctctacattctcaggaaatttttaaaaatggggtccaggaaacaaggtttccaacaaagggtggggagtaggagtgtgaaagaaatccccggggtacccaagatgttaagagctgcgtagcacacccagagctcaatcagtccagatcagagtatgtcaaattctctacaagaaacttcaaaaaggtaaaacaaatataacagtttgaacttaccaagggattcatagttggcaaggactttgagggtaacttaggaaaaaaatacctaagagactaagcaaaccaaaaatcaacacatttattatccttggggtagcaaaagattgtacaggaaaggaaaatgaatcttaagtatactaataaactcaagtgtcaataagcatttaaacaattaaaacaatacaaaactggggatccctgggtggcgcagcggtttggcgcctgcctttggcccagggcgcgatcctggagacccgggatcgaatcccacatcgggctctcggtgcatggagcctgcttctccctctgcctgtgtctctgcctctctctctctctctctgtgtgactatcataaataaataaaaattaaaaaaaaaaaaaatacaaaactgaagactgacttaaccaaattacaaatgataacgataggagaatgggagatagggtgactgacatcaaaaatttccatgtgccaggcacagctatcttttgtctaatcatcagataaaaacagatattgtccttatatgtgaggaaaccaaagcacagacagggtaataatttgccaaaagtcacacaaatagtaagtagcagaagaactttgaacttttttgctcttcaccatcacattggctatcaaagaatgaaatctccatctcccagcgggaaatcaacaggtaatggttaaaactggaaaaaaaaaaaaaaaatcagtagagaggtaaaaatctcaaaatcagtcaaaagaactgtttgttttggggagtgaaagaaggaaaaaggggtctagaattcttgttcttaatccctgtagaactactttactcttgaaaactgtgcatttataacttggataaagtgaaaattaaatttttaagtaaaccttaaaactctttttcaaccctagaaaactggacataaacactaatatgacagaagaaaaagtgaaaaaataagaccaaaaatataaataagtatttgatacatgataaagatagcatttcaaatctttggggggacgagggtgtggatatgaatttctcaaaaaagtaggggaaaataaccaattatctgaaaaatatattagatattgatctcccaccacactgccaaatatatttcaactatataaaagatttatatgtaaattttgaaatcataaagaaaacagaagtgagtaataattaatattaacaattatgaggggaaaagatttctaagcatgaaaccaaaagcagaaatcaaaaaaggctgctggtttcagcttcataaaaattcacaaaaaaagtaccacagagtaaaaaaaaaaaaaattataaaccaagttaaaagacaaactagaggaaaagcaagtatttaataagaggctaatttccttaatatgcaaacaagtcaacaagagaaaaaaataacaatccaattaaggtagacaagaaaacactagtaagtcatagaaaagcacaaaaggcctcaataaatctgggggaaaatacaaatagccaataaagatatggaaagatgtcctacctcgttcataattaaaggaatacaaaataaaatgaatacacctttaacccatcagatcagcaacaatgtaaatataaagatcattcttgggttgaaaaaagtgtgtggcaaacaagcactcttgtacactgacagtaaaaatgaaatgtcacaatatttttgaagtgaatttgatattacctatcaaaatttaaattgcccatacacccagccccagtaattacacttctagaactgtacccataccagggtagctttttaaagcaaatacgtataccctagctgtccatcaacaaggaactatttaaataaaatatcatcagccacaatgaaaaaaataccatgcatccattaaaataaatgatgtcttcagcattattttgacgtgaagctaatctaagaacagtatgtatagtatgactccatttgcatgtgtatgcgtattttcaagcatggggtaggagataagacctctatgcaagtgatggtgcatctacagatcatgatctctgtcggaaaaactcttgacaagtgaagtagatgatagatctgaaatgacctggcctaaagtccacacttaacatatcaaagttttttttttttttaagattttatttatttattcctgagagacacacacacacagagaggcagagacacaggcagagggagaagcaggctccatgcagggagcctgacgtgggactcaatcccaggtctccaggatcatgccctgggctgaaggcagggctaaaccgctgagccactcaggctgccctcaaagtttgttttaaagtgccgtggaggagaaaaatttcccaagacctaacatataagacttaaagactactatcacgaacactgacttttaactgtctatacagaagacagttctttttcagaaagaaagaaaaaaaactgtaggaggaaggatttaaatctgtgtgtagaatggaggagatatagctataatcttcattagcatacatatggactctgtgaccactatgatcaaatacaggcctacaaaggtacatagcgtctctgaagaaacagaataacggccacttctggagagtcagtcaagggagacaaaacacaaggatttacatactaacttttcacaaaaaacgtgtattggttttataattatctaaataaaactttaagttaaaaaacaagacacaaaaaacatgtgtaacatataacttacaaataccaatttttaaaatgacaaaaaataaaaaataaaataaaatataataaaatgacaaagataccaaaaagagaggacatttacaggtattaaaactatgtagaacaacatctggaaagatacacaggagactgatagtaggtaccatctctgacagagacataaaatctagaatcaaaggaagacttacctttcattgaaataactttggtactgtttgaatatttttttaacaataatgattatttttttatgtatctagactattcatcagtaaaacagaatagaatgaatttccataaaagatccatgctataacacagataaacctcgaaaacattatgctcaggaaaagaagccagccacaaaggccacatactgcacatttaaatggtggttagctggtgctgaaggcaacaggactgaccacaaattggcataaacctcactggagtgacagaaatgttctaaaactgggggtgcctgggtggctcagttagttggttaagggattgactaattaattaattaattttggctcaggtcaggatctcaggattgtgcgatccctgcgctaggggtggagcttgcttaagattctccttccttccctcccagcttcagcagtgccccctacccccaccccccagggctctctgagggggggggagggagtaaaatactgtccttctggtgagaaaaaatgaagaaaaaaaaaagacaaaaagattaatgactgtgaaatcagaatgatgggtactcaggcttcattacacttttttttttttcaaattaaaaatgtaagtctattaaaaaatagccaatgtacacacataaaacttaagatctcaccaagcaaacaaagaaatgcaaattaggggcccctgagtggctcagtcagttaagctgttaagtgtctgccttccctaaatcatgatcccaggggtccttgaattgagccccaaattgaggtccctgctcagtgggaagcctgtttctcctgctccctctgcctctccccctgcttctgcatgctgtcagataaataaaatctttaaactatatacctctctcacgtacaaatatctacatatgcatacttgtgaacacaaactgacaactgagtagtattgtcaagtggctttatttctttattgtcttccttcaacatttctgaatttgttggttttcagtattactacttttgtagtcaggggggaaaaattccactttccaaaaagcatacttcgttacaaaaaaaaaaaaaaaaggacagggcagcccaggtggctcagcagttcagcgccgccttcggcccagggtgtgatcctggagacccgggacagggtcccacatccggctccctgcagggagcctgcttctctctcagcctgtgtctctctctctctgcctctctctctctctgtctcttatgaataaataaaatcttttttaaaaaaatggacaaaggccatgttcagccaattcataaaaaaatacaatggatatttaggacataaaagtactcatcagaaatgacaaaatacaaattaaaacaagtctcattttttttaatctaccaagctgaaaaaaaattttaattgtaatattctgcattgatgaggtattattactcacacagtagtggtggaaatacaaattagcctgacctttatgagatagagaatttggcaattaaatattaagagcactaaaagccatgtttatctttagctcggcaacctaattctaggaaaaaattccttttttttttttttttttttttttaggaaaaaattctaaggaaataattaagaatgccaagcaaagacttacctacaaggatattcaatactgaggctatagtgacaaaaaattaaaaaccctgatatccaatgaaaaaggattattaaattattttatatccatgtaacagaatactatgaagcctttaaaagtgtagaatcgtatttattaaaaactaagaacagccataagagattttaagtgaaagcagattacaaatagtgtgtgtagcagatgaagagtatccaccaaaattctcatctactcagaacctcagaaagtggtcttatttggaaagagtctgcagtttagaagagatcaggttaggctgggcccaaaatccaactgcctagtgtctttttggggagggagaaatctggagacacatacacaaggaagaaggccacgtgattactgaggcagagatcagagtgaaaacagctacaaacctagagaaccccaagaaatgtcatcagaagctaaaagataagggaggattcttctctaaaaccttagagggaacacagccatactgatgccctgacttcaacttctagcctccccagaactgtaagaacataactttttgttttaagccaccctatttgtgataatttgttatggcagccctagcaacgtccctagtgtataaaacagcaatcgggtgcacactgcttaaatctgaatcatacttctaccactattatccatgtaactttaggcaaattatttaaccttactgaatctcttttccttttcgtaaaatgaggataatgttacttacttcctaaaattattgtgaacattaaattatagagtaaacaattacttggaaaggtatctggaatatagtaaatattccacttttgtaaaacatacaggtacacacacatactgtagtatgagaaaaatagagatgaaaaggttaaaattatttatctctggctcctgtgagtatggcttatttctgctccctttttgctgactggcactttctagcttatctgcaatgatttatgtaacaataaaactttatatcataataaaatagttattttttaatttaaaatttttaaaggcagttggtttccagttgtagttatatgcaaaacccaccctgcagccagtgatctccattttcccaaaccctattatcaaagtattacaaaaaattaaaaagtaaaatttactatagaacagaaatgcgggggtgccagggtggctcactccattaagtgtctgcctttggctcagatcatgatcccaaggtgtggggatcaagccccatattaggctccctgctgagcagggagtctgcctctccctctccctctgcttgtgctccattgaaagaaaggaaagggaaagaaaagggaaaggggaagggaggggaggggaggggaggggaggaaagaggccaaagcaaaggaaaggaaagctaaccagaaagcactttagaaagcacactgtgtatcattcaatggagtagtaggctgttgctccataataggctgtgaatcactgacctcaagcacaataattcaagtgtgaacctttggaaacacttcacagagccaaggctcaaacataagaaaacaccactgttcattttttaaagtgagtcttttaaaatccagtacatagtaatttcagtgggcctgagttccatatttggaataaattgttccctcccaagacatatattaactttggcaaatcattagaaaaccactcacaaaatcaattacgcttacaagtgaaaaatgtattagtttcatctgcacaaggcaacttaataataagagctaaacctcttctgtgagtttcagtcttgtgttttaggttcctaaaaagtttaactcataaaatgtgttccctgacaatctctcataagcaaattcagatgaactcactagttaacacattttgctcttaacatagcaaaagaactttttaataattatatgtaattactggatgagaggctgttgctcaatacagtgaagaaattctactgtacttgaagagatcaaatctacctctgcacttttagaaaagtatgtatctatttgatcatcccatccaagtatcatgacaactaattcagttcaagggctgtggtatccattatactggataggaagaacaattattcaaattgcaataccactgctgttaaaatacatatatgcacacacacttctctaagtatatatgtgtatatatatgcatgcaaaattctaaaggcatagaaattttctaaaaggtacagaaaaaaacagacagtagttgctatatgtggaaaggaaaggggacttctgcttctcacttttagcccagagtttgcaaattagtggcccaaggaccacatcctacctatagatgtgctttatttggcccatacagtgttttaaaaatatttgaattagttgccaacatttgaaaatcaggaaattttccataaaactctgatttactggcttctcttgaaaaaatggaaaaatctaagaacactaggacgccattccatcctggtaatatttgaattaagggaagtaaccttcttaaaaaagacaagtactttctagcgcttgtttctttccaacacttcaactgttcagattcgcctcctgacatctatagacattttagtttgcaacccctgtgaaggcctttctaaactacttgaacttactatgtgcttatattactttttaaattttttcctcaatgaaatacagaaaaactttagagaccccacaaaatatttttctccattcacatctaaataaatgttacctaatattcagttcaaggaaatatgcctgaaaaggtaggtatataaggtgggccaatatttagagggctcaaattgcttccagatacaatattcttgctgtttaattttaatttctttcacgtcatgtttggaatatatactggcaacatttaaatcttatggcaaatgaaatccacaaagaaaaaaaagccttaaaaagagcctagattatagaacttatttcttcaagatttctataaaaacgaagtctttactccatttacctaaacagcttacttcaaatatttactgagcaccaaatatataccattcatggcagcagatgttctgggagaaccaaaaactattagggtgtattttcctctcctgcgtacgtatcatatgtgatcaatgatattaaaaaggcaagagtggagtttagagaagacagcactactacagtgattagtgtcccaatttcaaaaaaaaaaaaaaaaaaggatctcatgaggcataagaaaaggaaagaacattctaggtagaagaaaaagtttaaaattgggaaaacaaaagtaggtgtggaaaatgaccaacaaatcagtttgaatggaacagagagaaagaagatatccagaataaagatataccagaaaggtttttgttgggggcacctggctggctcagtcagttgtctgtctttggcttatgtcataatctcagggttctcaggctgcctgctcagttgagagcctgcttctcctgctcctagtgctcccccccccaacttatgcatgtgcacactccctctgcctcaaataaataaataaaatcttaaaaaaaaaaaaaagaaaagaaaagatacgccagaaatgtagagatagataaaccaggaccaatctttggagggccctgaatgtcaagctctgttctttttctagtattcaacaagggcattgttaaaggtttttaagaagaaaaaaaatgcaccaaaataaagctgtgatttaaaagattaatctgggtgggtggagggacagggtaactgagtgacaggcattaaggaaggcatgtgatgtgatgagcactggatatatgttggcaaattgaatttaaatttaaaaaaaaaaaaaaaaggacgcctggatggcttagcagttgagcgtctgcctttgactccggtcgtgatcccggagtcctgggatcgagtccgacattgggcttccagcatggagcctgcttctccctctgcctgtctctgcctctttttctctcatgaataaataaataaaaatcttattaaaaaaagaaagatagatttatctggtagtggtgtgtccattaaatggattagaaggaagagcgccaggtgtagaaagccaatttggagagtgttcctgttaaggttgtggcaaggggaatggaaaaaagagttgggaagtgcactgcagagtggaaacgaatggggtttggcaaatgatttgaggtctccaggaacaagagggcattggatagaattcagttcgagcctaatgtctggaagaccaatggagctattaacagaaaagggaaaaatcagaatgaaaagcgggctagtaggatggggaaaaggatagattgactttttaaaaacacatttagttttgccaacaatataacatccataacatattccaccatgagaaaaccttgcacccttttctggcccaatttttaggtttagccaaagagagtatatatcctatacaagtaaaggatatatttaatacagagtcaatgagaagccagtcacagagcatattaagctaaattaaaattaagctacaaggcagcccaggtggctcagcagtttagcgccacctttggtctggggcatgatcctggagtcccgggatcaagctctccctgcatggagcctgcttctccctctgcttgtgtctctgcctctctctctctctctctctctgaataaatcttttataaaaacaaaacaaaattaagctacaataggattaagttggactcctacctcactttctatacaaaaattaactcaaaataggtcagtcatctaaatataaaacatgagggaaccctgggtggcgcagtggtttagcgcctgcctttggcccagggcgcgatcctggagacccgggatcgagtcccacgtcgggctcccggtgcatggagcctgcttctccctctgcctgtgtttctgcctctctctgtgtgtgtgggtgactatcataaaaaaaaaaaaaaaaaaaaaaaaaaaatttaaatataaaacatgaaatcttaaaactctaagaaaaaacatagagataaatcttcatgaccttgggattagcaatagattattatatccaatgcaaaaagcacaagcaacaacaaaaaaattagataaactagatggcatccaaaataaaaacatgtgcattgaaggatgttatcaagaaaatgaaaagacaacctatagaatgggagacaatacttgcaaatcacatatctgataagggtctagtatacagaacatataaagaactcttacaactgaacaaaaaagacaacccaaattaaaaaaaaaaaaacaaaaggacttgaaaaaacacttctccaaggaagtatacaaatggctaaaaaacatactaaaaggcattcagtatcattagtaatcagagcaatagaaataaaaattgcaatgaggttccacttcatactcatatgaatagctataatttaataaaggataatagtggttggtaaggttatggagaaactgggacagacctttgttcattgctgggggatataaaataattcaattgctatggaaaatacttcgatggttcctcaaaaagttaaacatagaattaccgttaagacccagcaattcaattcctaagtatttaaccaaaagaagtaaaaacaggtactcaaatatgtgtacatgcattctcatacagcactattcacaatagccagaagctggaagtggcttgaacatccatcaacagatgaatggataaattgtggtatcagcatacattgaaatattatttagccacaaaaagtaatgaaatactgatacatgctatacaatatggatgaacctttagaagacattagacacaaaaggactaatattgtatggctcccttcatatgaaatatccagaataggtacacatccatagataaagacttcagattgatggttgtcaaggcaaaggaagaaaatggtgacccgggtgattgccagagcttgggtttccagggaatgaggagcaactgctttgacaggtgtagggtttccttttggggtgttgaaaatgttttggctacaaagaagtggtagctaccacattgtgaatgtggtaaatgccactgaattgttcactttgtcatggtttgatttcatgttatgttgatttcatctcaatttttaaaaaatcaacaatatttcaaacaaaaaataaaaataaatccatgtcttgtcattcctgagtccattaaccaaccacattttacccaagccaagctcctagatggctctgctccacttgctccttcctggtttcactcaggaaatagactttacctacaatatactgcttttccatcaattcaaatccactaattatttcaaaacttctaagaacacaacttgcctatggcagccattcaatctttgtgaatcactggttgtatttgattcagtccattcctacctgtctgaaattttatacagttaattcggtattgatatatgaatgtttctgcattatcctgaaaattttctctgatcatttcagacatgttcttttcctactagagcacaaattataatagtagctgtcttctgctttttgtattacactgtctgctaaggatctatccgaaatacattcatttaaatactatctggttgatagtttttgctgttatgtgctacacaaattttgtgtggaaggagtgggaagataagatatggtaaagaaaccacttccacccaccctagctataatggagattagttttgacttcatctatgatcaggaatacaagtcccacagcaataccgtttgtaaagacttcctgtaaggcaacaatgtatgttttactgtgctccttttaaaactaaaatgaatctaaatgctctatttgtaaacttgtttatatcatacccagagtcccactttgtatgtgtcactcaaaaaaggtaagaacaaagtagaagagaagaactccaaagcaagaactcccaatctccttgaaaatgtcatagagtgtaggacactggggtggctcagtctgttgagaatccgactcgatttcggctcaggtcatgatctcagatcagggtcatggtcttagggttgtgagatctagtgagtggggcttgtgctcagcagggaatctgcttgagattctctctctccttttccctctgcccctctcccactttaaataaataaatattttttaaaaaggtcatagaatgttatgcaatccttccctaccctcttcctaaaattgctgcttggcacaaattattttcaagaaacccagtattaatatcatggtttatctgttataaagggacttttcctagactcatgcatataaaccagagaatggatcagaaactcatttaccatgcaggtgactgagaaatggattaagatcaggcaggagaggtactgtgaaataagaggtacaactgagggcagccccggtggcgcagcggtttggcgccgcctgcagcctggggtgtgatcctggagaccccgggatcgagtcccacatcgggcttcctgcatggagcctgcttctccctctccctgtgtctctgcctctctctctgtgtctatgaataaataaataaaatctttaaaaaaaaaaaaaaaagaggtacaactgattttcatgtctagattctgattttccttcactgtgtcagttatacctttattttattcagttgggtgcctctgacaatgttgacaaagtcaacaggacaagactgataaaaacattttcctccaagttacttttctagaaaacatctgttccatccatgatgggcatatgtaatgttccaaaaaatacaaaatacttcctgaagatacctgcagataacctaggatgttgcaacaccacaactgcaaagcactagccaaatgaacagtcaatacaggctatatgctagtcaaaattattgtatttatacctgtaactcctaagttaatgtcctctaaaaacctagaagtattaaaaaataaaataaaatctaggggatctggttagctcagttagtagagcatgcaactctcaatctcgaggtcttgagttcaagctccaagatgcgcatggagcctactttaataaaaaataaaaataaaatctaaaagtgttatttgccacttgtcacaaatgctaaagaactcactttaaaaacacgagacaaaagattttgaaggccagaagtgaatttaaaatcttatgtaacgttaaactgtacacttaaataaaatggcttacgttaaatttttatgctggtttccccttaaaacaaaaaatgtattagactacattaaaggatgagaaaccactaaattgaatgtgcttaaattataaaaggttaaaaagctttagtgatttgattaacagaaactttctgacctcttaaggaagatgtttattagatattctccatctccaaggagggtataagcaatgaaaaagtctaaactgtagtaagagagatttagttttgacaaaattctaactagaaaagtaattaaacacaataataaggtatcatgcaaatctctgccctcagggatgtaagaataagcgatcttggaagtattatactcaattcttcaggaaaaactgaaatgaactagaggatctcttaagcagcttccagttttagaattccagattctatactcaaagcccagtagtatctctctgcaagacattatacctacagaaagttttttttttttttttcctacagaaagttatactaatctataagccattccagttggcttcagatattgggtcttttcacaccatttattcattttatgtactcacttaggaactgaaaattgactactttttttaagaggcagttctatcaattctccagcagcatggctgccaactcaggtttatcactacaaaaaaatgcttacattgaaacatacttggttccaaattaaacaaataaatatatctacatactgcacaaggaacaactagaaaaaaaaattctagggtagataatttacaaagccaaaacattcaatttagttcaacagcttcttaaaaagttgtttgttactgaaaacaaaaaatacttttgaaaacagaagcatagtctttccaacttgagtttcattttagaaaacttatggcctacattttaaaataatttttaacttaccatattattttctaacagttatcaaacaactaaatgatggttatttattaaaatgcacagcaggcacttatgaagtcacagtaaagttaatcatctcaaattcaacaggttaatcacaacaatttgagagagattttgctaacctgtattaggattatctcaacagtttacaaaactggatattaaacgatacttaaaaataataagtatctagatcatatatttcttttttttaaagattttatttatttattcatgagaagcagagagaaaggcagagacataggcagaggaagaagcaggctccctgtggggagcctgatgcgggacttgatcccaggaccccagtatcaccccctgaaccaaaggcagaggctcaacccactgagccacctagttgcccctagactatgtaacacacaaatgttttgaccaagtacaaatgtacaatttcatttattttaactagatcttattaattataatgaatatttgtttaaaacaaaaatctaagaagacaaatttagccaggtcaaaatagcaatcaaaatacaatactgcagctaactactttcattagaaagaaaagaataccaagcctcctttcagttcagaaatagtttttcattttataatcaaagacaaaaaatatgacttctacagccaaaaaataaggtaatgtagcttatagctgagttatcacttaattgcctggatttctaagaagctactaacttctaaccactttaaaacctgatatgactttacagccaaaaaataaggtagtgtagcttaaagctgagttatcacttaattgcctggatttctaagaagctactaacttctaactactttaaaacctgaatccatcttttaatggctcattgctttgttcagaagtgtatcgcaccttgttccccccctccctttttttaagattttatttatttattaatgagagagagagatagagacaggcatagacataggcagagggagaaacaggctccacgcaggaagcccgatgtgggacccaatcacagaactacgggatcacaccctgagccaaaggcagccactcaaccactgagccacccaggcgtccctatcacaccttgtttcttacagatgtcatctcattagaatacatggtgtctttgagcttaataattttttatttaaaaatccaagtaaaatttttataaggcaactataatttttaagttattttttttcttatccacactgggcctcatctttcacaacacctaaaaacaatcttagatgttaaacacacacacctcaaacatataaaattcattacactggttctgtagccataataattatactaataaatactgactctaaagaactaaaaacttataagggcagggtttcagtggtacaactcaaaaagcagtggggagaaataatgatcctcccctaccaaactggtagcaacaatatgccatttcctatgctaaagtagtataaacaaggaagaaaaagagctggaggtacagaagtaggtagataagagaaccctcatcaagatacagctttacttccaaatttcactagtgtaatacttgttctcaatgttttcaataacctctaccacggactatttaaacaccataggttggtgttcagaaaactactagaagctgtaagtccctctcttagataatcccagacataaaagatagaagtggggatcacaaatgcttcttcaattataaagactttctcctgcattcaatgcctcaaaaagttttctaaaatctaaaaaactccactcttgctacaacaatcaagtttaaaggtaaaataacaagacctaccaatgatgcaacaatgaaaaaaaattcacacaccactcttggtgtgaccacagctacaagtaagatgagcatcattccagaaaggactagaagaagaatgagataaagaggaggcttacagcctcttttttttttttttttttctggcattgcctgaggcattcagtggacatggaataaagggaaagctggttgtataagtgatgccaagagaaacaagattccacatgtcaggggactgaatgcccaaacacagagagcaaagggcactcatcccatggctttctgaccaaagaaaaatgagttgtttcacctgaaatcctttcaaagtaagtctgatggtctctacttcatcactcaccctaagtgaactccacaaccccttctcctagaacaaggagaagccctgcttatcaaaaatagcaagtgctacattcaaagccaagaaacactcctttagtctaagtgccatggtcttctgccttaattctacaaggagacaccaagccaaaaaactggttcccagcctaagccaagctctccattttcccaaacatcccaaataactcagctttatttcagataagcccctccccactctgacatcctggggtccagggctccagtcccctcagaaagttccctcgtccaagatgatctcctttccttcacctttcctaaggctttcccggacccagccccaggtccagcacttttctggccttccgttagtagatctactagcataccccccccactcctctctggcacaactcttcaggaaagtcatctctcttaccgtactcacttgtcctcccccataatattgttttcctttttccctatcattcctcgaatggagaaacccaaacaaacacgcacacgcacgcacacacaatatgtgttctcagctcccaactcccaagtctctcccgtgccccaggttcttccattaacaccgaattatctcccggagttcccccttatcccggtcttcctcgaccctaactccatactcccagcttttttcccactccccaaattcctatttcctattctgcttactcttaaccaacaccacagccctcttgcgctcaggtctactcctgtgcctccgtactcaagtctctcccgacgttcctcggcccctaattctccgcagaacctcaggagcccctccccaacctcccctccgcccctcctgcacccgtggccccccactcccctcgaacgtcctctctagccttgctcagccccccaatttctccccagtccccgaggcaccccacacgccgtccacgccctgggaagggggtgcccctcagtgcccgcccggcccgccctaccgccgagctcgggtgtcccttcccttccccgcgggccccagtgctggcgcggcggggccggctcaccagttggtcatgtccaggaagaaggcgcagccggccgggttgagctggaagccgaggagccgctggaactcggagatgagcacgtccttgtcggtggtgcccaagcagctgaacttctgcatcagctcggggtccaggtccacgtccatgccctccatggctggggccggacacccgcctccccgcctcctcgcaacctagccgccgccgccgccgccgccgccgccgccgcgccgccgggcccggggacagggagggggcccgctgctagcaggcgccgcgaccccgctcctttgaggtaggccccgggcctctcaccgcctcatagggataaactcattcagccattcactcacattctcgctcccccccgtcccaccccccccagagccgccgcctccgccgccgccgcctctcgcttcgccgccgcctccgcctcctcccgcgccgcgcccactgcgcaagcgccgcccgccttgccccgccccttcctctccaggggccccgcccctcggcggcgtcacaaccccgtgacgtcccccgcgtgacctcaccgcggtggagcgacggagcggggagtgggaaggaggagagggaccgccccgcggctgggggtgactcctggtctgaccttctgctcgccccacccccaccctcaaggggaggagttagagctcggggtttggggagaatctcggggatgtcggtctgcggcaattccaccattttgcaggtgaggaaaccagtctgggaggagaagcgaccagggcaaggtcaagtaccagggtgtacgcaggacagtcttctcggtcaggggtttgcccctcgccctgaaacggtttgtttgcgttaagttttaagagctgctttcccggataggcagtgccgtgaatccctggtttccagccatccttcgtaagggttactacaatttatcagtgttgtttctgttatgcaacagtggtatcaagtctctggaaagtaaaggaggccttggatacgaacgtcaatcacaggtccagaccgcagcacccgcaatctcctgctcattctgtcaagaccaaccctctcaaagtaaaggttaagtaatgagtattgggcatgccttcttctgtttttaaaatagaaagcaaaatattgctgtacaaatggtacacctgcctggtcaagatcccatttgaagatcagagattgagaaaggcagcatagagacgatcttgtctacccccttccattcctatttgtccaacaccgctatatccaaaggggaaaaagatgagtaagaaatggccttctacctttcagtagctctctgttttacgaataaggaaagtgagatccagaaagcttatatcttgtccaaaaaaaccccaatttcagattcctaatggggtatgttttcctttttttttttaaagattttatttatttattcatgatagacatagagagagagagaggcagagacacagggagagggagaagcaggctccatgcagggagcccgacgcgggactcgatcccgggactcgaggattgcgttctgaggccaaaggcaggcaccaaaccgctgagccacccagggatccccctggggtatgttttccatgacgatttcaacgccacacagcactagaataagtcaccagtagtgtctgggtttctaggagggtttagaaagggaaagcattctacttccttatgtcccaggacaaaataagagttagtagggcgatccctggggggctcagcgnnnnnnnnnnnnnnnnnnnnnnnnnnnnnnnnnnnnnnnnnnnnnnnnnnnnnnnnnnnnnnnnnnnnnnnnnnnnnnctctctctttctctatgtctatcatgaatattaaaaccttcaaataaataaagtattaaaaaaaataagagttagtaaaatatgatggctttaaaagcttgggttctgggtcatatatctgtaagattcaaattctcattctgccaataagtggtattcacagtgcctgcccacataggattgctgtgagaattaaatgagataaaatatgtaagctcaacacagtgcctattccttaaaaaacacttcgagaaatgatgactattgtggccataaacatgactatagaaatagacaatggtacaagtagcctacgttactacttcacttggatccccttctacttcattttgcttccttgtcctctattaaaatttgaattatatgccctttctcttctttaatgattttttcccctccaacatgactatcttatgggaaacaactgtatcagcatacagatacattatttacaaactcctactgtacagtagttataaacattttataagaaactggttttaggcctctaatacctgtggaagcttagatcattgccaggacctaacttttgaatggccacaatgttgaaatattttactaatattaaggaaaattctgtctctctcagaggtaaacacatattgtccctatcttatgggtgatggaatgggaacacagattattaaaaaatcccaatattagacctataaaagaaccagactgtctagcccaacctccccattttacagatgaagaaattgaaaccaaaagaggggaactgattcactcaaaattaggcagtaagtaagggatctccaaactcccagtttagcactctatccactatatcctgctacaattccctttatgctttgagttcaacttggccttacatacaaaataatcagaaattgatgttagtctactgactaaaatttaagttaacttgtaatacctatgaattaaagttgtgttaaccaaggatccaaaagaagaaaatgttattggaacctgacaactcccttagaatgctgacccaaggagaacaaacaactcttggccagccccatgcaatactagggtcttagctcacatataaatagcccataaaatgcaaagagatcctggcaaataagagacccaagtagctcagaacttcagttcatggcagaagttatctcaaaggagcgcaactattcctcaaattacttctgaaacattgtggggacatttttagttctcatgagattggaagtggtaccccagccattaattccttgaggaccaagaatgctaaacatctgcaattcttatgtcatccacacacaataaagaactgacccattccaatacactatgcaaaaacactgaccaaaatgaggtattacccaatcaggacactcacagaaatgtgagtttccacttaaatctgaggggttaataacacatatggttcttctataatggctctgtagctgtgttttgttttattgggaagaaggcatggagaaggactggttgagagacaaagggacaaattgctgagtgccaccctaaggaagaaaagctgatggcaatattcccaaagggcttttaggttttatgtcagaacagtgtcaggagctatgcctggaaaggccactgcctggaatatgcccaagacgagccagtttctttctgaatttcttgggctggtgatctcgattgagaaatttaaatgggcacttgagtggctcagttggttgagtgtctgcctttggttcaggtcatgatctcagggtcctgggtttgagtcccgcatgcgactccctgctcagtggggagtctgcttctccctctgcccctccccctgctctctttctctttctcagtctcaactaaataaataaatttttaaaaaaatttttaaatgaatcccaagtccccagatgaagccaaagtttcttaaaggaattaagccattctatcattagaagttgaaagtctaggagaaaagtgattcatcttaccagggcagctgagattgtgtccagatctctaagtccttaagattcagaattgccaagaccagctaatactaagattatgccacagcataactgattaagagaacagagtccaaattggcattagggtacattatatgataatagcaacttgtagtcaaaaccttttaggtatatatccaaactgtgatgacctccttttctgcaaatcattaatgaccctctatgtggcctccagcagccatatctgccctacatggccctgtcctttagcccccattgattggaggcgagggagatgcttaacttagatcagccaatcagattctctctcaggaatttcgaactgaactcagtgagtttgtggaacaggcctgtttacttgaaagtgagagaaatacagaaaaaggtccatctttgtggagcacccatgaaaacgagaaaatgcctatctgcagaaagacagaaacagagaaaaacagagaaacaaagatgggagacctaaagacttgagagagaagttcctcaatcatcctgagttctgattattcagcttcctttagattccatgagaatctccaggttccattcaaaatatgttatctcttagatgaaattattcttttttaatcttttttttttaatttttatttatctatgatagccacacagggagagagagagacagaggcagagacacaggcagagggagaagcaggctccatgcactgggagcccgacgtgggactcgatcccgggtctccaggatcgcgccctgggccaaaggcaggcgccaaaccgctgcgccacccagggatccctcttagatgaaattaaaaaagaatcaagttaataaataagtgaagtgaatacagtatttgatttctagatagagatggacatcctactcttaaaaataatgaaaacttgaggctagattggtagagcatgcaactcttgatctcaggatttggtgttcaagccccacattgggtatagagatttctgaaaactaattaattaaaaaattaatgggggcacctggtggctcaatcaattaagcatctgactcttgatttcagctcaggtcatgatctcagggttgggagatcgagctcagatcaatccagttccatgctcagcagggaatctgcttaggattctctctctgtctctccttctgcccgtactcctcctgcacccacctaccatttgcacatgcattctctttctaaaataaataaatctttaaaagaaataatgaaaactcccgtaggaaaaaaaaataaggatgcaaaaaggcaattcacaaaagaagaaatacaaatggccaataaacatgttgaaagatgtattatgctactcatagttaaataaatggattaaaacaacaataaggcatcacttttttctaatcagattgttaatgctttataacataatagtttttgttggcaagagtatggagaaacatgtcctctcaaataccactgcttctgggaatgtaattgatataatttttcctaaagatgagtagatgtgaatttagatgaattgatatgaggaactttaataatatttatatataatagtccccaaatccccaaaaagcttttttattagaagtattataatacatataataataaaaagttggaaataacccaaatgtccatcaataggggagctattgaaaaaaacgtagcagaggtggattcattcttttttttatttaaatttaattaaataacatataatgtattattagtttcaaatatggaggtcagtgattcatcagtcttatttaatacccagtacttatcacatcatgtaccctccataatgtccatcacccagttatctcatccctttgcctcctcccctccagcaaccttcagtttgtttcctattattaagagtgtgtcttatggtttgtctccctctctgatttcatcttgttttattttttacctttcttcccctatgatcctctcttttgtttcttaaattccacatatgagtgagctgatatgataattgactgatttcacttcgcataatatcctctagttccatccacatcattgcaaatggcatgaaggggtgaatcattcttttcatcaatataattttacatgaatctgtgaccaaaaaagtaaggaactggaaagaaacttaaatgaatattttaataatctgagagagaagaagaaatatccaattatgaaatcaaagaaaagactgatagtataaaaaatttaaaatttctttgggcagcccggtggctcagtggcttagggctgctttcagcccaggacgtgatcctggagacccgggatcgagtcccacgttgggctccctgcatggagcctgcttctccctctgcctgtgtctctgcttctctctctcccgctctgtaactctcatgagtaaataaaataaaatctttttaaaaaatagaataaaatcaacaaggaaaaaacaatctaaagggaaaattggtaaaggacatgaatgggcatttgataagaaaaattataaatggcctacaactgtatgaaaatattttgaataccatgaataatcaagaagtgcaaattaaaagcacaatatcatttttatctgtcagtttggcaaagattgatcatagccagtattctataagatgtgaagaaaaaggcaatttcatacaatattaataggattacagattggtagaaacctttttggaggatattttggccatggctattaaaattttaaatgtgcaccttatcttagatttcatatagataactaaaaaagatggccaaagatatatgttgaaggctgatcactacagatttgtaatgctggaaaattggaaacaatctaaatgaccaaccgtaaagttttgattcgattatactagatttatgctatagaatactacaccaccatttaaaaaatgaagtaggtctatatgaactaacatgacaagatgtagattttttttaagcaagctgtgggggatccctgggtggctcagtggtttagcgcctgcctttggcccagggtgtgatcctggagtcccgggatcgagtcccgcgttgggctcccagcatggagcctgcttctccctctgcctgtgtctctgcctctctctctctgcctctctctctctctatatatatatatgtctatcatgaacaaataaataaatcttaaaaaaaaaacaagctgtgaaacagtatatatatattatctcttttgtattaaaaagcatagtaagtgtatatgtttatgcatgtgtgtggaatatacacataacaaaatatttggggagatatatatcaatagttaaggaaggtgggtttatggtagagttgccatataacaactggatatccagttagatttgaatttcaggtaaacaattttttttttaccataagtatgtcacaagcattaactgggtatcctgtattttttttatttgctaaatctagcaatccaatttatggggaatgttcacttttaatgttaaatttctgtattgcttgagtttttacactgagcatgtattcatttttaaaagataaaaattttaaataacactttaaaataattttatgttggtaatgtagaattttatatggctctttgaaaacacattttgggggacacctggatggctcagtggttgagcatcttcctttggcttaggttgtgatcccagagtcccagaatcaagtcccacatcgggctccccatgaggagcctgcttctccctctgcccatgtctctgtgtgtctcatgaataaataaataaaatattttaaaaaatgataaaagctgtaagaaaacagtactattacctatgctccaatttctaacagatgcaggaatgagtgaatgcaagagatgtatagaaggttatacttcaaggtattaatgatgacagtgtctgagtgtgggaaattatgggtatttttacatttttaatctacatttttaaactttcaataaaatgctcatgtcataaaacatcaagagacacttcattttaaagaaaagaaaattaggtgacctaagggtttgtcaaacatgtgttcattttagttctggacactctcttccccatgtcagctggcttaaattttgtaaactgcaaaagctaggaagcagctaacagtccaatgaactatccagttgagcaagcaatgtctgctgacttactatcagcaaggatgaattaggggccttgtgctatatgaccatgaacaaatgaccatgaacaaattactgagtctctctatagacctcagtttactcatttctgtataaagaatgctgcaaaaagatcactgaagtggagtaaaatagtaagtcaaacaaaagaaaaaaagtttttggaatttaacctatggctacaattagaatttgcataaacataactgtgaaacaaatcttacattctatgcttattccccaggactggaagttccaacaaagtaggcataactgcttgttgaatattaaggtattacatggcaagaggggagatacaaggacatacatttctataaataattatacttgtatatatgtttatatattatacatatgtgtgtgtgtatatatatacatatatatatatgtatatatatatatatttgttatattgaacatgtgctcaagtgccaaatgagcagtagacaaagactgagtaggacttgggaggagggaggggtcaacggtggcttgggatacccatagagacctttaagattccttgaccaggccttggatgattctccacaggatttaaggaacaggctagagaagtgacacatgacaacaaagtcatttaggggactgggtagcttagtggttgagcatctgcctttggctcaggttgtgatcctgggggtcctgggatcgagtcccgcttccttcagggagtctacttctccctccacctatatctctgcctctctctgtgtctctcatgcataaataaataaaatcttaaaaacaaagtcattagacatttatttattctttaaagtgtgaccaaaaaccccgcacataacaaaacttaccatcttaactatttttaagtgtacagttaagaagtattacccatattcacattgttgtgcagccaatctctagaactttttcatcctgtaaaactgaaactctgtaccctttatttttttattttatttttttttaagattttatttatttgttcatgagagacagagagagagagagagaagcagagacacaggaagcaggctccattcagggaacccgacgtgggactcaatcctgggtctccaggatcaggccctgggctaaaggcggcgctaaaccgctgcgccaccagggctgccccaactctgtaccctttaaataacaacccccccaactccctcttcccagtctctggaaaccaccattctaactttctgtttctgtgaatttttagatacttcatataggtggaatcatacaatatttttgtgatgcacaaaagttttaagtttgatgtaatcccatttgtctatttttgctttcattgcctatgtttttggcgtcatttacaagaaagcattgccaagttccaatgttgtgaagtttttttcaccatgttttcttctaagaagttgtatagtttgggttgtacatttaggtctttaatccattttaagttaattttcatatatgttgtaagataagaatccaacttccttcttttgctcaaaatgggagtcattcacatctataagacccaggctcctctttgcctatgctgatcactgcctatgctgatcacagaaatatacctgaaagtggattcaggtaaaggaaataaaatctaaggtgtacctgagggggtacaggttcatttcccttaaaaatgaatgggtgagattgaagagcagcctatgacagtgagtggtacctctgctttcaacatcccagagcgtgaagggaaagaaccagatcccctacatttgaggatccctttttccagttcttctatcctatttccctattgaagagatttaaaaaaagtagaaggcactaacccactgtactatcttgtcttctagagagagcatctgatgccctgggtctccctgttcttactgtggtgaatgggacaatgcgggggtgaagggtggggaacttgattgtctttatctcctatcccacagtccctcaacctagatatccagaagtagtccgttcttttcttttcttccttctcctccccctctccttctcactcctccttcctctttctttcctttgtcttttttcttgcatcttttcttggcccctttaatctcccagatccaaaacattatctaaggaaacaccaactcctcacctctccctcatgtaaaaaacaaacaaaaatacctcacaactcttcttgttttactatgatcactctttacacactctccaactgggttaccatgtgtgaatcatcttgctatatgcatccaagctagcagtaagaatgaggaaacatagttaatgaacccttacaatatgcccaatgcccagcactttaactacttcaactcatttaatcctcacagccaaatgaaaccaatattattattattcccattttgcagataaggaaatagagagtgagagagtttaaataatgcacccaaggggacagccaggatttaagcccaaggctcagaaaggaacttgtgccttcctttttgccccagatttcttccagttctaggaatttttccttttcaccatgttcaacttgattgtgtttgcattgagcagtcattcctgcttctaattgtttcttcaataatttctaggatactgccagaaaagactggggtaacaaatactaaatactaatattttcaatttatgtgataacatctcataatttctcaacagagccatccattctctcatcttattctcaagaaaaacaggttgtataagtttattttttaacagcttcattattctgcaaggactcatactgcctattgcaaataaaactaagcaatatagaaaattacatagaagaaagtaaaaaataatgccttaaatcccactacccagagataaccattattaatattttagaatatgtctttcatataactctccatttgtatagtttgcctcaatgatagtatactgtatctgcctctctagcctgctttgttttttttttaagattttattatttatttattcatgagagacacagagaaaggcagagacacaggcagagggagaagcaggctccatgcagggagcccgatgtgggaccggatcccaggtccccaggatcacgccctgggctgaaggtggtgctaaaccgctgagccacccaggctgcccctagcctgcttctttcattcacggtatgttgaaaacagcttttcacatcaataaatacatatttacatcatcctttttaatggctatatggtattccaatttaggaatgtactttacttgaccaatctattgatgaactctgagactactttcaattttttattgttggaagaaattgttaacccccatataaagaaattggtccaaaaaaaaaaaaaaaaaaagaaattgttccctcatagggaactgaagctctgagggaactgggctctatgacctctttttaaaaatccaggtctggaagtaaatgcttaggctaaactgctgacttttgactctttttttttttttttttaagattttatctatatattcacaagagacacagagagagcagcagagacacaggcagagggagaagcaggctccatgcaccgggagcccgacgcgggatttgatcctggtctccaggaccgcgccctgggccaaaggcaggcgccaaaccgctgcgccacccagggatcccactgacttctgactcttaaaacagtgcttttttcaactaaactaccaagatcaggaaactggaattcttaacatatatatggatttgataactagaaatgagatttttaaataacgggcccattttttaagaaattaagtatatggcgcgacggatccacccggggacgagcctgcccagcacctgcgagcgccatgaatggttcctccagcatcgccacgatgaagaaagtggttcagcagctccggctggaagcggggctcaaccgcgtgaaagtttcccaggcagctgcagatttgaaacaattctgtctgcagaatgcccaacacgaccccctgctaactggtgtatcttcaagtacgaatcccttcagaccccagaaagtctgttccttttatttttttttattttttatttttttaatttatttattcatgagagacagagagagagagagaggcagagacacaggcagagggagaagcaggccccatgcagggagcccgatgtgggattcgatcctgggtctccaggatcatgccctgggctgaaggcagcgccaaaccgctgagccaccagggctgccccaagtctgttcctttttgtagtaaaacgaatcttttgatggttttctaagccactttacatgaacaagtgaatattcaaaggagaactaaatttgaagcctgtacaaaagcttatccctataacacgtgccatactatataaactcctacttttgtcagtccttaacatttacctctcggaattttcataaattccttttttttaatttttatttatttatgatagtcacagagagagagagagagaggcagagacataggcagagggagaagcaggctccatgccccgggagcccgacgtgggactcgatcccgggtctctaggatcgtgccctgggccaaaggcaggcgctaaaccgccgtgccacccagggatccctgaattttcataaatttctatttcacaagggtaattattttatatatactggcagcagcatacaataaaatacttaagtgtaaaaaaaaaaaaaggaattaagtatatacttaccataaaaaccagccattccactcctatgtgttaaccccaaataaacaaaagcatatgtccatacaaatatttttacatagatgttgatagcagctatatctagtattcaaataatgtaaacaacctaaatatatttatcaacaggaaaatggctaaacaaattctgatatatctctacaatgggatagtactcagcaataaaaaggtatgaactattggccatacaacatggatgaatcttgactattatattgaacaaaagaagccagacacaaaggactatatactgcatatctcacttatatgaagttcaacaggcaagagtaagctatagcattggaaagtgactagtgagacctagggttgcagggaagtttgaatggatggtgaggggttgcctgggaagaggcataaacagacttttggggttggattcatagaattgttctagatcttaattcagtaatggttagatgggtgtatccatttgtcaaaagtcatcaaatggtaggtatgctttactttttttttttattagagacagggaggtgggcaggggcagagggagagagagaatctcaagccgactccccgcagagcatggagcccgatgcaggactcagtctcacaaccctgagattatgacctgagccgaaatcatgagttggacgtttagctgactgaggcacccagggacccctcaaatgatactcttcatttttttaagactttatttattcttgagacacacacacacacacacacacacacacacagaggcagagacacaggcagagggagaagcaggctccatgcagggagcctgatgtggaactcgattctggaactccaggatcatgccctgagccgaaggcagactctcaactgctgagccacccaggtatcccaatggtacactttaaatgggtgaattttattgtatgtaaactatacctcaatagaggttttttctttaaaactggccatctggttttattaacaagcctgtctacaacaggcggtagagataagcatttggcataaataataaatggctgtcagtgaatgaatgactatatttgctgcttaaaagaagaggatgaaagacacttgtttgaacctttcacaggagcagggatttacaacctatcaggtgaataaattgctttcgtggacttgaccctgaagagatgagaccccacttagccatacgtgattatgggtgttgctgctttggcctagcccttcgtagacgggaggatccccaacaataggcctcaggcaggcatctgagtaggagcaaggcctcagggacacagccctcccctcagcatacacttctcaggcagacctgtctaggagggccacctgctaaaggcccggggcaagccaccgcccatgcaaaagctgaagggttccctgagaaagaagccttggtgttaaaaaaaattaactttcaaggggaaaaacaaaagccattttctgaagctgggcaaaggtgagcatttcctggaaagttaaatgcctcaaaagttaatttgaatttcagagggccatggtaatgactcaaatgtgagagcacctcaagggccctgcatgaaaggcaatagaatttgctggcctccttcagtctatctcctggggctgccagaaccttggagaccagttttaaggttatctcagtttctacagaaaaggggaaattaagtgaattgcaggtgctcaattgattaggaatgtcagaggtacttgcttggaaagagagcaaaacaaaacaaaactgaaaagccctaaagaagaatctctataaagaaatgtgtctctgtaactgattacaacagccaaagcaaaatgtttgttttctctgcaaaagcatgatgtatatatgtgtgtgtaagtgagagagaaagagagagagagaatgctataaatgagcctgagagagagagagaaagtgaattttttatttcttaccagacctcacatgaccaaaaggtacttgggtccataaccaacgaattcccaaccttcctctgtgtgtattctttttttcttcctctgtgtgtattcttaagcaagtgttcctctgagtgtaatttcctgcactacttagatcagagtcacttgggggagggagaactcttaaaatggtccattcctgggtctcaggcccctaaaacctgagttagtgtgtctggggtggagcccaggaatcaccaggtgatccttatgaacactaaaacttgaatatcattgctttaaacaaacagtgaattgtttattgatgatttgctcaatagtacaactcgattttaggttcacaaattgaactgtattttcactggtatatttgaattacaactgtctcaagaaaagcaactatgaattggtgaagaagcagaccagaaaaaaacaaaacaaaaaacattgatggttaggaatgtaaatccaccacaacctttctgagattggttgcaatatgtatcaaaatccttccaaatgctttgacccagattttccactcttagtcatgtatcttaaaaaaataacctaaagagacctgagatatgtacaagaatgtttattttgctattgttcattatagtgaaaaactagcaccatctaaatgtctaacaacaggaggttagttaaataaattatgatagcatcatataataaatccagattgatatttatagaaatggaaacatgtttacaataccatattgttcaagagaaaaagattaccaaaaaatttttacacatttcatttttgtacaaaattaaaaagaattggaagataagaaaatgttaacagtaattatctctgagtggtagcattacaaggagcatacatttttcttctttgtaacttttctaagttgttttaaaataagatatattattttcaatcaggaaaaaaaaaaacaaggctgtattcatttcaaataaaagggtagtaggccactgaattccatgtcagaagattgagttaggtgtgcctgggtgcctcagtctgttgggcatttgacttctggctaaggtcatgatttcagggtcccggtattgagccctatgtcaggctctgcgctcaacagggagtctgcttctcccactccctcctcctactcatgctcctgtgctcactctctctctctttctctctctctccctcctcaccctctctctctctcaaataaatctttttttaaaaaattgggttgaagtcccagatctgctgttttgaacctcactcttcttttctctgaaatgaagatggtaacacctgcactacccacctcagacattactagagagttaaatacgggggcacctgggtggctcagtggttgagcgtctgcctttggctagggcgtgatcctggagacagggtcctgggatcgagtcctgcatcaggctccttgcagtgagcctgcttctccctctgcctctgtgtctgcctctctctgtgtctctatgaataaataaatacatttttaaaaagtgttaaatatggaattgctttgtaaactataagatgttttatagagttagtgtattgtgttgatttttcacatcagaatcttgaattcagggcagcccaggtcgggtggctcagcggtttagtgccgccttcagcccaggcgtgatcctggagactggggatcaagtcccacatcggtctccatgcatggagcctgcttctccctctgcctgtgtctctgcctctctctctctctctctgtgactatcataaataaataaaaatttaaaaaaaaattaaaaaaaaaaaaaaaaaaaaacagggatccctgggtggcacagtggtttggcgcctgcctttggcccagggcgcgatcctggagatccgggatcgaatcccacatcgggctcccggtgcatggagcctgcttctctctctgcctctctctctctctgtgactatcataaatgaataaaaaattaaaaaaaaaaaaaacactcactaaaaaacaactagagtgtaacagtgacaatattgtgtcaaatgtagtcatgagattgtgagtgacattttccccctcaatatatatggaaaccctctatgacttaaattaaaatcttgtatgattcaaaatatatgccacttaaattggggaaaaaatacccaaaatggtagccagccatattatctctccagattgttcattcttggaaggcattctaccagaaattcgacaccaccatgatgagttgatttaatgccattcctaaagattaagcgtgcatctcagcattaggataatcatagagaccttgaagcctgacacacttgagttcaaattccagccctgtcacctatcacccacgtgatgttggaaaagtgaattactctttcgacgtcttatattctacctctgacaatgagtaagagacccaaataggagaatgtatataaaagcacttaacatgatgccaaacgcatagtggattggcagtgacatcttacaagatactcacttcatttatagaatacccttaagaagcataccataacattgatttcctttggatgaatgaagaaagtgacaaacttaattagtattgctgagagtgtggagccagatgatgctcatttgctactggaaaagttaaaatagggacaagcactcggcacagccactatttggcagtgtctaggaaagatgaagaggcggttttccctgcattccagcaagtccatttctaggtatatgccctagaaaatgtgtgggaaggagacagacgcgagaatgttcattgtaacaatgattatgagagccaaaaattggaagcaatttaaacgtccatcatcagggaaatgtttaaatcaattgtgatataatcatgaaatgaaacacctatagcaattaaaatgactcaactagggacgcctaggtggctcagtggttgagtgcctgcctttggcttagggcgtgatcccagagtttcggcatcgagtcccacatcagggtccctacatggagcctgcttctcctccctctgcctgcgtctctgactctctctctctctctgtgtttctcgtgaataaataaaatctttaaaaaaaatgactgaactagttacatgtgcaacatggataaatctcaaaaccatgaggttaaaaaaaatagtggtggaaaaatttgtacaatatgatgtgatttaaaaaaaatatgatgtgatttttataagttttaaagatgggtgaaacaatagtatacaatctttatggaatcatatatatcagcttttaaaaataataagcaggagcagctggctggctaagttggaagaacgtgtgactcttgatctcagggtcatgagttcaaaccccacactgtacgtagagattgtttagaaatgaaggaatgaataaataaataaacaaacttaaaaatacataataagtgatgaatttaggaggatgcttacctcaagaaagaaaaaggagggaatgtaataggggagatatatatgtgcatgtgtgtgtaattgtttctgtaatattttatatctttaagagtatctaggggcgcctgactggctgagccgctggagtgtaagactctttgattttggagttgtggattccagccccatgttgggtgtagagattacttaaaaaataaaatcttttaggggatccctgggtggctcagtggcttggtgcctgcctttggcccagggcgcgatcctggagtcccgggatcgagtcccacgtcaggtcccggcatagagcctgcttctccctcctcctgtgtctctgtgcctctctctctctgtatgtctatcataagtaaataaataaatcttttaaaaaatttttaaaaataaaatctttaaaaagaaaattttaaaaaatcaaagtatctaaagtaaaaagatcataatgttaggatttgtgtgtaagggcttggatgtttattattctttttttgtattattcttcatacatagatatgtatatgtttataagcaggaaatatacagtgcttacaatatcataggcactgttaggttctttacatgtcttaactaatgtaattatttctacctgtaaggtaattactatgattatccccactttacagatgagaaaacttgctcaacgtcacatttttggtaagtaatcctggaagttgaaggcaatctggtttgagtctgatctcttaacaaccataccctactgacccttgaaacactttaaaatttttaaatttaaattttatttatttaattttatttttaaagtaaactccaccccccaaagtggggcttaaactcacaaacctgagatcaagagtcacaaactctactgactgagccagccaggagcccccctccaaaaaacttttttttcacataagagggaggtcatgggacaaactaggaagtaaaaccctctagcatcacacaggtcagtgaaaaggcatttcaacaacctttcctaacctacttctgctcttggtaggaaatacttaaattttccaccagaccacataacaaagccagagagcgctgcctggacccatagaccatacaacatcaccaagactgtggtaacacaacagtaaaagccaagtcacctctaatttgggaagaggaggataagtcaaacaataaactctgagaagaccctttggaggtcttacacctggaagaaattccctggaaggcaatgcaagcaggataattctatgagtgaagaaaatttttttgtattttttttattggagttcgatttgccaacatatagcataacactcagtgctcatcccatcaagtgccctcctcagtgcccgtcactcagtcaccccaaccccccgcccacctcccttcccaccacccctttttcgtttcccagagttaggagtctctcatgttctatcatcctctctgatatttcccactcatttcctctcctttcccctttattccctttcactattttttatattccccaaatgaatgagaccttataatgtttgtccttctccatctgacttacttcactcagcataataccctccagttccatccatgttgaagcaaatggtgggtatttgttatttctaatggctgagtaatattccattgtatacatgtaccacatagtgaagaaattttttttatttagagtctgagataataatcctgagagttttgagtgttgctaaattactgtctgcatttgggcaggaccagttgaatgggcaaattcccaaatgagtcaaaatccacacgaatacaataaaagtggaatccaagcttctgctgtattacaccagagcacaattaagactagattataaatcaaatataataatctgcttccagatctgttggtagcctctgccaaccctttggggtggatcagaggccattatggacagctggcctgtggaagatggctaacagcctcctccaaagatcttccatagccctgcctccatgttccgcatccaggcatagtgtggttcaaaggtttggggaggctgatgacttggactgctggtggcaagtctcacagcaaagagaacttaactgagcaagcaaaatgctttaggggggaagttaggggaccatttttcaaatggataatttatttttggatgatagaggatatttttacttctgtcataactctgaattttatgattttattttccctctaagaagtccctgtgatcatccatctgttcccacgaaagagtgaacacctctatggataaatcaatccttagatttccagaggaatttcttctttataaagaggttccacatccattatgctatttggttctcaaactatcttagtcataggaaataagaataacaacaataatagcaatcatattgaatgtcttatgataatgaaagctaatcaaaaagacagcatattatagattccatgtatatgattgtccaaaataggtaaatctgtagagattactcgttgccaggggtgataaggaagggctcctggagagtgactgctaatgaggacggggtttctttttgaggtgatggaaaagttctggagttagatagtggtggtggttgcacaactttgtggatatatgaaaaaaccactgaatcatatgctttagactggtgagttttatggaatgtgaatttttaaaaattcactgatttttttaaattgcagaacaaaaaaaaaaatggtactcaccatgtgctaagacaagagaaagggctttacttggttcaagccacctatgtcacctaattatcctgacaaacttaggagatagtataatttccttattttatagatggggacacaggctcagacagatgatcagtccgtagtgatgtggcaaccagtaagcaccaagcaaaatttcagtttctcaccttcattctccaaatcagtctcctaattgtcattccattccagtaattcaaagagatatttccaagtgaagttcatccaatagtatttcttctgctcaactcttttagtaaaaggtctttttttttttaagattttatctatttgaggaagtgcaggaaagagtacaagtggtggagagggagaagcaggctgcccatcaaggagggagcctgatgcggggttcaatatggggttctatacggggttcaacatgaggctccatgcagggttcaatcccaggaccctgggatcatgacctgagctgaaggcaaccacttaaccaactgagccactcaggtgtcccttggtaaaaggtcttcatgcttttaccttttttcatgtctttttaaatttaggattctttctccccaattttagagagttaaacacaacagtgatttcctctctgaaaatacttaattctctaaactacctgtcttctgataaaaagcaaaccttcatttcttagctcccagggaagtcccttagggtcacacaaccacggctgattttaagcagagatgtgatgtatatcccctacactcgttctgccccaagacatgattaccttgtcacgcagttcccaaaggtttttgtttactctgacctaatagatcgcttggattacaaatgagtcactcaaaataccagagatagcagcagcctccgtgatgggtaaatcctcagacattcagagctggagcaaaccttatagaatatgtgttctgacctctcaaacatggagcattccaaggtggggagatgttgaatgactttcccttggtggtggagttagcagcagaactgaagttgaatttctgacactatgtatcattgccttggtaaatgtctcaaatgattctctatccttgaggcagttccatttagtgttactgatattgcttgttaatatattactatgtgaacttttccatacttttggcatatccatccgatggattattgcataatcattaaaaattatgaggatgaggggcgcctgggtgactcggttgattgagcatctgccttcagctcaggtcatgatcccaggaccttgggagtcctgccaagcagggagctggcttctccctctgcccccttctcctgatcgttctctctctctctctctcaaataaataaatctaaaaaaaagttatgaggatgagtatttattgatatttatataaaatgtgttttaaaaggttaactaaaaagtacagtacaatccactcttttgggaaaaaaacagcaaaaaactatatgtataaacatttataagtactagaatatgtactgaaatgttaacagaggttatatctctggatggtatcattgtgggtaattatttttcttcttctttgtgataatctacccgttataatatttttacaatttacttttgaaaagaataattttgtatttttaaaaaagagtaggcaaatgatttttaaataggacacaaaaaatactgggtataaaataagtaattgacagaatgaatgaattattttaaaattatgaaagacatcattaagagaatgaaaaggtgagtcccagagtggaaaaatatattcatacatgcatccaataatggacttgaatccaaaatatatattataaaaaagttttagaaataactaagtaaaagatagacaactcaatagttagaaaagagactgaaacaagcactcacaaaagggaatatccaaaatttccaataagcctatcctatataccttttaagatgctgttgcaaattaaaacatacaaatgagatacatactcattagaatggtacaatttttttctgattttttaaaaaataagttctaggctcaacatggggctcaaactcacatccctgagaccaagagttgcatgctctaccaactgaaccagccagattcattcctaggccgctttttttttttaagattttatttatttattcatgagagacacagagaggcagagatacaggcagagagagaggcagagagagagaagcaggctccatgcagggaacgcgacgtgggactcaatcccagggctccaggatcacgccctgggctgaaggcaggtgccaaactgctgagccacccaggcatccctgttcctaggctttttgattttttttttaatacgttgaataacacaagttttttttaaaaggccatactgaatactaagaaggttgtggaacaattagaactctcatacatttgtggttggaataaattggtacaaccactttgaaaaactgtttgtcagggacgcctgggtggctcagtggttgagcatctgccttcagcttggggcgtgatcccagagtcccaggatccagttccacattgggctccctgcatggagcctgcttctctctctgcctgtgtctctgcttttctctctgtgtctctcatgaataaataaataaaatcttttttaaaaaaggaaaactgttaataggtaactattgaaattaaacccatgcttacactctgatccaacaatttctctcctaagtacagacctgagggaagagagcttatatctactaacagacataaggatgttcatagcagtgcaattcataatcactaaaaccctactgattttaggcttggaaacatccaatgccaatgaacagttggaaggataaattgtgacctctccacacagtgggatactacatacaaacttgaacttctgctatgtgcgacaacatggatgaatggcacatacataatgttgaaagagcatatgcagcatattgtctctgatcgcattgataagattggcaaaactaatttctgctgatagaggctggactgttgtttacctgagaagatggagaggaaggacaaggctgggtggaatccacgagagagcttctaaagtgctgtaaacattcactataaaccaatctagaattacacaggtataaacatgggtaaaaattcatcaatgaagatgttacctgaagaagtgtcagctgttcctttcctccaggggcacttgcattacaaaaggggactttacagacactgtggacaaaaatacgcaggaggaagaaagggagtttacaaaaacaagtcacaattgaaatgattgtcagtttccttaaaattttttgagggaattccaagaagcccaaaaacttttagataaactgaaacttaaaatctgtagcaatcaaatccctcactacactctcacattattatcgtagtcgagtctcacaacaacctgtgaggtggtctgggtcactgaccccattttacagaccaggagactgattgggaaagagaagcacttttcacaggattaagtaactggagctacaggtcagaatgtgaacttgagtcatctgaatcatgaccccacactgctctcctcttccagaaaagccttttcaccaacatgggttcatgaaatgtccttcctggaaccagcagagaggaagagccagtacatgcagaattgcctctggaatattctttctcttttttctctccttttctagtttttagttcagtgttacttgtgctgtgtcacctcttgaacctttggaaggtgttggtagcaactgcaaactaccacaacctttgatttcaaattttctccacactttattttcacctctagtcatgggtgggtagtggtgacaacaagaggtggtgcgaggagagctttagcctccttactcatcaagccactccaagtaaaaatgtagtttaagtagaaaaagtgctagggaaatttggcctcataacaacttccggaaattaagactcctaaaccccatagccccaagaagtgtcatttatgtgaaataccagctaagggatgcccctagaattgcacaagagggaagatatgccgaaccatcttccaaagagtctgccctgtttaagaatccccatgacagaaattctggatccacctttgtttttggtaagtggtaggaaatcaggactccccaggatctgggagataccagcagaaaggatcaagtccacagagatcacaagagcaagggagaaatggaataggaccatagggtgagaccggtaaggtccagagtcccagaggtcagggagttcaatcagcaaacataacatgattaagcagggcctcacattgaccctgggggaaggctgtctgaactttggtcttgtgtggagatgagaagagttctgaacccactcatgctgatttcagccacaaggaagtccagggcttgcaaataaccactagaaatactcagagaacttcttgtaagaatgactaaaattgtatgtttgagttaagacttcggtaaaagttgctatttgtttcaagtggattcatattttgatctggagtctggagtttttactttactgtattctcaaatctgggacatcaactaatccaagagaggattaatttggctataccactgaattacattgtttatgaaatgtgaaaatttctcaactctggaagattggtggaaggtgaaaccacagtctgtgttggtgggccaaattctggtttggttatgtataggaggaaatggagtaaggtctatgtaagctgcaggtctcaaattctggtcccaggtgcccatttccaaactgaaagggacatttctatctgggagaaaagacgtggtcatgcatgactctttggagtccatcctactcaggctcatgaatcccagtgttctgtttttcaggtcaccaggaggcccagagtgtccctagttgggtctctctggaggactacctactgtggcactgagtgtggggaaagttgtgaactctggacagatgttacatctgatgtctcctgaatatcactctttcctttccctctaaattccagagtagagaataggctccttagccagctttgttggaagtttgtcaacacctgttgtttgttcagaataatcagaggggccatctcagcaaccccagggagttcaggggtgcctgcactgctactatgtatctgcattaagatatattttgcaaaaacgacaccctgtgacccattgctcttctattacatcctgccatgtgggccctgctctaaggccttgatctttctttttgaagagactaatgtccattacattgtggtcatagagcaaggtacaaatgggcagcaggtggaaaggattggcatgaataactccaccactaaccagggaattgatataactaagactataagagacatgagaagttgtggaatcctaataacatgcaattaggttcattatgtgtgaggccctgtgctacacatgtcatgtatattagttgcttcatttaatacaacaaccctatgtagtcttatcgtctctattcaatgaatgagaaaacctagaaagagtttaaataaattgctcgagtttacatagcaattatggcagagccaaagctgggtgttcacacaactttttattttcctttggaccacacagaaagactacattttccagatctccatgcatttagatgagatcatgtgattgaatactggtgaattagatgtagatgcgatataccccatttctcggtttaaaacattccacgggcacttctgctatctcttccttattcacacagctggaagcccaggaccaccttgcttccctctccctcccaaggacacagcccagataccctaaataactacctggtggagagcgtctcaagggagctgactggcttacgttacaccgtaatgggaacaataaataaaccttagcttggttgtgctaagcagttgacatttcagggttgatttgtcattattgtgtaacctacctaccttgagtagtagccaagatttgagcgcaggtccgtctgacttcaaaccactcttaaccaattccttaaatgagcacagaaggatcaagaaagactctaatccctgaatctgccactaacctcacaaaggatcttgagtaagtcatttaagtgactcggtttttcatttgtccattgggaataaaaatgtctgcccttctaatccttcagacttgttgcaaagagaatataaaaccattcctacgaaataacttaaaaaacgagcaccgtacaagagcaacgaagtgttattatctggcccattttcccacctctgattaggaaactattccactgaccttagaattggcatgaaactttagttttgtagccctgcctctgttttctctaatagttgttcttctggtacctttaaattttagcataatcaaacttacagaagggttgcaaaaatagtccaaggagctcctgtataaccctttacccagatttcccaattgtttacatcttgccccatttctgatttattcaaaagtaaattggagacattatgtgctttaccactactgagggaacacgaccttgccaacaccttgatttcagcccagtgaaacggatttcaggtttctggtcttcagaactataaaagaataaatgtgtgttattttaatgtaccaaatttgtagcaatttgtgacagcagttataggaaactaatacagtccatattcaaaaaatttgtccagggatccctgggtggctcagcggtttggcgcctgcctttggcccagggcgtgatcctggatcctgggatcgagtcccacattgggttccctgcatggagcctgcttctgcctctgcctgtgtctctgcttctctctctctctctgtatctctcatgaataaataaataaaatctttaaaaaatatatttgtccagatagaatccattacacttgctttggttctcaatccaatctccagttcagaaccatactttgcatttatttggtgtgtttagttttcttctaaaatgaaacaattcctcagccttactttgccttccttgacctcgacactttatttatttatttatttatttatttatttatttatttatttatttatttatttatgagagacacagagagcgagagaggcagagacacaggcagagacacaggcagagggagaagcagagggagaagcagagggagaagcaggctccatgcagggaacctgatgcgggacttgatcctggcactccaggatcatgccctgggccgaaggcaggcgctaaacctgctgagccactcagggatccccgaccttgacattttttaaaagtgcagctttttatttgtagaatgtcactcgttttttgtttagctgatgttccctcaaccttaaattcagattatgcattttgacaggaatataatatgatatcaggaagtatatgaagttgctctgtctcaagatcaataatgtttattttgatcaagtggttaacctagacactgctagatccctccactctaaacttactagtttccccctctatagctaaaagtaatttgtggggagatactttgagaattttcctcattacactttaactctcaagtttccatgtccatgatgattttcttttttttttaagattttatttatttattcacaagagacacacagagagaggcagaggcacaggcagagagagaagcaggctccctgcagggagcccgatgtgggactcgatcctgggactccaggatcacgccctgggccaaaggcaggcgccaaactgctgagccacccagggattccccccatgattattttctatccccatcatttccttctgtattagcagatatgattctactgtaaggaagatctccttcttcttcattatctatctatctatctatctatttcaggggcacctggctggtgcagcagtagagcacaccactcttaatctcagggtggtgagttcaagccccatgttgggcatagagcctactttaaaaataagtaaatatttatttatttcagaatagactcatagattcttagttaatgcaatgggctataatctactgacatcattatttatttttgatgctcagatcatcccagatttggctggtgggagcccccttaggctggttcctgtgcttttttttttttaagatttgtttatttaatagagatagagcgagacggtgagcgggaggcagggcagggagagagggagagagagagagagagagagaatctcaagcagactccatgctgggtacagaccctgacatggggctcaactccaggacccttagatcatgagccgaactgaaatcaggagttggctgcttaattgactgagccacctctgcgcccctcctgtgttcttttgatatatccccagaatttatggagtactttcctactttccggcacaagaaggtatttcaggttcatcttattctttctttgcagaagtctgttctccaagaaaccctggtttccctccttggaaaatggtatttagaaaccaaaatctggaggggtgcctgagtggctcagtcagttgagtgtctgtcttcagctcaggtcattatatcggggtcctggaatggagccctgcatcaggcttctcactcagcagggcgtttgcttctccctctgcccctcaccctgctcatgctttctctctctctcataaataaataaataaataaataaataaataaataaataaataaataaataaataaataaaatcttaaaccaaaaagaaaccaagagctagctcattgcagctggtatgtcgttgcttctctaggctccctcagtggacaaaaccagaaaatttgtataaaaccctaagttcatactgatacctccaattctaatccaacatcacatggtatattccctctttttgtaactccctttaaccaactgtgagaaaactggctcccattgccctcagtatattttcttatttactcaagcctaatctaccaagtataggtcaatatttatttatagatttggcagggggaatggacagtgagatgcagacattttaagtacataatttgatgagttttgacaaatgcctacatttatgaggcccacatccctaccaaaacaaaatagtttcatcatcttccttgcctcagcaatttgacccccccagacacaaccaatttttaaattttattccaccataaattagattttcctgttctagatctcatataattgaaaataaactgtgtgcactcttttgtatctagtttctttggttcagcataatgattttatctgtgaagttcattcacattgttatgtatattgttagttccctttagtggttgactaattttctattgtatgaatttgtttaaccattgtactaggatgcacactgggttgtttccagcttgaggttattatgaaaaaaacttctttgaacatttttgtacaagtttttgaaaggacatatgtttcatttcccttgggtaattgcttaagaatgaaattcttgagtcatagggtaggtgtgtatttaattttataagaaacccaaacatttccccaaagtagttgtaccatttttcactacttccagcaacaaatgagtatgctagttgctccacccttgccaacatttggtatattcagtctttttaattttaaccattacagtgaatttagggaggtatctcactgtgattttattttattatttttttaaatttttatttatttatgatagtcacacagagacagggagagaggcagagacacaggcagagggagaagcaggctccatgcaccgggagcccgatgtgggattcgatcctgggtcctcaggatcgggccctgggccaaaggcaggcgccaaaccgctgcgccactcagggatccctcactgtgattttaatagacatttccctaatgcatgacatttttaagctattttttaaaagacttatttatttattcatgatagacacacacacagagagagaggcagagacacaggaggagggagaagcaggctccatgccgggagcctgacgcaggactcgatcccaggactccaggatcgcgccctgggccaaaggcaggtgctaaactgctgagccacccagggatcccttttaagcaatttgttatgggcttattggccttttgtacattttctttcgagtgttcaggtcttttgctcattaaatattttggagtccttttcttatagatttttaaaaataaatttcagggtgcctgagtggcttagtcagttaagtgtccaacttttggtttcagcttaggtcatgatctcagggtcctgagactgagccctgagttgggctcctctgttcctccccctgctctctctctctcttcctcactctctcaaataaataaataaaaattttcaaaaaatgtttttaaatacacttcaggggcacctagatggctcagtcagttgggtgtctacatttggcttgagtcacgatctcagggtcctgggattgagccccaagtcatgctccctgatgagcagggagcctgcttctccttctccctccccgtgctgtgctctctctctctcaaacactctctctctctcaaatagataaataaaatctttttaaaaatcaaaataaaaatacacttcagatgcaagtcatttgtgaaacaaatgttttatgaacatatagcgtctcaggctatgggtttcctattcattttctgaactatatcttgtcataagcagaagttttaaattctgaaaaagtctaatttatcaaatctttaaatatggggatccctgggtggctcagtggtttagcgtctgcctttggctcggggcgtgacccctgagtcccgggatcgagtcccacatcaggctgcctgcatggagcctgcttctccctctgcctgtgtctctgcctctctctgtatgtctctcattaataaataaataaaatctttaaaataaaatctttaaatggttatttgctttctatgtcttaagaaatgtcggcctacctccaggttgtgaatcccaagtactttacatgagtactggaatcaaatgaacaaattataaattcaggaagccagaaaccaaacagactttgttggtgagcaaatgaaagattttaaaggacatccaagagaaaaggaatgagagcaggactaaaagctgctttttcaagtgtcattgatggagcttagatgagagtcatcaaccaggctgaatcacttgcagtctgagaacacctaacaaagcagccatactccttcccacgatcccagggatttggggggagggtgttgaagggtgtcagtttaggagactacatgttaatttgagtcacttcttttaatgaagagtctgtccactcaagaaggcagtttgtagatggattggagtgacagtcctatagtgcagccagaatacatatgatgtgccccaataccacattgcttttctttattccttttattgtaaaaacaatcattcttaattttaaaaattcatgaagtttaaacatcaaaattttaaaaaggtatacagtgaaatacatccctcccactgttacttccacaatagataaccagtcactagttttcttgcatctctgttaagagattttgaatgcatttacaagataatacacatacatggtatttcccttttttatgtaaatgatatctactgtatacactgttctgtgtcttgcttttttcaaatcaataatatgtgttagaatgttttccaatcagtacacaaaaatatttctcattcttttcctcagctgcatagtgttccactgtatggatgtcccataatttatttaaccaggcccttttaaaaaaaaatgttatttgtttgtttatttatttatttatttatttatttatttatttgagagagagagagagacatcgagtgatgtgaacaaatttttcttttataaattcaagtagctagaaaccaaacagactttgttggtgagccaatgaaagattttaaaggacatccgagagataaggaatgacagcaggactaaaagccgctttttcaagtgtcattgatggagcttagatgagagtcatcaagcaggaggaggggcagagggagagggaaagggagaagcagactcctcactgggcagggaacccaatgacacaatgacacaggggctgatcccaggaccctgggatcatgacctgagctgaaggcagacacttaaccaactgagccacacaggtgccccataaccaggcccttattgatggatatttaacttttcagatttttgatgtttctttcaagtactgcttcagtgaaaaaccttgtatatacatcattttgcatacccacaactataactgtaaagcaaattcctagaaacgagcttggtgagtcagagggtatatacatatattattttggtagtcatgaccaaattgcctttaataggaattatctcaacactggtaatgtatgatagctcctatttatccacatttatggctaatctaagtgttatcaatcctttggatttttatcagtccaatacataataaataaatctcagtgacttttagtttgaactcatattaagtaaggagtatcttttcatgtgcttaatagacactttatatttcactttcattaagatttattttttaaaagactttatttatttaattgagagagagagagcatgaacagggggaggggcagaggaagagggagacataggctccccattgacccaggaccctgggatcatgacctgagctgaagatagacgcttaactgactgagccacccaggtgcctcaatatttacttattattattatttttttaagtaagctctatacccagtgtggggcttgaactcacaacctcaagatcaagagtcatatgctctactaattgagccagccaggtgcccctcatttgtactttttaacggagttgatgatcattttattattgttttacagatgctttttatccccagtgtcttcattaaaagccgtatattatttgaagttcaaattgcatacaataagattcaactttccaaggactgtcccttgtatgtgggaggccttgccacacaatggtgttttgaagtacttttttgaaaaactccagagcagtaagagagttatagggagcaggttacattcaggccacaatttcaaaagtctcatatgcacaggcagtgtgtttaacagaaagaagttaagctctggaatctagtaatttgggttcaaatcctatctttgccatgtattaactatgcaattttgttcagattatgtcacctctttgggtcttggtgtcctcatcagtaaaaaaccctcaaaatcaaatcctatcagataacacaatgaaagcacactgtccagtgctgacacaaactaggtgctttataaatatgtttccctttctgcggggaaagccagtcaccagagacaacatgccctggggcagcagaatggtgtgcgcatgtttgtgtgtgtgagcgtgcacatgtacatgtgcttgcgcacaccattcccaaccatgacctcagatcctattaaagtattaagccacgaaaaagccacttatgtttctgtttccagctttccaacgtggcacttctaggatcaggctgaaagcttcctgtgttcataaaatgggctcaggaagaaaatactacacctaagagaggacattccaagagtaataactccttttcagtagagttactcaaaaccaccctgccaaacctgttcttctgccttgttgattagtgcctaaccaggcttccacctgttcatccaacagcgttagattagagtttcaaaaaaagaacttgctcctcagatcctggggcattggcttttcctattcccagttgtgaaccctctgtttactgtgagggagacaagacaatcacggcagaactaatgaataatcattctctccccactcagccagacaaaaatggatgaggtctgctgccatcctgaaggtgtcagatgctcatactcactgaggttctagtgttgcccaggctaggtggcaaaagccttgcctccaggcactggctttggaaagcagcatctaggtcacctctcaatgatttcacttgcagggtagactgggctaaagattgggtgaagtcctcagaaggacttcccttcctcctaccagttatggtcatgagtcctcagccatagctatgtttatacccatctgggacacccggtgtgaacttctaaagctggtgccctttgtccttctgttgtttccaaatagaaaggtcaagtgttagccttctgagtctacctcatggtagcaaggtctcagttcaaaaagaaaagttaggggataaagtcacagttgtatgatcctccccacggaggtatctatcaacagatcagctctctctgaactggaagtacaactcagagtgcagaggcacgtccacctgggattcagcctctcccccacattttggggccctgaggtctgggaaggaaataagaatggcggattctggggtgtttgggtggctcagtcagtagagcatctgccttcagcttgagtcatggccccagagttccaggatcctgggattgagctccacatcaggctctctgctcagtgaggagcccgcttcttcctctctttctgccttttcccctgactcatgttctctttcactcactctgctctctctcaaataagtaatcttaaaaaaaaaaaaaaaaggtgaattctgaagagtgcctcatagatagaagagtcagcagccactgacagctgcaaagtggatctgaagtcttttattggaagggagacggaaaatgactctgagttctgcagctcatctcttgtgtggccctgaagaggcctggaaggattcctagatgtgtgtggaattcaggagacctggtttttaatactgagtcttactattgacagtgccaacactatttgtcaattattgcagggctaacctgtgctaagtgctttgtaataattattttattcagtccttacaaccatgaccccatgaagtaggcattattactgtcccccttttacagatgaggaagctaagactgaaagaggttaagcaactttcccaaggtccaagcaatagcttgtggtactgggatttaaacccaggcattttgggtctagaaattgtgcttattacttctttttttttttttaagattttatttacttattcatgagagatacagagaccagacagagggagaagcaggctccctgcagggagcccaacacaggactcgatcccagaacccccggggatcaccacctcagccaaaggcaggcactcaaccattgagccacccatggtacttcttcttgatgaagttgtcttatcattgtccttattatataatgctctatagctctttgtttaaatgcttactgtgtacactaaacttaatggtggacatagcatgtttaatcattttccattgatggtggccaacactgacctgaacaacaactgggtagtcagcaaacatttattgaataaatattaaataactgaatattacttcctgtgccttagcattgggaaaagatgagggtgagaggaagggaagtacaatgttggtcattgaaggcactagggactcaagtcctctggtggttacaatggaaattaccaccttaaactgggtatttcctttgagctgggttttgcaaactgggttacatatgagcaacggtggcagctgtacacgccatttgtggcccgggaggcttttctcttcttccttgaaaacagtacccaccacccatcacctctggatactcctgtctcattccctcaggttttagtgggaccgttattacaattccccacccatccctatccaaggaaaattcttgactcaagcctagccattcaggccgctccctggcttttggcactatggtgctagaagaatggaattttggaaatatttgacggtatcttgcctggttgtgtagaggaagccaggctgaaatgtgagaagttgaagccaatgtacaaagagaagcagacaagcagagatgagatgagagatggagagacaaagagacaaagtaacaacattttttgagaccatacctggagataaatctaccctgagatgtcccaatttctgggcttctgtagggagctatttgccaaagctagtttaagttggttttgtcacatgtaactaagataattctttcttttcttttaaaagattttatttatttattttagagagcacgctcatacaggactcggggggaggagcaaaaggagacggagaagcaggctttctgctgagcagggagcttgacacagggctcaatctcgggactctgagatcatgacctagtgaaggcagatgcctaacgaactgagccatgctggcaccctattctctcttttttttttttttttttaagattttatttatttattcataagagagacagagagcaagaggcagagacacaggcagagggagaagcaggctccatgcagggagcccgatgtgggacttgatcctgggtctccaggattatgccctgggccgaaggcaggtgccaaactgctgagccacccaaggctccccttcttcttcttcttctttttttttttttttaaagattttatcatttttaaataatctctacagccaatgtggggatcgaactcacaaccctgagatcaagagttgcacactccaccaactaagtcagccaggtgccgcagattctttaaggctcttaaacatatgaaaaaaatgctcaactttattcataagagaaattaaaattataatacagtggcacttttggattgaaaagatgaagaaacactcttaaatacaatcacaatagagggaaattttgcaatatttttcaaaatgatagatgcaaagctctttaacctagtaattccagttttagaaatccatcctacaaatatatatatatgccaattaactgtgtgcttcagcatcattgtcatagcaaaagacaagaaataatttaagtgttcatcaataaaggactggttaatatattaaggtacatctatacaacaaaatactgtgccatattgggaaatagaatcaggaaacatatgcttatatttgcatatgtgtggtttttccctgaaaggatatgcaagaaactgacaaggggatgtgtgtctgggaacatacttttgtcttttcctaatcttgcatcatgtgtacttattacttattaaaacataagcaaaatacattttatgtttaaaataccttaagagggatccctgggtggcaccgcggtttggcgcatgcctttggcccagggcgtgaccctggagacccaggatcgaatcccacatcaggctcgcggtgcatcgagcctgcttctccctctgcctgtgtctctgcctctctctctctctctctgtgactatcataaattaaaaaaaaataaaaataaataaaataaaataaaataccttaagaaaaattgaaaaatataaatgttatgtataaagtagattgcaaatattttaagatatcatctagaaagttccagggcatttcaagctcaggtaggcacttgggattttcacctgagacctacggcaatgagggtaaaaaaatgaactctctcaattgcttgggacactcaggaaaagtgtgaaaagcactgctttctagataataaggcccatatgcaagactcaggggagataccatttggaactcggaagtaaagttactttctgagttctagaaaacagacaattctaagtttttaaagcagaaggaatttaattcaaatgagtggtttatataggttttggcagagattaaaagtgaaacagagaaaagtgaaacagtccagagacaagcaataggaagaaactactgccgccctcacactggaggaacagaaggaagacattttgttaccagagttggggctgaggatctgctgctagaaatccgagccaggtaggtgggaggagacagcttgagtttggggtggggtggaggtggggatactctaccttcttcctccatctctccaatttccaggagtgcccctcttcggatgttgcccagtaacagcctggaagcaaaacagcacaagagtgcaagacacacagccttcatggcatcactgccatactgaaaagagcaagggaaaggtgaagaatggatctgagggtaaagcaggcccaagatcagcacagaaggaaatcggacagggggtggggtggtgggtaaaaacatggttgacaaatctatctcctttgaaaagaatcaactcagggtgcctacacaaaggtgggtttctagaactgcaacattaaggcccagataatttccccaaaatgttctttagagctggttctccaaactaggatctaaccctgagctatatgctatgtctaattgttctgtctctcaaaaacacgtaaatccagaatgacatcttttcttgatttggtgaaggaaagaggccatttgtcctatagaatatcccaacttctgaatccgtttgctgccttttgctttactttagcttgatcctcttgcctagcctataaacttgagtagatccaattgaaacattttttggtaagaataggtcatacttgatgatgcctattgaatgttgacatcctagcaggagacacataatatgattgttctaccattaataatgctaggatttactattgttagagtgatgaaagcctgataatttcattgggcagttaacttttaagacggggctagtagttcttgtggtacactttcccttgttaaaactagtttcctcatctgaaatgtgaataatagaattgggctttttataagtatttttaaaaatattttatttttaagtaatctctacacctaaccaggggctcaaactcacaacctggagatcaagagtggcatgctctattgactgcaccagccaagcaccctgaaatgtgaatagggtttttgaatagatcaaataaattaatgcattcaaagcacctaggacatagtaaacattcaaataaagcagcaattattattttgattgcaacgccaccatcggagaatatggagaagaatcaaaagctctaactcaccattctaaacaattacttggacgcctgggtggctcagcggttaagagcctgccttcagcccaaggcctgatcctggagacctgggatcgagtcccacgtcgggctccctgcacggagcctgcttctccctctgcctgtgtctctgcctctcacgaataaataaataaaaaccttaagaaaaaaaaaattacttcccttttctgagaccggtcgggtcattctggagtctggcaggccacgctgggagcttggccttgctgttgcgcgggttaggtctgtggacaagatacgtaactgccatatgcggaggacttagcatgtacagacgttgcaccaaacactttacaagcattttcacatttaattcttaagctccacaagtgagaattatcacccatactcttcagatgcgactgagtctcagaaagatcaaataacttgctcaggtggcaccgccaggaagccgagataggactaccatctcctcgggtccacgagacccaagaagaagacgcatcgtaaaaacttttgcatcgggcttattgctttaagagacctatgacttccctgctgtcaccttctcagcaggctttctgggtcttacaagttgaactcctctcttcctagcgtcactcccttcccccaacgcccctgcacaggactccccctaaccgacattcattcgtcttccccaactccatgagggcagggagttctgtctgttttggtcactgctgtcttcttagcatttacagcagtgcctggcacacagcggacgacgcttaagaagttgtagacagggatccctgggaggcgcagcggtttggcgcctgcctttggcccagggcgcgatcctggagacccgggatcgagtcccgcgtcgggctcccggtgcatggagcctgcttctccctctgcctgtgtctctgcctctctctctctctctctctctgtgactatcataaataaattaaaaaaaaaaaaaaagaagttgtatacaaacgaaaaacgctttcggaaacgtcagggagccagagtgcagcggcgcggattgaacctcgcagggacccttcatacacccccttccgccttcctgtaggcggggggagaaggaggaaagccccgcctaaggccggcgcgccgcagcaggccccgcggactggaggactagcgggagtttctggagtcgcgtttgacgcgtcagctccgcggcgtcggcgcctgctgtgtgcgtcatttccgggcggcgcgggacggagtggccaacggcctgcagagcaacatgcctaagtgagtcgggggcccgaatctgcgggtgttggcgctcacgggcaatcactgtgccccagtgggggagtggagagcgggttctagctcttgaggtttcccggagagcgccagccttgggcgagggaccccggaaattttagacgctcccttctttcgaaatggggaggtggactccgcgaaaggaaacccccttccttcccttccccccccccccccccaaagagcttgtgtcaggtcgctttgtaggaagtcttggaatcgcgggtagatcttttcatagtttacgttcattgaacagcacgtcggtgggtgggctctgttaactggctgtcgtcttctctttttctctgctttctatctcttcccaggttttattgtgactactgcgacacatacctcacccatgactctgtaagtagcgtctcttttcattttcaaagcacctgtgtgtgacaaattagatgtatttatttattttttaggtgtaaatttgtgctttccatcctgtgggagtttaagtgcgtctgcttggagaaaataatctggatttcttttcccccatccttcctgtaactgttttcgtaatttgtagttatgagtcttccagcggttggtgttttcagttgagacccaaaataaaggtgaaaattgaaggtgaaaaaagtttatgacaagtgaaaattccagggagatctaaagttcaaatatttgattgtgacaaggcactcacacatttgattgactaaactggaaagaaatgcctagatttgaaacctgagtactgtcctttgatttgattaaaagctgccccccaaaattaagatcgaatatttactgtgtgtcaggcagtgttccagatgcataacatatatcattttgtttaatgcttatgataagttagtattatcttcattttacagaggaggaaactgaggcagagtatggatacaggactgggtgtgttgctaaaccaggaagttgtacagagctaaaaggttagcctaagcagtctaagtccagggcttctgtgccagcagttcccaaacttctttggtcccttccactcttaaaaattactgggttattaaaaaacaaacaaacaaaaaaacagttacatgagttatattggtttagctattaatatttgttgtatttgaagttaaaacttaagatacttattgattcatttgaaagtagtattaacagacgctttaattgtaatacaaataacattttaaaagtgaaaaatagcaattttcaaaaaaattagtgtgaagaatggcattgctttaatctttttgcaagcctctgtaatgtctgacttgatggaagacagctgggtttttctgcattaaatttgttgcactatattttggttgaattgtatgaagacttcaaccgcacaagcataaggagtactttactagcctttttagataattgtggatattctttaatactttatattactatatccaaactagtttcagtgtgggctcttgaaaccatatcaaatttttcatactgttacatcagaattcactgatctggggatgcgtgggtgcctgagtcagttaagtgtttgactcttttggctcaggtcatgatcttagggttgtgagagatgaagccctgtgtccagctctatgctgagcatcaagcgtgcttaagattctctctccccccccccccccccaccaaatttcactgatctgtcttgtactttgagtgaatattttaccagacatgattttgtaacatgctttggtcaattggaaaatgaatattggaatattggttcactcaattttacaggtcttccaaatgttgacacatttgattatgtaatataaatattcacattaatgtcacaatctaataaaaaaaatacttcctaagtattaggaagctgacaagctcatggtagtaaataaggttttctaaaattctgagttttggggatccctgggtggctcagcggtttagcgcctacctttggcccagggaatgatcctggagtcccgggattgagtcccgcgtcggactcccggcatggagcctgcttctccttcctcctgtgtctctgcctctctctctctctctctctctctctgtctctgtctctctgtctatcatgaataaataaataaatctttaaaataaaataaaataaaattctagttttgtttgaaagctcaaattttattgttggcagtaaatagtaccaattgcttccttaaagtgacaggctcacttgatttatttctaagaagtttaaatttccagtttgtgtctcagctctgtcagataaaaatgttccattgaagaggcagctggtagagcttacaacttgaaccatttacattcctgcttttctttggaatggctccatattttggcatgtggctgaagtactttgtatatctcattttcacccagaatattcaaaagacatgaacacaagagtatatataacagttatatattagtaggtatgatagaattaataactttgctgcttcagcaaggacagtctccatgaaactggatattttccccctgtgagtgcatagcgttgaaaaaatacaataatccctaatgaattgggttgccattgcctcaggtcattctaaagtgccagaagtttggcatcatctggaattgtcaatacagtgaaaaagaaatgtctttgtattatgaaactactttgaccttgcacatcttcccaaaaggtgggtctgagacacccttagatgctcgtgagctgcaccttgaagactacagctctatactttgctgcctctgcagaaacctaattaaaccagaacttttgatcatcttgtcctcttgaaatgtagcttcaaggaccctagcccatgatttctgtgttgttacttcatttggaattctaacacttggtcagatgtagttcagcattcatttgtggaatattgaaataagatggtccctcttgaaggaataatagttttgaatattacttatagtttgtcctggatgggactcctccaataagttggtattatggtagcttgcctttagaatcccagtcttgggacacctgggtggctcagtggttgagtgtctgcctttggctcagtgtgtgatcctggagttccggaattgagtcacacattgggctccctgcatagagcctgcttttccctctgcctgtgtctctgcctccctctctgtctctcatgaaataaacaaataaaaatcttaaaaaaaaaaaagaaccccagtctttttgtttagtcaaacccctcatcatcattttctgatatagcgagtaggctaattatagcttatctgctaatgccagcatttagagaattgaagaattgaagaatatttctttaaaatgcatgtctctttgtgagaaatgccaggtgcctttgtgatattgttgtcctaacatgatagtttgtgaatgtagtaaaattccatagtgattgaaccggttctctgtggtggactttgatatgcagtaaacaatcagtgctgcaacttctgagtttttgctgacttttaggcatgattttgttattaggcttaaggcctcattgttgtattacataataagtcattgaggagtcagggaacaatattttgaaatgtagaccatgaaaagacagtctctgttcatgtgatattggtcatacctggttctagtgaagcaatcctatgaagagaggatctatcagtaggaggtagttaggcagccctgaggagcatctgagtaagatctgggctccaggccttcgtttgctacttaccagctagttgggtttttttgtttgtttgttttgtttttttaagattttatttattcatgagagacgcagagggagagacagactcctgttggggagcctgatgtgggactcaattccaggaccctggggtcacgacctgagctaaagacagacgttcaaccactgagccacccgggtacccctgccagctttgtgttttatcagacaagtctttaagcacaaattgaagatagtaagcttgtgatttttttttttaagattttatttatttattcatgagagacacagagagagagagagagagaggcagagacacaggcagagggagaagcaggctctatgcagggagcctgacgtgggactcgatcccaggactccaggatcatgccccgggccaaaggcaggcgtttgccaccgctgcgccacccagggatcccaagcttgtgattttttaatcaatttcattgaattatattttgattaaatgcatacattctaagcatacagtctgatgatttggcaaataattacagttcagtgtatacattgaaatacaggacatttccatcatcccagaaagttcctttgtgtctttttatagtcagtcccctacacccttggccccagttgatttgggttttattatgaaagattagtgttactggttttaaaactttatatgaatggaatcttagagtatttagtctgtgtacctcattttgtttgctaagcatgctttatttttttaaaggttatttattagcaagcagtcgagcactagtggaggaaggggcagagggacaagcaaactccctgttgagtgagatgccccatgtggggctcaatcctaggaccctgagatcatgacctgagccaaagtcaaacacttaactgactgagccacccaggcccctctgagcatagttttgagatttgtccataattgtgtgattcagtgattggttctttctgattaacattccattgtaccatgcacatgtgattattatgacaattgagacactgcttgtaaagtaaatagcatggtgtttagcatgtagtaagtgttaaataaatgttaacttgttaacaatggttaaatgtgtggagtttatcttaatgtcaattctacctgagtaaaactgttaaagaacaaaaggattagtgggctagagacacaagtctgtatgtgactcacatagtctgtattctagacccatagtcatttaaaagacgatattctcataaacagtataatttaaatatatataaactatattattttgctataggataatcttagagcatcaaaaggcatattctagatcagaagtttgcagacttttccttaaagtgtcagattgtaattattttaggtttgtggaccatatcatctttgttttgatgacttgtagaggaaagaaatagatagtaccttaataaatgaatgtggctgtgttctactatgttgttttacaaaatcaggtggctggcccgtaggccatagtttgctgatctctggtttagatgacatagtagttaaatgaccacagtgcattgttggataatgtttgtgagtgatgctttagcacccagctaaagctgctaaaggtacccaggccacctatgtaaaggaaagggtttataaaatttctagtttggaaaacttgtttctatgactgataatgacctttttgttttacagccatctgtgagaaagacacactgcagtggtaggaaacacaaagagaatgtgaaagactactatcagaaatggatggaagagcaggctcagagcctgatcgacaaaacaagtacatttcagtgtcttgttctgatgttcttgatgtggtaaaatggttccattctttctcaaatccccgtctctctgttgtttttcacagaagcaactcattctgagtgataaatagcgttctgatgtgttgaacaaaaggattagaaggttgtcggtttctcagggaatataggaacacattaatattattgagattagagcaaaatgtattgcttagattaggaatggtggcagaggagaatgagttacctaatatttctttattcacatggactagattttgtagcaaatttgtatgaaacctcctttgtagtgatcgttgtttttagaactattttctttttatagtagaaaaaggtggaggtgggtttatcgttaccttcagagagtctgagagactttgagtttcttattcttatagttctgacaaagataaccagtcaagaaggaagtaatggatatgacataatgatctgagtatgttttgacctctgtcggacattccatactctttttcttttgttttatgtaggctccgtgccagcatggagtccaacacttgtttgaactaactaccgtaagattaagacttgagctgagatcaagagttagatgtttaaccatctgagccacccaggagctcctctttttgtttatttagggaaatttttgtttaggctagttgagttcaagacactgacagaagatgttgcatttctatcttagatcattctggtgtgtttgacacatggcctttcttagttattcagagctggcaggcaaatgtgggctttgatggtgttgcgattttaaggaaaaaaaaaaaaagcttatggaaaatctcaaagtagaaaggttaatgaatgagactcccatggctgacccccacccctgatttccatcacctagttgtaacagtcttgttttgtttaaacataggttcttgggatccctgggtggctcagcggtttggtgcctgccttccaccctgggcatgatcctggagtcccgggatcgagtccaacgtcaggctccttgcatggggcctgcttctctctctgcctgtgtctctgcctctctctgtgtctctcatgaatacatgaataaaatctttaaaaaaaataaaaaataaagaaataaatgtaggttctcaaacttagcactgctgacatttggggctagataattctttgttgtggggctgtcctgagcattttaggatgtttagcagtagccctggcatctgcccactcgttcccagtagcagttcccagttgtgacaactaaaaatgtcaccaagcattccccggtgtccccagggggtcaaagtgcccatagttgagaatacttttatcttctccctttctccatcctggattactaaggagtaaactcagatattgtcccatttcattagaaaaaaatatattataatgtaatctttttttttctatttgaaaatatgttagaaattttttggtattaaaggttagaattatattcatttacttattttctgtatgaagcaaaagaatttaggatgagtaaatgtttttgatggattatggaagagagaaggcaagccatcagggacaccatgtgctgctgtccatgattatgttggctttgagtccgctgtctactcctcaatctttacaagttgttcttctgcttagggtgtgggaagtgacattttgattggaaaagcctttgttgagctatgatcccctatagagcacaggctctattcagaggcatatgaatggctagctttatgtaaatctctactgtaggtcattttttgggatctgacctttaggagttggcagtgatttgcttgagtaatttgacctacgttgtactggtcgggtagaaagggactggactgcagattgcactgaattggaaagggcttatatttaggaatagctttctgagtgtatattttactttttcttttttctttcttttcttttcttttcttttcttttcttttcttttcttttcttttcttttcttttcttttcttttctttttaagattttatttatttattcatgagagacacggagagaaggcagagacagagagagggagaagcaggtgcctccaagactccatcttggaactctgggatcacgccccaggccacagacagacgctcaaccgctgagccacccaggagtccctatattttactttcatttagaatttttatttattggggcacctgagtagcttagcggttgggctcctgcctttggcttgggatgtgatcctggggtcctgggattgagtcccacatcgggctccccacagcgagcaggcttcttcctctgcctatgtctctgcctctctctctgtgtttctcatgaataaataaaaaatttttatttatttttttattttattttattttattttatttttttaatttttatttatttatgatagtcacacacacagagagagagagaggcagagacacaggcagagggagaagcaggctccatgcaccgggagcccaacgtgggactcgatcccgggtctccaggatcgcgccctgggccaaaggcaggcgccaaaccgctgcgccacccagggatccccttattttatttttttaaagatttatttatacgtgagagacagagagagagagagagagagagagagagagaagggaggcagagggagaagcaggctccatgcagggagcctgatgtgggactccaggattacaccctgagctgaaggcacgcgctaaaccactgagctacccagggataccctaaataaaattttaaaaaatttatttcttaattttagcttcagtatagttaactgagtatatattttagtatttatgcgtgacttctttgtaaagctatatataaaatatcttcagtttcttttgttttcatttgtgcctcatattgtctgtattagatattttttcagatcagaatctccttctgggcaggctcttgctttaaaatttttgtttcttttttttttttcttcttttttttttttttttttttgtttcttttttatgtctcttagctcagtatattaatttcaaacctaaaccaacatatgaagttttacaaagcctggcctttgggcagatacacactctttttcaaataaaactgtgaatggttcacactgtttgtaaaccacatctactgattaaagatgactgcgtctctttgctagacactggtagattggaggtcttcattccattctcctgttgataattcagccatagaaatgctgactaaataaaaataggttaaaaaacccaaatcaataaaccaatcaattgtaatttttgctggtgaatttctatgattgatttaagaactatagaggccatgaaataataatcttaaatgaatactctgtaggtaaagtgaaataattgagaccattaaggattttttgatttttaaaagattttatttatttattcatgagagacagagagagagagggaggcagagacacaggcagagggagaagcaggctccatgcagggagcccgatgtgggactcgatcccaggtctccaggatcctgccctgggctgaaggcggcactaaaccgctgagccaccagggctacccaagagaccgttaaagatgtaaaagaaaagtgttattttatcaattgggttgttgagttcttatttaccgtgtggtgttttttatctcactctctccaaagccgctgcatttcaacaaggaaagatacctcctactccattctctgctcctcctcctgcaggggcaatgatcccacctccccccagtctccgtaagtttacagtttttatcttaacagccataacttaaggggggagattatcctttgattttgttagattatcttacagttgacttttgaatgcttattgaatgaatatataggtagtaaaaaaaacaacttcagtggtatcatttctgaaatatcatcagagttgccttctgatcaggttattactaggatattgtatttgtgacatcccatgtggatctgagaaattcagtggaaaggtcagactgtctctgtgattagacgacctaaaatatgaaaaggtatagatgagtacattaaattatttactgctgtgaaccccacactggaggattaaaactcttcagtctttattttctaacccacctgggaccaatatatattcctttggaaagacaagaattggacaagaattggacagttgaaagtggagtggagagtggcctctcctctctgtgaaggtttttgtttctgaatgacagaagagtgagtaactaggctataagtttcattgatctcctgggagggcttagactgtaattgaattcaaaaacctaaacttggtcctgtaagtaaccatggatatgaacattggagtagtctgtttatagtagctgcacactaatgtaactagaccactaatgtacttacgccatcctgggaacaggttaggccttgcttgagtcacaacagctctcaggtcacctctctgtcctactctgtattttggctagctggcacccaactccattatttttagtagtgaaataatctatactattaatgtaccataattagcctcaccattttcatattgttggacacttaagttccaaattgttgtaaataatttcgtcaagaatatctctacatatgtttttcataatttaagtattttcataatttaaggatttttcttttaagggttttatttatttattcatgagagacacagagaaagagagaggcagagacacaggcagaggaagaagcagactccatgcagggagcctgatgagggactcaatcctgggattccaggatcacaccctggggtgaagttggcactaaactgctgagccacccagggatccccattttcatatttctaaagaatattttaaatattttgatattttgaaaaacagatctgaaattaggtacttctggttttagtttgacaggaactctatagaaggcataattcttaataattatgcttagaatattaataataattctcataattctttttaaaaaggaatttaaaacattaaattttcgggatttttttttttaacctggagaacctgacttcattttatacttctgtctagacagtcttattcttgttttttagacataaagtgattaaagttttgtggcatattgatttttgtggctttactgttataaaagaaaccataagaagtctattgttccagaacttggacaggaccatgaagcccaactagtttcatagaagagaaaaaaaatattaatatgtaagcctatcttaacctccaccctcgttcgatattccagcgggtcctcctcgccctggtatgatgccagccccccatatggggggccctcccatgatgccaatgatgggccctcctcctcctgggatgatgccagtgggacctggtgagtttgaatctctttccttttaggatgctccattgtgtttcagttctccatttaaatgtaattcttaattcattgtaaataataggtttagtattattgcaacaaattatatttggtgaatatgtaatgatgaaaagaaataattgttttatcagtataattgaatgctacccaaagacctatgctactaaaaccaggataaagctgcctttttttttcttctcttcctccctactgcttacttgcctcctcctgacttttggccatttacaatggagaaaaaagtaaatgagtttgttccaacgggggtggggggggtggataaagggcacggtaggtaaatacttgtgctgctacttttttcagttttgatctagagcagagctaccttgttgctgatttaatcttgctggttaaataagccaaattagtatatgaagagggccttagcactgtagttagtcaggaagggtgtaaagatacctcaaacattttattttaatataaataagaatgtacattagtttgcagatttatctgaaagccggtcagggcctttgctttgaaaatgaggctactgatttaagcaccatatatttttttcccttttttttttcatatatttctttcctaaatcaataatccatatccataatatattctttaacaactttttttcattttctttcaatgttaaaacccttgtgaggcagtctagttctgatcttttatgatcctcttatccattaaatttgtgagcactttttgggatgatttacttgagttttttgaaatatctacttagttttcatggaaacagttctttttttatactcattttattgattgcagaataaattatgtaattagagtaaatccaatgcccataagaaacctacaactcaactggttggacaaggtgcaaaagtattagagtagctttccagccagaagcattcagtgtgcttattactgtgggtatcatttagagagatgttaggagagtctacataagagctcctgccttactgccttgtgaacccaaaacaaggtgacttggcttcttttgcattcttatatcaggatcacaaattcagattcttcgaggggttaggaatgtggtcaactggtcaatgcatgacacacctaaagaaggcttctagaaactcagcctcagcctgtggttgatatttgagaatgcaggcttggtattgccagttctcctgagtattttgttgttgttttcagccaggataaaataataagattatttaaattaaaataattaagtagttgggggtgggcaggtataagatagaaggttggggggatccctgggtggcgcagcggtttagcgcctgcctttggcccagggcgcgatcctggagacccgggatcgaatcccacatcaggctcccggtgcatggagcctgcttctccctctgcctgtgtctctgcctctctctctctctctctctctcgctctctgatgactatcataaataaataagttaattaaaaaaattaaaaaaaaaaaaaagatagaaggttggccaggagtgaataattattaaagctggatgatgggtacatggatgttttttatactcttttttttctattcttgtctatgtttgaacatttccataataagttgaaaaaaagaatctagagttactgcttactagtgattagatttagtagttgctaatgttggcaattaattacaagtaaatgccctgtggagaccaaagtaaacaacttttcaggtgccttgttttcaatctttggcctggatgagtttcctctaggaaatgcagaatatgaattatgttatagtgggtttttaaagtaagatacttagaagtttagtagtattctctgttcctgttgatcttaaaaaattctgtacctgttttgtctttgcatatacttgtgttttactttttatgataagactgtatttgactttgaatatagttttctcttgaaccatttattgcaagcctttaattaaaatggtttaataagtaattagggaaatttttatatttaaaagaagacctgaaaattatgaggcataataataaaatgaatacccgtgaacccaccactcagctgaggaagtagaatatctgtgaagctacctatgctcttccccatcttgtcctcccttccctagctcatatatttggctggtatattgatgggacacctcaaaaaattccttaacagtttctaaaatgcattagaaaaccagatttttgtgtgtgtgctaattgttgtaaatcacattattgcttatctttcttgacttgagctaagtatggttactaacaggttctcagcatgggcctcctgctcacctttcctacaactccgaacaaacgcttagtggtaagattgtcctccgtgcctgtgtacattcatgaaatagctcctggttttatggtgaatagaactgattaaaaatgctgactgagtaacatgtgatttagttgtgaatttccctgagtgagaaaaggtcaatgtagggaactagtatccctggtggtttctgaaaagcagtctattaatagtttccccctttactatcattatatcatgattcccatatggttcttctgttgacctttgttttttgtttgagaatgtctaactaatttacagatgtgatgaatttgttgcatttcttctgtcaagtatgtctttctttcagcattttgcggggggggggcctacttttttgtctttaattgaagtcccatcaagcttgctcataagtaatattttctgactttttttttccttttctttgttttgtcctgcagctcctggaatgaggccacctatgggaggccatatgccaatgatgcctgggcccccaatgatgagacctcctgctcgtcccatgatggtgcccactcggccaggaatgactcgaccagacagataaggagagacaggaacctctttatattcattttatattacttgttctacttcaccaggagatcatggtgctgtgactctgggtgttttctaacagcatgacaaggaagacttgcttccccttcctattgagaatagtttttgcaggggagtagtgagacaaaaaaaaaaaggcaattttcatttgtattgtgaaatgtgaaaataaaattgtcaactgttttagttaaaaacatgttcccttttttctctcctctgtattccttgtgtattataaaagagataaagtacttcagttgtgtttctctagcacattatctctgcagcatgccctccacatgacattctttttccttagctatagtggttcttttggacaacttgcctttatttagtaaagttctcttgtgcaagacttggtaaatctaacacttgtagaactttttgttgattaaaacaacagcacaattggttactttttcacatgaacaacacttggtgtattaagtggaaaatttaaaatcttttatgccgcagtaggaaaaaagactttccagtctgtatatgtcagctaaagttggcaagaactgccttaacctcagcttctcctttctcttagttcctctttttcttgggcttcaataatcagaaaactttctaatagcaatggtaaaattatacagatttccatggtaaagaagttgtcttcagaatgtcctttgttaaattactgggctataaaagtaggatatcagagaaacacctagaaagtaagccattgatattgtttatattctgctcagtgtaaaagctaagctttttcacattgcaaatgggagtgaaaattactatacttggggagggcaacttagcaatatctgtaacaattatagtacctttgacttaacatttccatgcctaggaatttatcatacaagtagacttgcgcatgtacaagatgacgtgagtataagactgcattgtaacacaagatgggaagtaacatagatgcctactgaagggggactgatttatcaagtatgatacaaccgcaaaatggcatatacgccaagcaggttaaaacagaataaagaagcctatatatactgatggggaaggagctccaagatacacattgtactgaaaattgatttgttcaaaatgtattgtttgctatctttagaagaaatacccatatgttcctgtggatgcatgaaggctctctagaaggacagataagcaattggtaatactggttgcccgtgaagagtaaatggatggctgggtggggacagggatgaatgaaaaaggcttgtcaccttttatatcttttagattttgaatcattacttataaaacaaattatctttgccatctgatgttattgttacagtgatgttatggcaaaggtgccctaaaccagcagttacaacctggctgatgattagaatcatgggggatcttttttaaaagtaaggattgcagattttgattcaatacatctgaggtgaggcttaggaagttggcattttccagatttcaggttgtactacaaagctgtggttatcaagacagtgtggtactggcacaaaaacagacacatagatcagtggaacagaatagagaatccagaagtggaccctgaactttatggtcaactaatattcgataaaggaggaaagactatccattggaagaaagacagtctcttcaataaatggtactgggaaaattggacatccacatgcagaagaatgaaactagaccactctctttcaccatacacaaagataaactcaaaatggatgaaagatctaaatgtgagacaagattccatcaaaatcctagagaagaacacaggcaacaccctttttgaactcggccatagtaacttcttgcaagatacatccacgaaggcaaaagaaacaaaagcaaaaatgaactattgggacttcatcaagataagaagcttttgcacagcaaaggatacagtcaacaaaactcaaagacaacctacagaatgggagaagatatttgcaaatgacatatcagataaagggctagtttccaagatctataaagaacttcttaaactcaacaccaaagaaacaaacaatccaatcatgaaatgggcaaaagacatgaacagaaatctcacagaggaagacatagacatggccaacatgcacatgagaaaatgctctgcatcacttgccatcagggaaatacaaatcaaaaccacaatgagataccacctcacaccagtgagaatggggaaaattaacaaggcaggaaacaacaaatgttggagaggatgtggagaaaagggaaccctcatacactgttggtgggaatgtgaactggtgcagccactctggaaaactgtgtggaggttcctcaaacagttaaaaatatacctgccctacgacccagcaattgcactgctgggtatttaccccaaagatacagatgcaatgaaacgccgggatacctgcaccccgatgtttatagcagcaatggccacgatagccaaactgtggaaggaacctcggtgtccaacgaaagatgaatggataaagaagatgtggtttatgtatacaatggaatattactcagctattagaaatgacaaatacccaccatttgcttcaacgtggatggaactggagggtattatgctgagtgaagtaagccagtcggagaaggacaaacattatatgtcctcattcatttggggaatataaataatagtgaaagggaatataagggaagggggaagaaatgtgtgggaaatatcagaaagggagacagaacgtaaagactgctaactctgggaaacgaactaggggtgttggaaggggaggagggcggggggtgggagtgaatgggtgacgggcactgggggttattctgtatgttagtaaattgaacaccaataaaaaaaaaaaaaagtgaaaaaaaaaaaaaaggaagttggcattttgggaaagctccctaggaaatttttaatattagtgggtttagcaaactcttaggatttattctacaaggaatgtaatactggatgtatatgtgtgtctataatttttcatagatgtgcggtagaaattgaaatggcaataggtggatggctttttttcctagaaacttgtaaaagggctactataggcaaatgaacaacctcctctaggtaaacaagaggctagaaatagagattctgacaggtgattttatgcccagcctctataaagctgagtcagcttccaaatctgagcctttgctaggactacttaattgctttttaatatctcattgttacatcttttaaagaaggacttactagaaattgatagtttatatatctgagttctgtggctcagatttgttataaaatctttgtagacttaagatatgggaaaccttgccaactgagcttacattgactcagcaagtttctggcttgatgctctgtcagactcaaggtgcagagggtgtctttagtgtatacatagaaagcttacaggtacctattttgctttttaaaatagcctcaggtatttcctaaaaggaataacccaggtcttcctaaaaggaagctttttccaaagtatgtttttaaggttgactatccattccagaaacatttttttctttcaagatttcattttttttttttttaaagattttatttattcatgagagacacacacacacaccagaggcagagacacaggcagagggagaagcagagggagaggcagagggggaagcaggctccatgcagggagcccaacatgggactcaatcctgggactccaggatcacgccctgggctgaaggcaggtgctaaaccaccgagcgacccagggatccccccaaaatttcattttttaagtaatctccacacccaccgtgggctcaaactgacaaccatgggatcaagagtcccacactccactgactaagccagctaggtgcccagaatcatttctttgaagaaagtattttacatagttttagaaaaacaatacgatgacttaaaagtttaacaaactttacaatgaatgtatgtagggataaatagttctaataaggttctttttgtcttttaagtcaaactttatagttaatgaatataagatacttcctttgtaagaggctatgaagaatacaaacaatgctgttggtctatgcctttaagcatctggttttaattgtaaaatatgaatcaactataatgtgggaatttgtatagtgcaaacaagaatgccactagatctcaagaatcaaagttagtttagatgtgggcttaacacacttgctttctttctgtaggcaaatccaaagtcataggagtgcatttaaagtccaagctagcatcatttccactgtcttggctttagtggtttgtcagaatgccagtctcctcaattcccagctgcacaagaaacgggatccttgcatagaaccacaggctaatttggtcatcctatatggaaaaagtccagtggtgattaagtgtttgtcccaattaaatagcttcagtcagatgatatctcttatttaggctcctagatatatttagtgaacaaaagaaaaaagcctggctgccttagttttttattatagaagtatcctgaataaatgctagctaattggggtaatttttttgcctctcaattgaaagcctaagggttagattttctggcacagaatcaaatacagtatctaaagtagtttgtcagctgcaggaataaggtaaatctgaatgttgcttactgtccttactctttaggcatgagggatttcagacttaaagaaaagttggcaagagctgtacaaagaacacttatataccctttgaccagaatcaccggtttgttgtcagctattggcatcttaactccatttgcttatttgcacgcatgttttctccctctcgcaatatatatgtatgtatgtatttcgcctgaactatttgaaagttgctcatatcataccttttaccataaatgcttaagtcggtatttcctaagaataaacacattttcttacacaactgtggtttagttctcaagtccagcaaatataaccttgactcagtaatttaatctgccagtcacatttcatttttgtccagtggtctgacattgtccttgtatttttttttcccccttttctgtacaggattctttgcagaatcacgtactttattttttggtcagatgtcctttgtctcctttaatctagaataattctcagcctttgtcttttatgacgctgacaatcttaacaaccttctgttcaatatattgttcctcattcctcattttgggattgcctgatgtttctccgtgattatattctggacatgtcctcattgtatccctaggatatcacatctgtaggcaggctcacaggatccatctgcctttcattggtgatgataattttgatcaaaactttaaaaattttgttgtgtactttgatacatatcaatcatatctcaatagagtcgttttaaaaagtcataactagggatccctgggtggcgcagcagtttggtgcctgcctttggcccagggcgcgatcctggagaccccgggatcgaatcccacgtcgggctcccagtgcatggagcctgcttctccctctacctatatctctgcctctctctctctctctctctctctctctctctctctctgtctctgtgtgactatcataaataaataaaaattaaaaaaaaaaaagtcataactaccacaaactaaaagactactctcaagaaccattagtaataacctatctttgctattcagcactctaaaatcagttaccatgaagaagaacaagttagcagttgctagaggttagaggttagtggtggccagggattagggtgttggggtgaggagagcaggaaattactataaaggggtagcatgagggagatttttgtagtgatggagtagtctgtatcttgactgtggtagtggttatacaagtctacatatgataaaatgatggaattatacacacatatcagtacaagcatatctggttttattagcttcactttattgtgctttgcagatactgtgttttttacaaattgaaagtttgtgacaactgttgagcaagtctgttggtgccatttcacgttgtgtctctgtgtccattttgttaattctctcaacatttaaaactcattattgtaatatttgaattgctacaaatctcataaaattttaacagatgaggagttgcttcttactgatgagcaagatattttcttgatatgaaatctactcctggcgtagatgctgtggagattgttgaaatgacaaaaaagattagaatattacataaacttagttgataaagtagaggcagggtttgagaagacagactccaattttaaagacctactatgggtaaaacaccatcaaagagcattgcctgctacagagaaatcatttgtgaaaggaagagttaattgatgtgataaatttcattgttgtctattttaagaaatggctacagcctctccaccctccagtaacaaccaccaccttgatcagtcagcagccatcagcgttgaggcaagactttccaccatcaaaaagattataactctttgaaagacaaggatggttagcatttcttagcaataaggtttttgtttgttttttttaagtaggctccatgcctaacatgggggactcacaaccctgagattgagagtcaccatgctttaacgctgagcacccacacaaaccagcagtaaggtatttttaaaaataaggtatgtatataattttttggacataatgctatcacacacttaatagactatagtacagtataaacttaacttacatgtgctaagaaaccaaaaaacttatttgacttgtcttgtgatacttcgtttattgtggtggtctggaaccaaactcaacctgcaatatctatgagatacgcttgtatccatttcctgaattttatgttgtactctagttatataaggtgtaactcttgcaggaaagtgggtgaagagtacataggactaatctgtattatctttacaacttcttgtgaatctgtaagtcataataaaacattaaaacatttttagaaacatggacttatgcttccagaaagatagaattgatgatgtacttttccctattcctactgctaagtacagctaaaacactggaatgagtgtgtgtgtgtgtgtgtgtgtgtatgaaaagcataagaagactgaaaggtgaaaagaagtgagatctgttagagaacttgggacccaaggaacaactaaatgagctctggattttctttttgcttcatatataccagactttgtgctgaaggagctggcacccagaaacagtgatgtgccacagacaaaaaacacctccagaagagcctgctttctgaagttcaaggactagataagaggttagcaagacagaaaacttttagataataatcactctgctccagccaaacatcacagggaatatacaatatagatacccagggaatatacatactcccactcatgccatcctcgtgggaagcttattcttccacccttccccaaactcctagggtggtatcagaaaaagccaaatagggagctgagattatcatcccctattaggcaataacaagccctcccgagagtcagaagagggctaatcaggactttaaggattttcagcaatgtccagtggtaatgaggctgcatatacccccatgtcagtggaggccttgtgagaagcattaataaggcagtctgctataccttgctaggaaagaattagctgagtcctactagagagtcagaactcccatcttagcagtaataaggaacccttccctgggtgtccaaggaggctaattgtcaacctggacctctgttttcacctgaccataacaagaggtcccctcccccttttgccagaccagtgtgagaaaaagcaaaacagagggtttaaataagatcccaagtcttagaacataatatgaaaatgttcaggtttcaatctaaaatcactcatcataccaagaatcaggaagaatcaaattgaatttaaaaaggcaatcaattgatatcaatgccaagatggcatagatgctggaactatttgacaaggattttagagcagccatcataaaaatgcttcaatgagcaattatgagtatgcttgaaacatgaagaaatagaaaatctcagcaaagaaatagaagacgtgaagaagaaccaaatggaacttttggaaccaaaaattaagtaaattcagtggatggactcaacagcaaacaatcagtaacatgaaataatcaatgaacttgaagatagaatactaaaaatatctgatgtgaacaacagagaggaaatagactaaaaaaaaaaaaaaaaaagcaaatcttcatgggcctgtggaactataaataaaagatttaacattcagggatccctgggtggcacagcggtttggcgcctgcctttggcccagggcgcgatcctggagacccgggattgaatcccacgtcgggctcccagtgcatggagcctgcttctccctctgcctgtgtctctgcctctctctctctctctgtgactatcataaattaaaaaaaaaaaaaaaaaaagatttaacattcatgttgtaagagtcccaggagaagaaataaccaaagaaggtactggaacaaatatttgttgaaaatgtcccagatttgcaagaaacataaacctatataagaagttgagtaaacctcaatcaggataatcttgtacttttcaagattttatttttaagtaacctctgcacccagtatggggcgctaactcacaatcccaagatcaagagtcacaggcttcactgactcagccagctgagcagtcttcaatcagggtaactcaaagaaatccacacatcaagatatgttggaatcaaacttctgaaaactaaagacaaaaaaaaaaaaaaaaagaaaatatccagagaaaacgacaccttattcttgagggaaaacatttttgaaggacagatttctcatcaaaaattatggacgcccgagggaagtgcagcacttctttcaagtactgagtccaatatccagtaaaaacgagcttcaggaatgaaggggaaataacaaatgtcctctgatgaaggaaaactaagagaatttattgccagcagacctactttaaaagaatggctaaaatgtctcaaaacaggaaacaataaatgaatgaatcttacaacatcaggaaggaagaaaggacagtaagcaaaagtatgggtaagtgtaatagaccttactttttttgagttttctaaattattttggatggttgaagcaaaagattgtaatattgattaatgtagctccaaatgtatgtagagaaaatatttaaagcaattatacttctgggaaggaaaagagaccgaaagagaggtcaaatttctgtacttcacttaaattggtaactggcaatacagtaggctgtgatcagattatgatagaaataatgtaataactagagaactaaaagctgtgcacctaaaagttaccaaagctatacaaaaacattatggattcaaaattatttcaaaacttcttacaaagctacagtaatcaaaacactgttactggtgtaaggatagatacagatgaatggaacagaaatgagaatccagaaatggattattgcttttatcagcaactaattttcaccaagacattccaatgggaaagattattcttttcaacatatgatgctaaaataactagaaatccacatgatagataaatgaagttggtcccattcatcacatcatatacaaaaaagttagctcaacatggataaaattcctaaatgtcagagctaaaactgtacaacttttagatgaaaacatagatgtaaatcttcctgaccttggatcacaactattccataggtgtaacaccacgagcacagcaacaacaacaaaaaaactggatatcatcaaaattaaaaaattttgtgcttcagggctggctcagtcagaagagcatgtgactcttggtctcagggccgtgagttaagccccatgttgggtgtagagattacttgaataaatacataaactaaaaaaaatttttttgtgtgtacttaaaaggacacacaggaaaatgaaaagacaactcacggaattggagagcatttttgcaaataatatatctgacaaggaacttgtatctagaatataaaactgcagctgaatgataaaaagacaacccaatttaaaagggacctgaatagacatttctccaaagatatacaaatggcctataagctaaaagatgctgcacactattagccatcaagaaaatatacgcaaattcttaagcaaacattaacaaatataattcagcaatatatgaaagtaatatacaccaggcccaaatgagattttaaggatgcaggctggttcagtatttgaaaatcatcagtgtaggagtgtgtgggtggctcagtcagttaaatgtctgccttcaactcaggtcatgatctcagggtcctaggattgagtgccctgctcagcaggaagtctgctctccttcttccttggcccctccccctccactcttgcattctttctctcaaataaatatctataaaatcttaaaaaagggatacctgggtggctcggcggttgagcgtttgccttcagcccagggcgtgatcccggagtcccaggatggagtcccacactgggctccctgcatggagcctgcttctctctgcctatatctctgcctctctctctttctctgtgcctctcatgaatatataaataaaattcttaaaaaaaataaaaaataaaatcttaaaaatccatcacgggactccgggatggctcagcagttaagcgtctgccttcggctcaggtgtgatcctgggattccaggatccagtcccataccgggctccctgcatggagcctgcttctccctctgcctgtgtctctgcctctctctctctgtgtttctcatgaataaataaataaaatcttaaatccatcaatgtaatctaccatgttaacaagctgaagaaaagtcacatgaacataacattcaatgcagaaaaaagcatttgaaaaaattaaattcttgataaaaactcaaaaataggaatagtggagaacctcctgaatttgataaagagcatccacaaaaaaatgtacaattaacatttatactttatacttaatggtgaaagactgaatgagtgctttttcccttaagattgagaacacagagtatatctactgtcactgtaacagcattccaactggtcttaagggttaacttccttccagttcatgcaccccttgcttgctgactgaagtcccttggtctgtagtagacctaacataatcttgagatttgcagaccactggccttgagtgaaggatgcaactttcccagaagataaagtctgactaaatttgaaaacaattgccactgatgggagtaaatatgttcagggtcatgtcaacaaaggactaacctttggctgggcacttgtttcttctgcacatagccctcctccctttacccatgacttctccttttaaaacctccagtttcccctcggtggagagcctcggtctttgagatgttagtccaccatctttccagggggccagcttcctgaataaagcaacctttcctttcccaccatgacttgtcttctgagtattgattttcaagtggtgagcagccgaacctgagttcagaactggttctcagtttatcaccagttctgctacacaaagtgccaggaattgtggcctgcttaatagatgaagaaaaggaaataaaaagcattcatatcagaaaggaagaaatgttctgtatactgagtgtattaatgtcaatgttctggttgtgatatactaaaagttctcaacatgttgccctttggggaaactgagtaaaggacacaaggttctctttgtattatttcttacaactaagagttaatatacaatcatctcaaaataaagtgttttaagtttaaaaaatgtacggattgggcccaaattcctcttatttttgtatgctttgcagtcttagtattgcagggaaagataaacacattcaaactataggttagagtatactctaagtaattctcctgactctgtctctgcctctgtgtctctcattaaataaattgtttaaaaaagcaatttggggataacttgtagggaaaattgaactttccataagatacacataggaatgcacgaagtttgtagattgtttaaaaaatttaacatttatatagttgaccatgcttgaactgcctctggaatcaggtaacattgtattatgtgcatatattacctagtcacaaaaatgaataggtggccagatttccgataagcatatctcagtattttactcaggtttttgtcataagattcaagtccagaaagctgccaccttttcaccttttgacaggttttacaggtgtccccagcatacggattacacttgaaagtgtatgaacgacatagaatggacgtaactctggatccagaggaagaatccttgagtcctcaccctgagtttcactaagtagttgtggccttgggcagagtttttcaactatttttcctaggttcagttccttatgtattgagtaaacatttgcctattggttcgcctggcggaggctaagaggggcagagagaagatggtgaggtgctccctccccagctctttcgcacagagcagcagaccgaggtggttgtaagggccggggaggttcttgagaccacttgtcactcctcagcccgattcccggagtagagttagtcggtgctcagcaagcaatgatgaacgtgcgaaggaaatgaatgagaaatggacggggcactgcgcaattgtctagagaattcctgcaaaaaattacaaacatgcagcctttcccgtacgcttcaaagcacctgccggaacctgacacacttcagaggggaagactttctggtctcggtgggtggagagagaggcggaccgcgcacgcagcgcagggagccagcccggagccgcccccgccctccgcccgccccgccccgccccgccccgctccgaaccgaaccgacccaaactttggtccgactcgctcgtggctgcgtgcgacgtcccgtttcgacgcgcctgactcagacggaggccagccggacggacacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctttccctccactcccgcagcctcccgacgcctcccgcgctgggtcaccccctcctcgccgcgcgcctcctagactgcccagacgggccccggggaggtgaggtctcccccggctgcgcgccccctcgtttcctctccgcgtcgccggcccctctgcccgcctctttgcccgccccaccaccccctccgctgcttcctctccttcctggtaccagctccgcaccagactcttcatgctccggccccttctaaataacccattttctgctcggatttccaactccagcactggtgctctgcctccgaggagctccagctcctccacttcttggtttggccgaccctgttgcttcacccctgaagtggatacgatccttacacccagggccgttccctgatctcttttctctctcctttgcttctcttctcgttacacagactaaatggagaaaggtcatgagagttgggcataaagtttcaacaaccttccctttaagatgtggaggatttttgacagcctgtgaaaagaattaaccaagtccacttctctgcagccatttattaagctgtgttatgtctctcagtagttttgtcggtcaaaaccgttttcaggtgtgcctgggtgactgctgactcctgtgcgattttgcaggttgtcagaaccgtgtccacaaaaattggaagcaagccttccatttcgtttccactctttattccaggcaggtgttggagatgccttaatacttttagccagccttgtatctcaaggggagggtgattctagccttgtccacgctgctttccctgaggtaggaataggggattggagccagtcaacaggggacacaggggccttgcactaatctgccttcctggtgttctcattgcctccgtgagtgatatgtgagacacttttgctgccactgcatcccttttttggctgacactctggcttatttactgttgctttgattttagactttaattagtaattagattcagatacacctgttggttaatcaccatcctataaaagtaaaagcgaattggaggctggagccagaaggtgccttcagaccctttactctgattgactatctaataaattctttcttaggtagcattcatctgggtgttccatgaatttggttgtagaaagatttaaaagtaggactagtgattgtgaaattgtatagaaaatttaaaggaaaactgttcatttgaatagagtcagagcattttaggatttagagatgatctaagctaacatagcgttgtgttttagagtccagactctttctggtttactttcttcaattgtaaaatgaggataataataatctaactcacagggttattatttttttaaagattttttatttatttatttgagaaagatagaacatgagtagggggagggctagagagagagggagaagcagacttcctgctgaacagggagcccagctcaggctcgatcccaggaccccaggatcatgacctgagtagaaggcaagcacttacttaacccactgagccacccaggtgcccctcaaagtgttattttgagggttacatgaataaatatatgtaaagacttagcacagtgcctagcacatagaaagtgcccaataaaacaggagctatagttatttttggggctaccacttgtttgacagtttgatataagccatagacttctccagaaaaatccacatatgcaaataggtagttttttatgtaaattctgggggagagttttgaacttcaacattacatgcctgaatcctgcaaggcatcctggaactaggtgaagaacccccgactagttccactccctcattttatgtctgaagaaactaaagcctaaaaaggataaacaacttgcccaagttgcaatggaaggtaaggtagtgaaaaagaacctagctttttttttttttctttctttctttttgttttaaagattttattatttttaagtaatctctatacccaatccagggttcgaaatcatagacctgagatcgaattgctctttccaccgactaagccaggcacccctagaacgtaggtttctaattctggtatgttttcccctttagtgcacatgtattctctgcattcgctatgagtatagagtttttaagggaaaattttaatatgatttctttgggagaaatttctggtttcctcagtgttgtgtggttgactgaggaggaagaggaagagaaggttattttgggctgcagcatcagggctccgggaaaaggtggtaggacatggacctggaagatggacggtcaaactctttgggcctttctatttgtttatcctggaaaaatggcctaatcatgtatgacatttgtatctctgtatggtctctatgatacctacagaggctggcccacctggggcggaattatagcttccttggcttgccaaatctcatggggaaagagaagagaaggtatatggagttactatgttaaataaacatttgtaggtgtttaataattacttgatgatgatagtgccacttgacctggaggagagtgttttaacagcaggaaggatatcccagtgactctcgtgtttaattttggtcatgaagtttcggacattactaatgttttgttggaatgcatcttcgttagtagtattctggtaaacaagattggagggaggtggtcttcaagatattttctttaagttcctgcactaggcccaggccctgatctgggcaccggggattcagcagggaagaaatataaacatcttttaagggctttaacctatcgtttggatgactactgtgtagtacaagtagctgcaatgcacagtattcttttaaatagacccaggaagagacctttgcttagaaaccaaagtaatcatttaaaaaatagccaaaattgatttttcactaagttggattattcttgttttagcttaccttaactaatgacctttcgtaagaagaaatgtgattgattgtcaagtaagtcaagggactaaggctcatgggaagagtgtggactctggagccagagaagcctgattcaccctccagctctgccacttaatgaacaggtcagcctttctgagccttagttttcttatccatgaaagatgagaataaggaagaatgttacgtagctagcaaagttttttgagaattagggataaagtatttattataatactttatagcatataagtagcatgtaagtagggtttaataaagagtagctattataacatgactagagaagttagggacactgccatggtgttattgacagtaacctacctgactggcttttttagaaacctaccagaagtcttgattatttaaatagcagcaggaaatgtgactctaagtgacagaaacacagctgatagacatgatagatattttaaagacataagtatttggtgaaatccagaagcatacaatatttcagagtcctcttggaggataagagagcctgctgtgagctcagccctcttagttcctgatcagtgcctcccttcattattatttttcatcctgaagagatcttcatggccagctgccagtgaacagaggggagctacaggctcagagaggctgactgctagccccgggtctgtgtagggaaagatttgcaggagtagtctcaacttctaggtcatgcctctttgtactagactttatttattatcaccttcatttcctaaataattattttgttcatttcctagtgatggtcaaatcatatatgtttttgtttcccttctgcatttttttgtgttgcttcagaataaagctttttttttcttagcaaataataataaccaactgcaaataagcactttacatgtcttatgatgatgtaactctcagactaatcttatgaggtagttactagtcctactttatagttgaagaaatgaagcacagagaggttaagcaacttgccccaaatcataactattaagtggtggaactgagattcatatataaacacttcaattctctttatgactctgctgctgtttgcttctcatctactgaatatactcttgccaccagcatccatgtgaagaaacgatattgccagcagctatgaagccttcttgtgtcttcttctgtcattatctttactgagggatgaccactgtcctgagttctaacaacacatattagttttgtctgtttttgtacttcatataagtggaatcatatcgtatgtatgcttctatgtctggcttctttagcccaacattatttttgtgagatcaatccctattgttgaattaagttgtagatcctgcgtttttattgctgtatggcattctattatgtgaatatacctcaatttatttatataatgtactactgatggacatttggttagtttcccagtttagggctctcatgaatagtgctgctaggaacattctagtatatattctttgatgaacaagtatacacgtatctgttgggaatatacataggagtggaatttctggattataggatatgtatatgttacattttaatagatactatttttttttaaagattttatttttatttattcatgatagtcacagagagagagagagagaggcagagacacaggcagagggagaagcaggctccatgcaccgggagcctgacgtgggactcgatcccgggtccccaggatcgcgccctgggccaaaggcaggcgccaaaccgctgtgccacccagggatccctaatagatactattaaacagttttccaaagtggctatactaatttgctcttccactgaaagtgtttgagagttctgcttactcttcatccttgccaacacttggtatttttcatctgtttcattttagccattctggtggatgtgttttgaaaatttatttacttcagcagtaaaccagatggccactttgtttttgcctctgtttagttttaaaattctgatttatttgtaaattttagtcacaagcaaatgtcggaacactgaaaacaagatctttttggagcaatgttcaaattaagcaggttcaataaaaataattagggtaatttataactacaaacccataacatttttttttttttttttgagatttacttattcatttcagagaggaaagagagagcattcacggggtggggagaagagcagagggagagaaaactcaagcagactccatgctgagtgcagagcctgatctggggcttgatttcacaacccatgagatcactacctatgacatcaccacctgaaccaaaaccaaaagttgggcatttaaccaactgcgccacacaggcacccctagcccataacatttcttacttggaatggatctgaggcttagttccctgtcaaaatagctgtcatgtacattaagaaaaagggggtgctattcttcaggcatttgggtttttgttaaatatttggtctgcagactatcctggatatgaaatagttacactcagttctgtaagctgggcaccccatttgcataaattttttttatctttactaaagaaactaaagaaactaaaatttgaatttcatagcttttgtattacaatctttacacctttctagggtctattgtaagatgttgtctcacatcttaaaaggtagcatttaaaagcaatacagattcaaagcagtgcttgtatatgtatctgacacacaacagcttaatgtgtggtgcacaaagaatgaaattacctgctttgaaaaattgattgagaggcacatcaatgtagcagaaaaaactaggacttcatgaagaacattttccagtatttatgggagccccatactccagtagagtcaatcagtatctatagtaaaggggaaaacttaggtgtaaagtaatacacattagaatttaggtaaaagataggttgtttgtacctttttgccatagaacattgatggtgagaagtcagtatgtttaagtctcttacttatggatgtagtatgttctcagattctaaacttggtatttggagtgtgtattccagtagaaatagtgtattaaatgttgactaggtttcaagttagtccgcaaaacccataatgggttaactataatatcagctcagtagatggagttctgggtcttggttgttagggaaacatttgaaggaagggtggaggtgaaggagaggaagaaaaacgttttttctctcccatttcttggagtaagatcttttagattattgagatcattttatctcagcaaggagtttttatgcttgtgattaaggggtgtgaccagcatttagtcagcaggcttgagatgctgatatccagtttgctgaataatctcacacaaagaagcattgtcctttgtcatttttgaattttgaatatttgtttgatgtataggtgaattacccgtttatgtaaacctagaatctaattctgttgtaataaacacacaatattgtaagctttaaactatagtgaatgttctagacagcagctaccatgagggaaaattgttttgaactttaccaaatgtttgtcattattttagaaaatattgttactctgggcagcaccgctcgtggaattgaatctgttagggttgagaaacaccaatttacactaaattttgcaacacttgaagtttgctcttgatatactctctcttcccttgatgtctctttcctacctcttaaagccctcctcatggaccccatcaccccaattcttcccttagccctcctcacttttacaccaaaattcccagttctttaggttatatgatttcagctaagtcagcaggggatatggagatagtatttttggagcaggaatgctactctaattagaccaattctaattcagaatatgtcccacagggtcagctttcttaagttacagttactttcatagcttttaaatccacagatgctctggaagttcccagtttgcttttagttttccaaaaatggtttctaattggaaccattctatttgggatggagcagggggctgggcagccatttgtggcatgtatgagccctttgaaagttggagaattccaatatatagaaaatccagataagagttggctaatttcattcaagctgagtgtttccagccctctggtttagtgctttctcaggcagacctgaaaacatgtatttcccttttctaagagaaatctgtttttattttctatttctctttatttacttctttctttctctctctttgaagtctatgaaagaagggtctgcagttcaggaatacatttcatttgagaattatgtcttactagattgatgggaagttacaggcatggatggcagtgtattatgagatacccttttcctgaacctcagcagagtcctcgttgtctcccttcctttcaggtggagttggctgtggctccttagttctctgagcccacaggagagtttcctcagtctctttgaggaagatttgctgcaagatagttggatggtcagctgcagttggtgtgtcagccattctcaaagggagtctagccttcccccaaatagccccatactctgggctgcctttggggactctgtttctgagaccatttattcattgattctatcaggaaactttactgaccaccttaattttatggtaagagcactaacaactcgaaaacaaatgagaaaagattccctttcagggactccgctgcctaaagtaatagacctgtaaacagcccagtaaggcattaagaagtacctgtggagcctggtgggggggcacaggtagtcaggggctgaaaggtgatgccaggcagagggagttacatgagtaatggtacagagttgagaaacactaggggatctttaagagactacatatggttctgtgtcacttgtatgtaggatttgagggtggaacatagctagagataatattggaaagatagaggctgaatcatagatgcctgtaaactatgtataggcatctagatatggctcagcttgttctctattcccattgatctgggtcttaggcaactgaaacttctccaaaactctgtgattctgttcactttgttaaaagtgagagaaatggaggaaaaagagagatggtatagtgtagttaaggctgcaagttcttgagtcatgctacttgattttgaatcctggcttgctatgatcttggataagttatttaacatttctatgcttcagttctctcctctataaaatggagataatagttgtcttttatatcatagggtcattgagagaagtaaattaattaaaaatgtatattaaagtacttattaggatcatgtttggaataaagtaagcaaccattaaatgttagctactattttattttattttattttattttattttatttattttttttaaataatacatttattttttattggtgttcaatttgccaacatacagaataacacccagtgctcatcccgtcaagtgcccccctcagtgcctgtcacccattctcccccaccccccgccctcctccccttccaccacccctagttcgttttccagagttaggagtctttatgttctgtctcctgttagctactattttaaaaatagtttttgttctcagagaaatatcatccttctttttcattttcctgtttatttttttattataaaagcttctagacagagcttttagaatatactaatctctctctctccttaaaaaccttgcactttctaattgtctccaacaggaagggtatgccttctacttcagcttcacagataaatttatttccgtgtttacatatgacaattctttttattttttatttttttttacatatgacaattctttttttttaaatcattttttaaatttttttaaatttttatttatttatgatagtcacagagagagagagagagaggcagagacataggcagagggagaagcaggctccatgcaccgggagcctgatgtgggattcgatcccgggtctccaggatcgcgccctgggccaaaggcaggcgccaaaccgctgcgccacccagggatcccacatatgacaattcttaaacctggtttaacacgtctggtttatcagagtattatagttggtttacagtgtgtgaaagaatgtggatggattgttggatatgccctttagttcattccatctgttcgacaattatcatttatttgctctgtattatcaataaacattgattaagcattcttatcctagactttgtgccagacacagatctaaatgaaacagttctagcttttgaagaacacatcgtccttcttggagttagagaccttcatttttattttaagctctttgtttcctccacagctacttatatgatttgtacctatttatttaagtgagtgaatgtgctactatcttaggtatttgttcattgaatgatctctgcaggggaaactactcaaaggtttgccagggcttttctttcaccattggatgtgaaagatggctcattttgaggagtctttgcacccccccggtccctcccccctccactttttaaaagtaggctccatgcccagtttcaatcccagtgtggggcttgaactcacaaccctgagatcaagacctgatctgaaattaagagtcagatacataaccagctgagccacctagatgccccagagcagtctctgcctcttaaataagctatgttagggccagttctgctcaaaaattaaagacagccttgtgtatgcaatcttttttcctcagtttcctccttgagcaatttccaaagctcagataatttatatgccatacttccctaaataattgacgctatgccatgaagaaatatgttaacattcagtattgaataaccaacaatatctgttagaacggtccttttctgagcattaacaactacagtttcttttttttttttaagactttatttgaaagagagcacaaaaggggcagagggagagacagagggagaagcagactccccactgagcagggagcctgatatgggtcttgatcccaggaccctgagatcatgacttgagccgaaggcagacacttaattgagtgagccacccaggtgcccaagtattcagttccagaagaagactggcttgagacacatggctggtacagttgtgtagcatgtgactcttgattttggggttgtgaattcgagtcccatgttgagcataaagattactttgaaaaaaataaaatcttaaaaaaaaaaaaaaaaaaaagactggctcaaaccagagtattaggacttcagctaaataggctaagttttagcaagattccaggcttatggaagggaattagaatgttcatcaggttactgttgagcattaaggaaagcgcgcttcacagtctccagaacgtcaactggcctagtattggaatgggaagttagggtaaatggcagtgcttcaagtcattggctacataactactgtggatgtggggaaatttgtataattggttacagtgtagagagtgtaaatcagtatcatacttatagggagaaatttggcaatatatgttaaaatgtaaaatgtacaattttacttttatgaattcatcctacagaaggaaccaaacaagtgagcaaaacctagaaggctatttagtgaaattaatgtaaaagagcaatcagtagggactttattaaataaattatgatattccatacagaggagttgcttgtaaataactttccaattatttttgtcaattattaaaaagtacttaaaaatttgacagtataaaatgcccaagatatattgtttattgaaaataaacacaagttttaaaagagtatgtatggaataattctattttatatatctatctagatatataattacttccatgtattggaaattcatcttttcctttatacctttatatattgtttcaatttttttatggtaaacacttcaccagcagatcaagacggtgatttctctattactgtctgtcatactgttttgagatggtacatttgtgcacatctagtcatatgtattttttggtaactcacatcatggttgcctcttgggatataataccactgagatttagtggaaagggttctcctagtaatataggtatatcttatattgatctagctctttctcagataaaagttatgaactctggacagtatgtaaaaaaataactagttgaagacattggaaagtgaccaaatcaggcagaaattgataggaaacttgaaagatgggaattgtactggcatgcttctcatttgtacaattcttttgcctgaggatactccccagtttgtcatggtgggtggtggctagaactcaagcaaaagtctatagttttatagtttggggagttggaggattgagtttaggactaaaagagggactggagaatgaggggagaattctcagaaaggagggaacaacagaaaagggagtcctaaaatctgcttttaaattctgtcgaaatccttggcatgcatggggaaaggcttcatggagcctagaaaaggggtagttggaaaggtgaatgaattgagttgagatttagctgttgccccttgtgggggagacagagtttggagtatgaatctagccaagttaatttcccagtagaataaaattcattcttcagaggctgatagacagaatttggaatcctaataatgttcagtatacaataataaatgactagatgtgcaatgaaggaaaatacgactcattgttgagaatggctgtcaatagaaattgactccaaggtgactcatattggaattttcagacaagaacattaaacttggtattaataaatgaacaggtggagaatctcagcagagaagtgggaactataaaaagaaccaaatgtaaaatctagaacttgaaagtataatatctgaaatgaaaaatttattagatgtgcttaacagcagattggagatagctaaagaaagagttggtggacttgaaaacagagtagcaggaattatccactctgaagagaaaaaaagattaaaaaacgaaaacagccacaatgactgtggggcattattaatatatacataattggagtcctagtggtaaaagagaagacatctggcagactgtattttccaaagatggctgcaacagtagctactatcctacatgttcctctcttggccaatagaatctagttggaaatgacatccatgctacacagagcaaccttatgtaagtgctccagttaatagccctggcttttaagacgtttcagcccaggaaccaacaatgtgagtgaggaagccactaggtgatcccagctgccagtcattcgttggtgtcccagatgaggccccagaattcatgaatcagagtaaagctatctcagttgttccttggatgaatttctaatgcataaagcctgtgaacttaataaaatgcttactgttatatggagctaggtttggagtgatttgttatgctgtagtagataactaaaacaagacaaaaatatttgaagaaacaatggctgacaactaagcaataaaaagatttaaaaatgagcaaaggatctgaatagacatttctttaaagaatatgcataaatagccacaaatatatgaaaagacactcaacattatcagccatcaaggaaatgcagatcaaaattaaaatggctacaaggatgactgataaaaaagataatataatagtgttggtgaagatagagagaaataataacaaatgttggtgaggatgtggagcaactggaactctcaaacactgctgatagggctataacctggtgtggccacttaggaaaacagcagggcaggtcctcaaaaagtaaaatggagttaccattttacccagcaattcactcctacatatataccccaaagaaataaaagcatatgtccacacaaggacttgtacttgcacgttcatagcatcgttattcataatatccccaaagtggaaacaacccatatggccatcagctgatgaatggataaacaaaatgtggactatccatacaatggaatattttttaccataaaaaagaaagaagtgctgattcctgttacaacatggatgaaccttaaaaatgtgctaaatgaaagaagctagtcacaagagaccacatattatgtaattctatttatattagaaaatatatagagacagaaaatagaataatggttaccagattaggggaaatagggaaaatggggatgatagctgaagggtagttttttttttttttttggaagagggtaatgagaacattctaaaatagattaagcttatggttgcacatctctgtgagtatactaaaagccattgaattgtacattttaaatgtgtatatagcatgtgaatttcagtagagctgttactaagaaataagagctaaaagttccaagtttggtgaaaaacatttatagaatccaagaagctcagtcaaccctaagcaggatggatgcaatgaagactactccaggcacatcatagtcatgttgctaaaaactaaaagagaaaaacttaggagcagccaaaggaaaatgatttatcacataaaggagaacagtgttctaaattaatggctcacttctcattgataacaacggaggcaagaagacaatggaatgatatctttaaaatgctgaaagaagctttcaacctagaattccatatccagcttaaatgatttttaaaaatgggaagtaaaggcatttttagacatatgaaaactgagagaatcctagcagtacaagagataatgaagaaagttcttcattttgaagagaattgataccagagggaagtttggatctttaggaaagtgaagaatgctggaaatgtaggtgtaaaagactatatgtatattttttattctcagtttctttaaaagtcaagacttaggtctaacactattttgtgggtctgtaacatatgtacagtagtccccgttatccacagttttgctttccatggtttcagttttctgtggtcaactgcagtctagaagcagattatcctcctgacatatcaaaaggacagtagtagcctgacacgtgtcatagtacctatgtcagtcaccttacttcaactcatcccatagccattttatcattttacatcatcacaagaagagtgagtacagtaagatattttgagagagagaacacattcacataacttttattacagtgtatatagttctattttattattgttaatctctttgcctaatttataaattaaactttataatagttctgtatgaaaaaaaccccagtatatataggatttagtatatttcaggcattaattacaacatgcctgcaatttcaggcatccactggaggttttgagatgtagcccttgtggataaagggggactactgtaatatatatgacagttatagtccaaaagttgaagggaaataaagaactattttgttgcaaaggttcttacatttttatgtgaagtattacaatattaactgtgagtagattgtgataagttaagtttgcatattgtatccctagagcagtctctccgtctctctcacacacatgtataaagatgtatagctaaaaagtatgtaaaataattacgatgaaatgctaaaaataattaggttaacctaaaaagaaggcagcaaaggaggaatagaggggaaaaaatcaaatgaaacagaatgaatgataaaccaaaatccagccagtaaaaagaattacattaagtgtaagtgaattgaccactccaatttaatggcataggttgtcagactggatgaaagataaacaggttgaaagtgagaggatgaaaaaaggtacaccaccatgtgaacagtaagcacaagaatgctggagtggctatattatcatcagacaaagtagacttcaagacaaagtttactactagagataaacatttcacagtaaaaggatcatttcattagaaacacagtcattaatgtatatgagcttaataaaagtttcaatacatatgaaacaaggagcacctagatggctcagttgtttaagtgtctgactcttgatttcagctcaggtcatggtctcagggtcatgagatcaagccctgcatccggcactatgctcatggagagggtctgcttaaaattctctctcctctccctctgtccctactccctgctcacacttgcacatgtgctctctctctctctttctaaaatgaataaaatctttaagaaagaacagttaaaaaaataacacacgaaacaaaattaaacaattaaaagcagaaaagggcaaagccacaattacagttgggtgtttttaatactcttctctcggtagttgatagaacaacttgaaaaatatcaataaagatacagaagatctggggtgcctggggggctcagttgcttaggcatctgcctttggcttaggtcataatcccagtgtcctaggatcaagccttgtggggctctgctcagtggtgaagctgcttttctctctcctcctcttccctctcccctgcttgtgctctctgtcttattctctctcaaataaataaaatctttaagacaaaacaaaaaatgtttattaaaaaaagatgtagaagatctgaataacatgcattgccttgcctaattgacatttatagaacactgcacataacaactgaagaataaatatatgttctttttcaagtgtacagggaatgttcaccaaaatagacaatacattaaactataaaatatgtctcaacacatttcaaaatattgagaagttacatagtgtattccctaactgaagtatggaatttaattaaaaatcaataccaataagataactggaaagggctgcaaatttggaatatttatttatttttaaagtttttatttacctatttgagagagagcacaagtgaggggcagcgagagggggaagcaggctctacactgaacagggagtgcagcttggggctcaaggacccagggatcacaacctgagctgaaggcagacacttaactgactgagccacccaggcacccccaaatttggaatatttaaaataacatttctaaataactgatgatcaaagaaaaacattataaaagaaattagaaaatatttctagctagttggcaataaaaattcaacatattaaaacctgtgggatgaagtaaagtgagtagctttaaacacttctattagggaaaaatttaaaaatcagtggttgaactttccaacttaagatgatagaaaaagggatccctgggtggctcagtgtttgagcatcggcctttggttcaggtcatgatcccagggtctcgggatcgagtcccacattaggctccctgcagggagcctgcatctccctctgcctatatctctgcctctttctgtgtcatgaataaataagtaaatcttaaaaaaaaaaaaaaaaagaatgttggaaaaagatgagcaaaataaacccaagtaagtagaataaaggaaaaagagtagaaatcactgaaattgaaaataggaaaaaaaaaataggacaaaaatagagaaaattaataaagacaaaaggtttttttttgaatatcaaaattaacctttagtgaaactgatcaagaaaaaaagtcataaatactaccaggaatgaaagagaggatatagatagatcttacagatgttaaaaggtattgagggatattatgaatatcttttgtcaaaaaaattgaacaacttagatgaaatgtacataatgatttgaaaaaaataacttaccagaacatttaagtaagaaataagattcatttaacacgaattccttagggaaatagagaagggaaacacttcctatcttgtttaacatgtgtccatcataaccttggtaacagaagcttgacagagatgttgcagacaacaacatgaatgtctatatagaaatcttgcggcttcttaaagttactagaactgatatgttagcaaggttgcgacatacaagatcaatttatatcaagtttcaaaaagattggaaatgaagaagtaaaactcttcacagataaaattttttacgtagaaaatccaaaggaacctacaaaacaaccactagagataataacggaatttttagtaagtttgtaggatacgaagtcaatgtaggggcacctggctggctcagtcaatggagcatatgactcttgatctgagggttgtaagtttgagccccatgttgggtgtagagattacttaaaaataaaatcttaaaaaaaaggtcaatatgaaaatatcactttgatttctgtcttctagcactaaacatttagaaaaagtttttaaagtttccttttaaatattcctttactacatagatagatatacagataaattgaagaaaagatgtatactgagaactataaaacattgcctagagaagttaaaaaagacccaaataaatatgcttactttgattgtatactgtgttcaagaataggctgactcagttttgttagtatgtcagatctccccacaaactgagctattcaatcctaatcagaatttcatcaagtgcttccccccccttataaagtcgcagtctgattaaacaatttttttttaatttttatttattcatgataggcacacagtgagagagagagaggcagagacacaggcagagggagaagcaggctccatgcaccgggagcctgacgtgggattcgatcccggatctccaggatcgcgccctgggccaaaggcaggcgccaaaccgctgcgccacccagggatcccctgattaaacaatttatgtggaaatgaaaaggacctagaatggccaaaataatcttgggaaaagaggcaaaatgaggtttatactttactttccatcacatccagaatggaaaaactgatagctactttagtgattgagatgttttgtttagatgatttgggggtcctatgtttaaatcaatagcttgatgtgttattttttttgctaaaaggtatgcctgtggtgtggctgagcagtgaaaatacttgatatggctttgggtagaaagtttagaaaccaaggcctgagctgtgatcaccttaggggaaaaagtagtaaaggaagcaaagtgtgcttgcagtcatttttgtttttgtgggggttcaatttctatggagcctgaagcagactgcttattgcaacttactgactgtattactaacaataaaagtactgaattacagggtacagggtagtggaagaattgaatgaatgctgggtaagatctcatttctgccatttacttagttgcaggttttccacgggctagctggacaagtcatttaactttctggccatttgcaaattgtagatttggactaaatgattatttaagattccttctactctgaaattctgcaaatccaaaaatctaagaattctcacttcctaacattgtggtacattttcacaaagatgtctgagagtctttctctgttgtctctttggcagattgcagtcccctggcagaaatgaaacctgatcaaaatctgtttctccagcttgatttcatcttagtttcaatgctctgtaacagcaacagatggctagaaaaatgtttcgtgacatacttgaaatggaataaatagcaagcttccattagccttttcagcaaccctggaatcagtgataccattcataatcaggaacacaggtgctaaataaagtggtttcagatcagatctccaatctggtttccttgtttgaacaaacctccacaatcctccacaacaggccccggattaccttttcacctgttctttgttattactgtaaaatccagtcaaaatcagttgagaaattcttattgccttttttgagaagagaataacatgatatccaccttttgttgaatactaaaagtaaattgatatatgaaaaagcaaattatatatcattattactgttggagagaatagccattatagtccagcaaacctgcatgtaatctctagagagattctttattctgatagccaaaattatataataaaaggaaatttatcctcttacttggttattcttctgtgccttacctggaaatatgaatgatcacttttcatctggggcctcatcacactttggggtaggaagacaggttcttctgggttttgtgcttttctagttcctccgtgtaaacgctgttgaagagcaggatgtcaagatgctggtgagcagtcctcactgagattagtctgtgatcctggctggttgctgttcatacagttgcacttatttccaagatcagttcacctggtttctatcagaatagagtgggcacagtgttctctcccccacagaactaccctgaagcagtcagtgctgtcatttgccagatgacatgattatgacattcatataactctgctggttaccaactgtaggcctttgtttttagttggttggccttgcctttacgcacttgattttgactaccttcattgataattttgttccctgtcctcagttctcttgtgaccccgtagtactagagagacaagagatgaaaatctgttattggagccagagtgggatataatggaaagaaaggctttctggggaaaattaatttagttttaaccttgtctagatatcaatttgtagacacctgggtggaaaggatagaaataggcatacttgagaataagggatcatatgttgtgatagaaagatagctgaggggttgtctcttgacatcttgagtcccaggataataatataagcctcctaaaccttttttttttttttcctcctaaacctttttgaaaaagataataatttaatccttgtctaaaggcagagagcagtggaatccagaaataataatgattatgatttatttattgagcacttaacaaatgccaaatatttatatgttagttagctctgttaatccccgcagtcctgtgaagttggctttacagtttgcctaaagtcacagcaattagtcagtgagagagccaggttttgagcccaagtctaactctaaagcctgtgctcttaaacaccaagccataataagaatagaagttgaaaacttctctgctcttgaagaattgatttgtgcatctcttttccatctcattttcccttccttgaatcaccttagctggttaactgaaaactaaaaccattttcaaacttgagaaaacagaagaatcaccctgagtttgtttaaaatgcaggtcccaaataaatgaataaatgaataaatgaataaataaataaaaattgcagatcccttactcccttccccattgtgattcagcgtttctggagtgtggtccaataatctgcatgttaatacaaacatacaccaaagtgattctgcttatgtgatcacaggaccatagtttgagacacagtgccctatatactggcaaggttaggttgaaatataacacaatctcatacttttttttttcaaggcttgaaaaatgacacatattttatatggagctgtaaatagattttgcatagagcacaatgtagaaattagatacatggtgcttatatagtatcattttgagaatgtcagtgctaatatgtggcataacttactattgactgtgcttatgtttcattcaaaatatgttccttttattttttttagaggaatgtacttgaaaaagtccctgttactttcttttcttaaaaatggtttttattataaagaaaagtaaattgtcttagtgattcccagccttttatcttctgcatattattattattattaaaaatatttgtttgagagagaacagagagcacaagtgggggcataaggggggtgcagagggaggagaagcaggttccccgatgagcagagagtccaacatggggcttgatcccagaaccttgggatcatgccctgaactgaaggcagacacttcaccaactgagccatccaggcacccctctctcctgcatattaaagggtccttattctcatctctgacagtgactcaccctaccatgattcccaattgaagcagggaggtagggtcttatcataatttttggggaggggaggaagggacatacagtcttcaaaactaattttacattttcaaaaattattatttttaagacttaatacttctgaaggatgcctcacctgaatttgtgagctgatatggcttccctgaatacttaagaataaaggaagggttgctagaaggaaataacaataataataataatatgtctgacctaacatcttatctgacatagagacagtgtggttattaatcagcacttctttaattttctcttttttccaaattgaaaagtgttattggctataatgaccatttagtggatttccatggaaataatagcttcttatctttactcttttcaggttcaccaagaatctttccccagacaaaatcaatttgagcaccttgaaaggagagggtcagctgaccaacctggagctggatgaagaggttctgcagaatgtgctggagctgcccacctggttagccattactcgggtctactgcaacagggcctctatccgggtgagaatgggggtcagagtgctgttgctgtccttggccagcaggcatgctttctggaggggcagctcccacagccctgagtcttgctttcctctttcagatccagtggacaaagttgaagacacaccccatttgcttggtaatgacctttcttgattgcaagtaatcaaatgggaatggctgggatggggttttaatagatctgagaaaggatggggaagagtcctgataggttagcccttttgggagtggtgattgctgtcttgcttgtgagcttccctctgagacagagtgaccactgtctgggcttattctgaaattactgtgatgtatagtagcaccgagacacaatacccaggagtcctgagttggttgttttgcctttgttttttataacaaattttgctgtccaggttcttttagattttctttggaatcctgacagagaaaaaattagaaatttacttcatgttgactattgagtgatgatcagctgaaagcccttcaagaaaagaaaaatagcatgcaataaatgtacactgtaatgtggaaaaaaaaaaaaaaagaacagatcagtgcatatctttatccaaagattaggatccccagggatagtaatacctctgtaacttggatttatgtttctgctgtgagctaatcccgtgcttgtcctggagttctgctgctaatggacatagaagagggaagatgaggcctctccttgcatttcagtttgttcattcattcaacaaacatttattgtttgcccactgtggtcacagcactctactaggaattagagcatagggatgaatagatgcagtgtgtgctgtgtggggttttgtggagttgcttagctctctatggcttttatttcagtgtctggataaggtggaggtggaaatgaagacatgtgaggagcctcggcccccgaatggacagtctcccattgctcttgcttcaggacagaggttagttgcttaggtccctattatttccaacatgttaactgttcatatcaactttcagtgaaaaataaaaactttccttacaggaattttccaacatacactaaaagtagagggaatagtgtaatcgaccaccatgcacccaagatctgacttcaattatcaacattttgccattctgttttcaccttttccctaacactgggtttgtgtgcatacacatgtgtgtatttgaaagcaaatcccaggtagtacatgattccatctgtaaatacttctggatactatatcttagtagacagggattgtaaagaaaggaagaaaaaacacaatactattatcacaatcaataaaattactaggaatttgttaatatttatttcatattcaggtttcctgaattgtctctcaaatattttttccagtgcagtgtggatccaaagagctccatatattacatttggggatatgcctttcaaagctctttaattgtaaaccatcccccacccttactctttaatataccatttattctttgtagaaattaggtagttttttctttttttttttatatatattttttaatttttatttatttatgatagtcacatcagagagagagagagaggcagagacacaggcagagggagaagcaggctccacgcaccagaagcccgacgtgggattcgatcccgggtctccaggatcgcgccctgggacaaaggcaggcgctaaaccgctgcaccacccagggatccctaggtagttttttctaaagaatttcccacattttgtatttcaattgattgtgtcaaggtgatattttaaatgtttctcatttaacctggtagtaggatttattttttatttttatttttttaaatttttatttatttatgatagtcacacagagagagagagaaagagaggcagagacataggcagagggagaagcaggctccatgcaccgggagcccgacgtgggattcgatcccgggtctccaggatcacgccctgggccaaaggcaggcgccaaaccgctgcgccacccagggatccctggtagtaggatttaaaggcttgatttcaatgcatgctttttgttttcttggtaagaatactttagaaattgtaccatgtatttcctatggtaacatatcaggaggcacaaaatgttcctttggttaagattaatcagtggattcagatggtgatggcctgatttgtacattgtgataagttcctcatctgcctttcacctcatgatgtaaggactgttgatgatatttgtctagatctgttatttcactgtagggtgcaaaacagggattttataattcttttctttctattgcatttattagctatgattttttatttttttattttctttaaaaattttgtttatggagacagagagagaaggcagagacataggcagagggagaagcaggctccctgcagagcctgatgcaggactcaattcctggaccccaggatcatgacctgagccaaaggcaaactctgaaccgctgagccacccaggcatcccagctgtgatttttttttttaattttatttatttatgatagtcacatagagagagagagagagagagaggcagagacacaggcagagggagaagcaggctccatgcaccgggagcccgacgtgggattcgatccggggtctccaggattgcgccctggaccaaaggcaggcgccaaaccgctgcaccacccagggatcccccagctgtgatttttttataagaaactttctttcaccaactatttgattaccctgaagtacagtttgtatgagaatgttaggataattgctgaattttttacttttatttatcaaatgtaagaattataattgacatcctaataatctccaaggagattttttatgggtgtgtgtggggggtatgaaggaggcttatcattttgaatttatgtggtttttttggatagctttagtaaagtataatcaatacaaaatagactacacatataaagtatacaatttgataagttttggcatatgtatatacaccatgaaatcatcaacataatgaagacaatgaacatatccattaatccttaaacatattgctattctcctttgtattccttctctttcctttcacaccctctcctatccccaaacatggctttctgtgactatagtttacaatttctataattttatataaatggaaccgtatagaatgtactggtttttgtctgacttcttttactcagcataattactttgagattcacccatgttactgagtgtcattccttttattattgattaatatattccattgtgtaggtagatcactgtttatccacttgttaatggacattttatttacagtttttggctattgtgagtaatgctgctatgaacattcatatacaagtttttgtgtggtcatgtgcttttcttttgggtaaattcctaggaatggaatggtcaggtggtatggtaggtaagatttaacttttttttttttttaagattttatttatttattcatgagagacacacagaaagaggcagggacacaggcagagggagaagcaggctccctgcaaggagcccagtgtgggattcagtcctgggactctgggatcagaacctgagccaaaggcagatgctcaaccactgagccacccaggcgtcccaagatttagctttttaagaaacaatcaaacttttctagagtggtttactattttacattctttttgcattttacattctttttacatgattttatttatttatttattttttctttttacatgattttacatttaaattttctttcttttttttttttttacatttaaattttctaacatcctactcttccatttacttttaaaaaaatttgttgtctttcatacatctatagtcctcatttgtcttgatattcagatgtccttatctttggccaatgagagctttttggagacacctcctatgtcttttagagaagaccccaataatcttttttcttttagacagaacaagatgtttcaggcttctcatatacatccttacttcagacctggaatctgacattactccaaagaaccctgattccttttagtgagaaatgctatttagagagaacaatctgggcaaaatgtattcattgagttgtaattgaataaggacttttaagtgttcagttctagagtaaagttatttttaagagagagaagaataggggagcctgggtggttcagttgggtaagcatctgcttttagctcaggtcatgatcctggagtcatgggattgagtcctgtgtcaggctccctgcaggggtgactctgcatctccctctcccactgcccctccccctgctcatgctctcttgctctctctgtcaaataaataaataaatagaatctttaaaaaaagagagagagaagaataaagataatatgctgatatttctcaattcaaattaaaaaagagaattttaaattaactttttagatttaatgtttgtatttttgttcacatgctgaatcttggttcctaacaacaataatgtaataaatgatttactttttaaattgtttaaaaaatatcaaaaccagtattataactatcaatacaactagattactgtacagtagatttctctgtgtgtgtgtgtgtgtgtgtgtgtgtgtgtgtgtgtgtgttttaaacttataatatgtctcatagagaagaatggtcaaatgctgtgttttaaagtcacttgaaatcattttttatgcggttgggataccaatttgactacaaagtagttcttttttttttttttaagacgaattttgcagttttaggctcacaataaaattagaggaaggtacacagatttcccatatcccctttccccccacacatgcatagccttttccattgttaacatcccccccagagtgtggtacgtttgttacagtggttaaacctacattgacgtcacagtcacccaaagtctatagattatgttaagatttactcttggttttgtacattctctggattgggacaaatgtataatgacacgtatccaccattacgatatcacagtatatttcactgccctaaaaattctgtgtgctcctttatttatctctatccttgccctcaacccctgaagtcaatggtcttttttcattctccattatttttccttttccaaaatgtcatatagttggatccatacagtgtgattccatctttttagattggcttttttcacttaataatatacatttaagattcctccatgtcttttgcaattctatagctcatttctttttagaattgaaaatactccattgtctggatgtaccacagtttatctgtttacctactgagggacagcttggttactttcatattctggcagttatgaataaagctgttgtaaatatccatgtgcaggtttttatgtggacataaattttcaacttttttgggtgaatatgaggagcatgatgattgctggatcatatggttagagtatgtttagttttggaagaaaccacccaactgtcttccaaagtggctacaccattttgcattcccaccagcagtgcagctccacaaccttgcctgtattgggtgttgtcagtgttccagattttggccattctaataggtgtgtagtggaatttcattattttcatttcatttctttatatatagtttagagcatattttcatatgcttatttgccatctgtagatctactttggtgagttgtctttcaaggcctttggtacaattttttatttgggttgtttgttttcttattgtgaatacgtgttcttttatattttgggtaacggtcttttatcagatgtgtcttttgcagatatactgcaaaatactcttacagtctgagacttgtcttttcattctcttaacactgtctttgcagagcacaactttaattttttaaaatattttattcatttattcatgagagacagagagagaaaaagagaggagagagagagagagagagagagagaggcatggacgcaggcagagggagaagcaggcttcatgcagggagcccgacatgggactcgatcccgggactccaggatcacaccccgggctgaaggcgggcgccaaaccgctgagccacccagggaagtttttaattttaatgaagtccagttcatcaattatttcttccctggattgtgcttttggtgttaaatctaaagagtcattgctatacctaatgtcatctaggttttctcttatgctatcttctaggagttttttaaagttttttttgtttttgtttttgtttttgtttttttttatttatgatagtcacagagagagagagagagagagagaggcagagacataggcagagggagaagcaggctccatgcaccgggagcccaacatgggattcgatcccgggtctccaggatcgcgccctgggccaaaggcaggcgccaaaccgctgcgccacccagggatccctttctaggagtttttatatcagtttgttttaaatttttgaattgtcttaaaacttatttttaaaaaatatttattcattcattcattcattcatgatagacacacagagatagagatagacagagagagagagagagagcgaggcagagagacaggcagagggagaagcaggcagagggagaaacaggctccagcagggagctcgatacgggactcaatcctgggactccgagatcacgccctgggccaaaggcaggcactaaaccgctgagccacccagggatccccataattttaactatgtaagatacaaaactaaagttccaaagttaaaactataatacaaggtatatgtatgcatgtttgtttgtgttgtcccttttcttacacaaaatgtagtatatcataaacactttccacattgcttttttaaaaaaactatgtcctggtgatcactctatagaagtatatacagcaatgttccttatcccccctgcccttttttttagtaggctctatgcccaacatatgggacttgaactcatgaccctgaaatcaagagttgcctggtgtactgacagagccagccaggcacttcccctactcctttttgaatttatagaatattcagaatattatagggaggcatcatagtttgcatagccagttctctattgatgtttgagttattttcagggtgtttgcttttacaaatagtgcagcaataaatggccttatcacttatcataagtgtatatgatagcctagtgattctgttttggtttttttttttttttttaagattttatttacttgagagagagtgagagagcataagcagggggaagggcagaaggagagagagaagcaggctctccactgagcagggagtccaacacaaggcttgatcccaggactctgggatcatgacctgagctgaaggcagatacttaactgactgagccacccaggtgcccctagcctagtgattttttacaaagtttacacatcaataagcagactactgactttgagaatcccagaagcctcctgtgccctttctagtcctatctgctctcaaggggaatttattgtgatttttaaacatcataccttagttttctctatttttaaagttatataaatgtagtcatgtagtatgtcatcatttctgtctagttactttagcttcatgtgatgtttctgagagttgtccgtgttacatgtatttgtagttcattcatcctcattactgtatattcttacgttgcatgtcacagtgtgttctgttgtagatggacatgtggtttgtttctagtttctggatattaggtatactgttgctatatggaactgtctctatcatgactgtggtggcctctgcatctgttgaaacccttgacttgggcaccataaagaatgaatttttctgtatgtaagttaaacatatgtaagaaaacataatgctactatgaatattcttgtacatatctcttggtgtacacatttctgttttatatagaagaggtgcagggtcataggctgtgcgtgtgttctttagtagatactgctagatggttttccaaagtttttgtgccacttttcccactagcaatgcataagagttccagttgctagcacttagtattgtctattttttaattttagccatctgatagatatgtagttgtatcacattgtgattttattttatttttttttaagattttatttatttattcatgagagtcacagagagagagagagagagagagagagagaggcagagacataggcagagggagaagcaggccccatgcagggagcccgatgtgggacttgatcccaggtctccaggatttggccctggactgaaggtggcgctaagccgctaagccacttgggctgccccacattgtgattttaatttgcattttcttgatggttggtttattggaattttgaatatcttgtttaataaaatattgatataagtatttttcctatttatcttttgggtggtttgtctttttcttattaatttgtagaagtgctttatatatcctggagtcgctccttttgtcttctcttttttattgaggtataactgacatataacatgatattagtttcaggtgtacagcaaaatgatttgatatttgtatatattgcaaaatgaccaccaggataagtctagtcaacatccatcactatacattaccactgtcccttttatttttattatttatttatttcattgtatttttaaaaaatatattatttttaagtaatctccacacccaacatggggctcaaacccacaatccccgagattaagagttgtgtgctccactgactgagcaagccaggcacacctgctatcccttttattttattttttacttttttaaaaaaagattttatttatttattagagagagagagagagaaagcacacacaattgatggggtggggtagagggaggggaagaagcaaactccccaatgagcaggttgcttgacatggggctctatcccaggaccctaggtttatgacttgagccgagggcagatgtttaacccactgagccacccaggtgcgccacctgttgtcccttttaaattgctctattataattattgtaaattgtctcctctgtatttcatgtctttttaaaagatttatttatttattttttttagagagagagaacaagtgggaggagtggagagagagggagagaatctcaagccgactctgcactgagcataagagcctgacatggggcccagtatcacatctcttagatcaccacccaaccgaaactaagaatcagaaacttttttttttttttaaagattttatttatttattcatagaaacagagagagaggcagagacagagggagaagcaggcatcatacagagagcccgatgtgggactcgatccagagtctccaggatcacgccctgggctgcaggcagcactaaaccgctgcaccaccggggctgcccaagaatcagaaacttaactgcaccacccaggcgcccctttatttcatgtctttttaacaatttttaaaaattgtgctaagaaacacaatataaaatttaccatcttaaccatttttaagcataccgttcagtagtgttaactgtattcacaccctgcagcaaatccctagagcttttttcatcttctgaaattggaactctgtatccatttgtattggtttgctataactccatgacataataccacagaagggccaccaaaataattaaaattaaaattttttcacagttctagggctcgaaatccaatatcaaggtgtcagcaggtcctgaggcctctctccttggcttgtagacctgactcatcagcattttctcacatggatttttctctgtacctgctcatccctggtggtgtttcctttttttctttttaattgaagtacagttaatatacaatgtttttattggtttcagatgtacaatatagtgatttgacagttctacgcattatgtaatgctcatcatgataagtgtagctaccatatattattacagtattattgactatattccctatgttgtactttttatcctgatttattacttgaagtatgtacctcttcatcacttcacctattttgcccatttctcctaccccttccctctggcaaccaccagtttgttctctatatatgagtttggttttattttgttttttaaaattccaatctaagtgaaatggtatttgtctttctttgtctgacttgttttacttaacataataccttctaggttcaaccatgttatcacaaatggcaagatttcattctttttatagctgagtaatatttcattatatatatgtgtgtgtttatatataaatacatatatacatatatacatttatatataaacacatatatacatttttatatatacatacatatatttatccatgcatttgtcgatagacccctgggttgcttccatatcttggctactgtaaataatgctgccataaacataggggtgcagatgtgttcttaaattagtgttttcatttttcttaagtaaatatccagaagtagaattactggatcgtatgatacttctatttttagttttttgaggaacctccatactattttccacagtggctgcaccaaattgctattcccaccaacagtgcatagaagttcccttttttccatatcttcaccaacacttgtttcttggtgttttgatactagccattctgacagatgccagacgatatctcattgtggttttcatttgcttcactgaggatgagtgatgtggatcaccaatatcattcttaatgtgttttttttaacagaaatgattaattcttttttttttaatttttatttatttatgatagtcacagagagagaaagagagagaggcagagacataggcagagggagaagcaggctccatgcaccagaagcccgatgtgggattcgatcccgggtctccaggatcacgccctgggccaaaggcaggcgccaaaccgctgcgccacccagggatcccctgcgccacccagggatccccagaaatgattaattctaatgtagtacagtatacctattttttctctttatggattagctctttttgtatcttatttaagggctcttttcttgtcctaggtatgaagatattctcctttgttttcttctaaaagttttattgtttgacctttcacatttagatacaatcagtcttaaaactgattatttttcttttttggtgtaagataggagtcaatattattttttccctgtcggcatcttcaaattgaccatgccctgttattgaaagaccatgttttcccaactgctctgtcacctttattataaattaagtgtgtctcagtctagttttgatttataaatgaggtagaacatttatatatatatatatattttaaaagattttatttatttattcatgagagacacaaagagagagagagagagagaggcagaggcagagggagaagcaggcttcatgcagggagcccaatgtgggactcgatcctgggactccaggatcacgccctgggccgaaggcagggaccaaacagctgagccacccagggatcccaacatttttatatttaatatcatttgcacttacttctctgtgaactgtccatattttatcccatttttattggcctgtaggtctctttcttttcagtttcctaaaactcttcatacatttgagatgttagtcctttgtgatataaattgcaaatatatgtatttttccagtttataatttccataccttctttttctcttgtaatgagaactgatttcatttacatgtcaggaatgtctgtgttttctacattcagaaggattttaacatggccttcattcttctcctcaccatttctgacctctcactgtggaagtatagctataatctttgggatatatttgacagggtcaactagacagggtctagttgggattgttcttgacctcttgctcacctagctgtagttctttcctctttctactacctttgcagagtatgcttgtgtctttgaagattttatagagacctagcatttcctttcctctcacacaacattcacatttaggtagtttgtggactgtatgaatatttttcagcatgcttgggtggctcagtcggttaagtgactaactcttggtttgggctaggtcacgatctcacggttgtgggatggagccctgagtcaggctctgtgctcagcagagtcttgcttcatattctctctccctctccctttccctcccactcattctctcaaataaataaataaatctttaaaaatacatatatatttatattttttgaatataatggaggagatatatttatatgtgtgtatattttaagatttatttatttattcatgagagtcacacagagaagcagagacctaggcagagggagaagcaggcttcctgcagggagcctgatgcgggactcgatctgggatcccgtgagctgaaggctgatgcccaactcttgagccacccaggcattcctaaaaatatatttttcaatttattctttctaacagaagggggattatttccaggtcaactttttttctttcatttcattcttcaaaaaatccaattaaaaagagtacaaaaaattttcaaaattaaaaaaatttaagtagaaataggaagagagaaataaagaagtcacccacaattcctagtacccaaagagagatagtgttaataatcttgtctgatgtcttccactataaagagtgtgtaccatgtcttacctgattctgaacattggtctgcctcatttgttgtagtgagtatggctttgctgagaaggtggtggaagggatgttcatcatcgtcaattctatcaccgtcaagattcactccaaggccttccacgcttcttttgaattgtggcagctccagggctacagtgtcaaccccaattggcagcagagtgacctccgcctcacccgcatcactgacccccaccgaggagaggtgacagccctagtattacaagaggagagaaaggggagattcaaaatgggactcatttttaaaggatattattcctgctttggggatttcctcagatatgtcccccattcctgtgaacccaagaatcccagcgttactgttacatcttttcttctctcagggatctctgatccattctattctattggtaggatcccaactgagaatggtgggagttcctgctttgctcatcttttccccttggacttcctgcttcttggttaatttccatagaattaagggattttaccttttttccttctaggttttaacatttaaggaaataacttggcaaacacttcgcattgaggcagatgctacagacaatggtgatcaggatccagttaccactccactaaggcttattaccaaccaaggcaggatccaaatagccctcaagagaagagtgagtatgttttctgactccatgaaaacttccatcttttattctcctagatagcctgggagttggtgttctttcctttttgaatatattggctccaggaataaccatcgaaaggggcagacctgtaattcagtgttgtacagaacatttctgtgaacatttgcacctccttgtcacctgaattttggaaaccacaaattttacccatatatagggactgtgacataggtacctagcagttgactactgttgtttcttgttaatccagaaaacattagtagttttgtaagaaattgactctccatagtgtttgctgctttcctttcatgttctggggattgaaaagccatttctggaattaactgggcaatcatcacatggaggagttggaatgagaccagatgttgaaccccatgttttatgtggctccttcagaccaaagattgcaatgtggtagcctccaagctgatgttcctgttggatgacctgctgtgggtgctaactgactcacagctcaaagctatgatgaagtatgcagagtcgctgagtgaggccatggagaagtcagcccagcagagaaagagcctggcccctgaacctgtacaggttagaggcaaaatagatacccttggtggggctagggagatggtaggccagacctaattcatgttcataccaacatagatggagttgatactttatttggggcatttgtcatttggataggctttgttatgcttctaatttattcatttattctgttcattgggtacctccagtgtattaactatatagtactagccactgggaaggaaaagtagaataagcctcttattcctgtccttggagctctcactgtcttaaaatatggactgtacacaaattattacaataggaggtagtaagtgctgtgttataggtagacactatgccatgagagcacaaaaaagagggacctcactacacaggcttagcatcagtcagctaagtcctgggggatgagagcttgggggcagttcaaacctcagaacagtactctgacttgagttactagactaattataattaggctttttggagtttgggttatttaggtgggacagacctaagtgagctatcaggtgaatagttatgaaaaggaggggggcatattgctaaattgtggctttctttagcctgagctaaagcttaagaaagcctgtgcggagcctctctgggtttggacttcttgtttttctctgtcacatgtagatcacctcacctgctcccagtgcccagcagtcctgggcccaggcattcagtggtggccagggcagcagcaacagcagcagcagtcgcctcagccagtattttgagaaatttgatgtgaaagagtcttcctaccatctgctcatctcccgcctggatctgcacatttgcgatgatagccagtcccgagagccaggtaccctgtcggttctgagcctgggctgcctggtctgttagctccttcagctccagacaaagctttgggatggaaggctctttgcaagatgctgtggagtaatttagttggcttcccttaattccaggcattccttgggcctcagtctttgtggcacctctgtctgttggtgtgaggtagtgcttacagcctttagggtgtagtgggaccactggtaatacttaatgagatacagaggccagcactctcccaggcttcactaagttagaatctttaggggcagacctcaagcagtgtatacatttttttctccccagtgtgtcttgggcaatgctgaacactggtttaaccttgtaggaaagtaaattcaagtataggaaacaccaggattttcaggtttttgagtcaatttaagtattttttatttatttttactttttttttgttgttgtttaaagattttatttatttatttgtgagagacacagagagagaggcagagacacaggcagagggagaagcaggctccatgcagggagcctgacatgggactcgatcctgggtctccaagatcacgccctgggctgaaggtggcaccgaaccgctaagccactgggactgccccaatttaagtattttttaaaaatattttatttattaatttgagagacagagagagagagaaagagagagaatgaacagggaggaggaagggacagggagagggagaagtaattccctgttgagcagggatcctgacacagggctcaatcccaggaccccaggactccagtaccatgacctgagctgagggcagaggctcaaccgactgagccacccaggtgaccccaatttaaatattttttatgtgtaaatgccctcttcccaagcagagaggttatgttgtattctcttcatgcttttacattcattagggcagttagtattacatacacatatatgtttattcaaagtgagaaaggaattgactaatttttttctttcacgaaccttgggaaaatcacctaacctcctgcttaacctctgagtttcttcatttgtgaacttgagttaaatcatatctgactcctttactgcattggttgtcggtctcaactgaaataatatactgaatttgggggaccctaattatagtcacatactcggtattattattcctttgctgcctgttcctttaatactctgtattttatttatttatttatttatttatttatttaaattcaatttgccaacatatagtataatacccggtgctcatcccatcaagttatagtccctttatactcccctttgcaccaccttttggcttgagatgctctcatatggtagattttttttcttgtgctgccttatcctttctgaaggttatgtctgcctcttaatgacacctatactattttcttgggggatcttacctttcctttctggggcttcaggcagcattgtctctcttgcttagctattccttggtgttgaagtgacttcagtcccaatctactcccactctgagagagctaaaagaagcagtgacaacatagattgcttttgtgactacaagaaataaattgctcactggtttgccaccagttattttggaagttctttcctaaaacgattattattttgtttggttgttttttccaagtgtaactccaaaggctttgggttttttctcttgttttatcttgaatcctttcagaggtctttattaagagtatattgttaagagttttatccttttgggatgcataggtggctcaatggttgagcatctgcctttggctcagggtgtgatccccaagtcctgggatcaagtcccacactgggctcccgggagagagcctgtttctgtctctgcctatgtatttggcgctctctctgtgtctcttagaataaataaataaaatcttaaaaaaaagttttatactctttcttgatggagaggtattgagcactgtcctcttcatatggccaggacccataatccaaaggaagatatgaatgattagcctctcctgcagccctcatatatttatttattaaactaaatttctctacttggtggaatttagggaatttttgaatgagatatttttaggtatggggataactcccaacctaccttaccaaagtatggtatatgactctctcttttttttttttttttttttttttggtgtatgactcttaaaggagcaagaaacagaacaagtttttgtgaacttgactcttctgggatttggggaaaaggggaaaggagaactagctggcacagcaagagctctataattctctggaattgttctatctaacatggagccacatgtgattattgttggctgatccaaattgagatgggctgcaaattaatatatgcatgagattttgaagatataatagataattatcatattatatcttgaaatgataaaatattgattatattcatttaagtagtagtatgtattattaaagttaatttcacttttttaaaaaacttttttttgtatggctactagataatttaaaattacttatgtggcttacattctatttctactggatagcattgctctagaactgtctgtctagtatggtagccaatagccacatgtggctgttaagattagaattaaataaactaaaaaattcagttctgggacgcctgagtggctcagcggttgagtgtctgccttgtcttggggcgtgatctggagtcccagaatcaagtcccacattgggcttcctgcatggaacctgcttttccctctgcctatgtatctgcctctctctctctgtctgtctctcatgaataaataaataaaatctttaaaaaagaaattcagttcctcacttgcaacggccacatttcaagtgttcagtacaatctatagaccatataagattttcatcatcacagaacattctagtgctgctctagaggcttgttaaaggctagatctatctgctttttcatcaggggacaccataggctgggatgttgggtccttgagcaacctacctctctcttacctctctcccttggtattggaagtgaaattattagaaaatgggtgggtcctcggggacagcttagtgtgaggtgggacagcattatctctaaaaataaaacggagcagtgtatactccagccttcagttgatgaggaagagtgtcatctgcctctttaatcttttttccttaggatgaggcctgtgagccaaaaactttctttccctcttaaggccacacggtcctcatcccaccagttcgttggagaattttaattagtcttttatggatactacttattatttatgtcccatatatcattatgtgcatataattaaccatgttggtaattgataattaaatataattagattttgattttaattctacaccctactttaatatgcacagtctgtgtagtttattcttcttttaggtctaactaactccaatgaggggagcattgctgtgaaaccctctccttccagtagtctcactcatgcattttttttatttttttaattttttttttatttttatttttttttaaattttttatttatttacgatagtcacagagagagagagaggcgcagagacacaggcagagggaaaacaggctccacgcaccgggagcccgacgtgggactcgatcccgggtctccaggatcgcgccctgggccaaaggcaggcgccaaaccgctgcgccacccagggatccctcatgcatttttttaaaagattttttttaaaaatttatttttgagagacacagagagagaatgagagagagagagagagagaggcagagacaggcagaaggagaagcaggctccatgtagggagacccatgtgggactctatcctgggtctccaggatcacgccctgggccgatggcgctaaaccattgagccacccgggctgcccagtcatgcatttttaactaggatgctatcacccaacggcagagaaaaattggctcttttaaacatctttattgagattgaattcacatagcatacaattcacccatttagaatatacaactcagcattttttagtacattcatggggttgtgcaatcatcactacaatctaattttagaacatttttgtcccggcagccccggtggcgcagcggtttggcgccgcctgcagcctggggcgtgatcctggagaccctggatcgagtcctgcgtcaggctctctgcatggagcctgcttctccctctacctgtgtctctgcctctcattctctctctgtgtctctataaataaataaaatctgtaaaaaaaaaaaaaaaaaaaaaaaaaaaagaacatttttgtccttcctaaaagaaatcatgtacccattagctgtcactttccattttgtagctctaagcaaccactgatctcccttctgttttgaattttgcctattctggacattaaaaaatgagttctttggtgagatgtgggggcaaaaaatagtcttagctataacatggtttctgcccttccaaagcttaaccctgcatgaaaaaattttattccttatatttaatttctttcattgggttttcttggttatcacatgaggagcattgacattgaattcatggaagaagcacaagatatggtgaatagatggctgtgaatagagtactttttccctattgattgcttaatttgaaaatcatgcagtgggagtggccttgcacataaatgcctgttggttgccattgactgccttgttggtggtgttatatttgagcctcagtgcttttgtgatttgaacttaaagaaataaaaatagtttttattttattatttatttctacaagttattcagcaaatcattaagtgtgaaaagaaaaaatatgacctagtcttaatgaatacctagaagctacataggctaaaagattttttctcataataagtgaaagttaaaagttatgtttactgaggtgcacctggctggctcagttggtagagcatgaacccttgatctcggggtagtgaataagccccacattgggcatagagcttactttaaaaagttcattaaaattcattttaagaaatttatttaaattttccatttttttgctgaaaaatacttttgaataattaaaaatttgattatattgctgttgtgtatttctgatttgcatatgtaatttgatacattatgatttatataaaataaatttcattaaaggttattcagcaaatatacatataaagttgttaaatattaatagctttaacttttatttatttatttatttatattttttaaagattttatttttttattcatgacagaggcagagacacaggcggagggagaagcaggctctatgcaaagagcctgatgtgggactcgatctcaggactgggactctgggatcatgccctgagctgaaggcagacactcaactgctgagccacccaggcttcccaatagctttaagtcttaaatttaacttttgatttaaaacaattatttaatctttcataaccatgcattgaataaaaggagtaaacttcatacttattctttttatgtataaagcacaggtagcatatagtacataagcagatacatagtgtatctgtggtatgaaaatttcatgaagagggggcaattggggaaaaaatgtctaaacaagcttagaggtagtgataataaatacaaagattgagaaataggaatgtgaatgtaggatggtgattagtccagaatttggggtggtaaaatctagattagacagaaatgtattagcttaccccttgaggatcccatggtatttcccttcaccctaataagagaagtatagaacagtatagttcagacatatagttcatgcatatgtaggagaaagtttctactctaactactctactaacagttcttagagtgtagttggagagataggtagaaatagggaaagttcattcatttagtaagcattaaatgtaaattcaagataaacataatacattgtttgacttaacactaaaaattccagtttacctacaatatcctatatgtgtcatttacagtgtccttgttagtgcagtgttttagtgttcatggtactgtgtatgtacagtatggaatgattatctaattagctctgaggctagaatatgaaagtaaataatatgggttctgttttgggggaatttggcttatgcttctccaagtgttgggccgaggaatagcattcctagcatttttagttttggggggaaccaatcaattagggttttagaatgtattagtaggctacctaggattctaattcctgaatcctgagttttgcagtttcttttgcctttctggaaatctggcagccatttacagagataatggaatatactttttttgggtcttatccattgactgttagagatgaagagaggagggcctcaaccttgcaaatccttgacatcatggcctttcagttgcagttgcacttgtgtatcaactaggcttttttttttttagagagcgaggagggggtggggaagggcagagggagagggattgagagagaatcttaagcaggtccaagctcagcacagggctagatgcaggtctatctcacaactctgagatcatgacctgagccaaaatcaagagttggtcactaaactgacaggcgcccccaggctttggaactgatcctcaagaggacctaagtactttaagtggtgtttaggcttctttgtttcttctgctgctgttcacctttatttttcttttataggtgtctctgcaaacagactgacgggtggtgcaatgcagcttactttccgcaagatggcatttgactattaccccttccactgggcaggtaggacagccctgaatgacagcagttctagtgtgtcccttgtacctatgtattgaggacatattccatgggttcattcctgtctgcccagcaggagggtaccaggaattgcagctcagagaggtattgggaatagccctcttcaagaaacttgtaggtctgctatcgatgattctttatcagtgatggaaagaagtaggaggagaggcagtgcttgagatgttgcttttgattccgtgttctgccccttacttccactagttttagatctctctagtagtccatggtcaaagatggtgacagcatgtttgctggcctttttcggaaccttagggaaaaatcacatatggaatccagaagaacttgaatgttctcactagatttttacttttctcagagaactctggattggagtgagggatcagattctgaagtaggactataccaatggaagataaaaatcagaatgttggattatgatcttgaactaaaatcttattgctttattgttgtataggtgacagctgcaaacattgggtacggcactgtgaggccatggagacccgaggccagtgggcccagaagctggtgatggagtttcagagtaaaatggagaagtggcatgaggagatgggtttcaaaccaccttggcatctgggagtagagtctcccttccagaagaaagcaggtaggttataaggaactggaagactcccatagcttagccttttgctatttacttttgactctccagtgaagataaagccctggactaactaattatcccaacctcatcccatggagagttgttagtgacttcttttctttttcttttattttttttaaaaagattttatttatttattcatgagagatacagagagaggcagagacatagccagagggagaagcaggctccctgcagggagcctgatgagggactcaatcctggttctccaggatcacgccctgagcctaaggcagacacttaactgctggttgacatcacaacctgagctgaaagcaggcactcaaccattgagccacctaggtgtcccagtgactttttttctttacagagtcctagctgtctttagaactagccgcaatgttgaggagaggttgtcgtcccctttattccataggctgtggccttggtcttaaggagaatacaattttttagtttcttccaaaaattagatggtattaatcagtctttcctaattatagccttgatgatcttaggatttttactttccttattctattaataatgagagttgaatgtatctgattctctttcctaccttcttatttttatttagattctctctccagtcctcgaaagaacccccttgagagaagcccctctcagggccgacaggctcccttttggcctccagcctggaatcgtttacgctctagttgcatggtaatacgagtggatgacttggacatccaccaggtgagaagcccaatgcagggagacatggttggaaaggggtggagcagttcacttggaaggcaacaggtgtgaacaagattgtggaatttggggactgcttacttgacttctgaatgggttgataacactggtctgtttctttctgagcatggctgctgagatcaggacctgcaattcccctagtttcctctgataccctactataaccgttcccctgagaaaaatgcacttttttttttaagattttctttattcgggcaaccctggtggctcagtggtttagtgccgcctgcagcccagggcgtgatcctggagaccctggatggagtctgcatcgggctccctgcatggagcctgcttctccctctgcctgtgtctttgcctctctctctctgtgtctctgtgaataaataaatgcaatcttaaaaaaaaaaaaaagattttatttattcatgagatagataagagagaaagagagagagagaggcagagacacagtcagagggagaagcaggctccatgcagggagaaccatgtgggacttgatcctggaactccaggatcacgcccttatctgaacgcaggcgctgaaccgttgagccacccagggatccctgagaaaaataaacttgcagatgatgtgaggcaggtgtgagaatgcctgcagtaagtgtgcaaagcactctgtttcctgtgagagactttgcaaggattgtagtggcttttatatgacctcagaggaaattgaggaaattctattatagatgctgtacgggtactaacagcaacttgtgtgtggttgtgtaggtttcttcagctggacagccaagtaagaagccatctacactcctctcctgcagtcggaagcttcacaacctacccactaaggtctctgccattcatattgagttcacagagtattacttccccgataatcaggagcttccaggtaaagcatctcatctggtcacttcttactttgcagccagccttggggccatggcttgtattctcatttgttgctaggaattttaggtgtttgagttagtttagcacacttttgttaaaaattctccctttataaacatgtatctttgctttcttcataataagatgaatatcagctggtaagtaggaattgacttgctactctatatatgatgattcttttttttttttttcctgctttctagttccctgtcccaatctctacattcagttaaatggtctgacatttactatggatcctgtcagcttgctctggggaaacctcttctgcctggatttatatcgcagtttagagcagttcaaagctatctacaagctggaagattcaagccagaaagatgaacacttggatatccgactggatgccttctggttgaaggtaggggagagtgggatttttgttccttgttggcagccctagctgcatttcttccatggctataatcctgggttctactcacccctttgatagaaataagaaaaactataacagctcaaatggttggtcttttacatgtgtattaaaaacaggttgtggagctactcagatatccattctgaattgggtttcattttctttctgaaggttagcttcccgctggagaagagagagcaggctgggttgcatcgtcctcaggccctcgtcttttctgcgtcgggcatgactgccaccaatacacgtcatgccccacattgtagttgtccagacctccaaagtctcttccgaggttttgcggctgctgagttctttcattccaattatgttcactttcccaaggttccaggtggctttagccttctgcacatgctttttttacatcatgctttccagatggattcccgactccctcaacccagtaccctccctccccagaggcttaaggcttcccaggatctgtggtccatccacttcacccagatctcattggactttgagggaacagagaacttcaaaggtcatactttgaatttcgtggcccccttccccttgtccatttgggcctgcctacccctccgctggcagcaagctcaggcacggaagctccttttggccacagaagggaggttgaaaccatcagctagctttggcagtcctgtccattctgaggcccttgcctctgatgctgtgccccatcagcggtcaaagactgagcatgatttgaaaagcctatcaggcctcacagaagtcatggatgttttgaaagaagacagccgtagtgtggacaacaaagggcctctgactgaacttgaggatgcagcagatgtccacatgcttgtacactcccctgcacatgttcgtgtgaggcttgaccattaccagtacttggctctactccgcctgaaggaggtgctacaaggtcttcaagaacagctgactaaggatacagaggctatgactggctccccactgcaggaccagacagcttgcattggggtcctcttccccagtgctgaggtggctctgctcatgcatcctgcccctggggctgttgaagctgactctgcaggttcagataccaccagtctcattgattcagagctgtctccttcagaggatagggagctgaaatctgatgcctcctcagaccagggcctagcaagccctgagaaggttctggaggatagtggcattgaaaatttagatgcatcccatgacaggtcagtgcctcttcatagcaatgaaatactacaggattcagattctcttgcacagcaggaggcagggaagggccatgaagcagtcgattccttacaggcgaagagactgagcagaacccagacatccacctcaccagctgtggtgaagcctccatgtggtagggataccgctgtgaatggacaggcagagctcaagcccttgaagaacattgagggagaattgtcaagtgctattcacatgaccaaggatgccacaaaggaggccatacatgccactatggaccttaccaaggaagctgtatccatgactaaggatgccttcagtctgggcagagaccgaatgacctccaccatgcacaagatgctgtcactgcccccagccaagtgagtggctctctgcctccttcgttcatcctgtctcttcctcctagctctggtctttgggcttaaggccttctgctgcgtgtgctgttagattgggaagtgccatgtagtccaggagaatgcatagaatggcctctttaatgtgcgaagcctttagttttcagtgctgcctgcagggcagtggaagaattttcaggctacttagaagatataggtataccaactggagagacttattttcaggactacatctaattctgtgataggtgaagaaccagaaattggatttgcacatgcctccatgtagcttagccgattcttttttttttttttttttttagcttagcctattcttgggcagttttcaagtcaacatttattgcttcataggatcttcccttctctttcactgattcgctcttatagatacagctatgctctgtgagaataataataataataatacctggcatctgcatgatattttattctttttagtggcctttcacataacattttgtttgatcatcacagcagccctatgagatagtgataaaaattcgtatcctcagtttataactgagggaactgaagtttcaaaaaggatgagcccatggatgttgtatcttataaatagagaagctggggctttggatttgctctttctggtacaccttatcaatgtctgccagagtaatagagaaggaagaatttcatctgttcattcaacaaaaaattttggagcccctactttgtgcccagctctgtgtcagacactgaagaaacagtagggagtaagcagaaaaatacagaaatgcatagttagaagagtggaaaaggtatggatttttccattggtgccttgtggttttaggaatgataatgaagattatgggaaatctttgttgggactctttgtgctttggggaccatggtttgaagaacagtggctttggagctttgtctaagtgaattgtgggtctaagtgggtgtctgagcaatgtcagtgctagtacttgctaggtgcagaaagcctagaaggaaggagaagggaaaactttcagggataaatgatatagtaatatgaggcaacacttacagagtgttacagtgtgtgtaagcacagtcctgagtgcttacaatgttaatccattgaattcttgtaacaaccctgtagggcaggtactaatatcagtcctcattttacggacgaagaaattgagctcaaagaggtaagaaacttgcttagggtcacataactcttgagtggcggggcaaggattgaaagccttgagtcccagacaccaaatgtgctactttttccaaatggagaagcataagggaggtgggaaaagaggagagagaggtgataaagggaagagaaaggtgtgtgacgcaagccctttttttcactcacaaccttgacatgctgactgcccagcccacggtctcttcgcagtcctccctgtcctcggcttctctgtggcgtttgtacttgcagtcgctctgaacgcttacaggtatcaacctgtgtggccgctcatgcttctgggcaggaggagtctttccttcttccttggctgctctcttctgccttgagttctataaacctaactgctccattgcaccgggctgtccgtattctcatcacttttattacaatctttatgttttaaattataaaaactagttttgttcgttttgttgacaatgtaggaaaagaataaagaagaaaagaaagtcattcgtgacaatgcagagatagccactattcacatctggatctgttttcttccaattttcatacctatatttggatacccattgtgaatgcttttatgtgtatacacgtacacttacacgaatattatttttacaataatacaattatttatcatctagaaaatttctagttttattcacttaatgtttgtgaattatttcccattcgttaggtatctgaatacataatttttaattgctctattatattctggcaaatggatgtatcctaattcattcattcatctcactatgggagagggctttagtgtgtttccagtttttctcagaaccaaagctctattaaatgcccttgtttttgtgaacataactcttttttaaaagatttatttctttgagaaagtaagactgagacagagagcacgagaggggctaggagcagagggagagggagaagcagactccctgccaaacaaggagcctgacacagggctcagtcttaggactccaggatcatgacctgtgccagtgcagatgcttaactgactgagccacccaggcgccccaatgtgcacattagtctttatgcatatctaaatctttaaaataaaaacctagaagtgggttattattgggtcaaacgctgcaaacatttttaaggttcttgatgtatttgccaaacttcaggaaggtttatatcagtgcatttttccataccttctctcaaggttattttattcatctcttcctctactgtaaagtctgtattttcggttctgacttttctcccctcccctgctcttcgttaaaaaccatctactgcatgtggttccccatggatttcctagggatatggcgaacctcacatacataaaactaaattccctatccctcccagaccagttctttcttttttcagtaatatcattctcctgcctgttccagtcatttgtcagactctgactgtaatttctagaacaggggttctcaaactgaagcatgttgcagaatcacctggagcgcttgttcagacggctgagccccacctcagagttcctcatctagtaggtctgagatggggcctgagaatatatatttctctaagccccttttttctccctgttgatgctgatgctcctacctgtgtgacactttgagaatactactttatggagtcttgtatccatttctgctgtctgttcctacatgtggactatttcagtaaactattttttttttaaagattttctttattcatgagaggcacagagagagagagagagagagagaggggcagagacacaggcagagggagaagcaggctccatgcaaggagcccgatgtgggactcaaacccaggaatccgggatcacatcctgagccaaaggcaggccctcaaccactgagccactcaggcgtccctatttcagtaaactattaactgatttcctcattggagctcttttcctcattagcttgtttgaaagagccaggtcaaccttcttaaaacacaggtctgatttgttatttcatcattctaaaactttcaggctttttccttacaccctctagttttagtttgaacctacttctgtgacataatcaattatgccacacaattatgccaaaaattctatatatagatatagataccactttttggctttgtttttaaagtaggctgcattctggggcttgaactcatgatcctgagatcaagacctaaactggatcaagagttggatgcttaactgactgagccacctaggtgcccccactttatggttttttaattgattattttttagaatagttttaggttcatagcaatattgaacagaaggtacagagatttcccatataccctctctactttatagttttaaaagcactttcatatataaccttttatccacgtttttctgtaatctggctgcaatccgtgtggtgaaagtggcaggaaaaaacacttagcaggaagttaggagacttggatttttcttaattctcgtctttaactatgaccttgagtcagtttcttcatctataatatgggaaggtaagaacaaaagatctttaaagatttcttttcagtgtgttgtgcctttctaactttatcttccattgctctccccaacaaaacctaagctctagctgtctccaaaggtactttttgttgtctagctccatgtccttgctcatgctgtttcttcccaataaaatgccacttccctgtctctttcacagtccttcaagggcccgctcaaatgccatctccttccataaagccattactgatatccttcttgtcatcctttcccctctttgatatggcctagcctttggctggtactgctgtccctctcttctggtgtgtgtgatttactcccatacagtgatagttgtatttaaatttcctctctcctgatagactatacattcattgaggacaggggataccttattcattattttattcacttcccacccccaccctgtgcctagtatggtgccttatatgcagaagaatctcagtaaatacttgtggaatgggtgtgggtggcttcaggtgtcattcatttgtgctggggctgtaagtagttggtctcctctgtatatgggatgaccttgaaagtttggcatttaatgttgatatggcagaggcacttacgcagtttgaaatgccagattcagaaaggccagccgttgaaaaattatatgacctccttatagcagataataattgataccaaaatttatgtataaataactatttgggctgaaagtgttgggcgttgcaagggacaaaacatatcttctaaaccacgtttgtggtttttgttttttaaacagggagcccatggccaaaatagatgagggggcagtagcaccattgagtggaggagctgcccgactccgatttttctccatgaagaggacagtatctcagcagtcatttgatggcgcttcattggataacagtggtcctgaagaccggatttccgtggacagtgatggcagtgatagctttgtgatgttcttggagtctggtaggtggaagcaaccatgtggcattgaagtccagaaagcgttctttctgctccctatatactggcaggatacaaaaggagctgagatttgataaaatagacattttcttaaccaaaccaaaaaccagagaaattttagtggatttgtggctctggctttatctacacatcttctagtttattgattaacacttgacctttatcacagaatgagactcagaccaaaagagagagtgctagtcttatagtcatgtagctatggcagtaggattagtttggtggctggtgtcagtggtgtgtgtttgttgtctggtgtttctttgtttttttgcttaactatgtattttattgttggaaaataggagcttttgtctctggtacaatgagtaactactgagaattgaatcactcactactggaagttacactggtttttttcatctttttgaactggagactttttaaatggtcccttaagagtgtctaagtgaaaataaaataaaaataaaatgaaaacactgtttcttaagatgggtgttgtgtacctctgttttgttttattctggaatatggaataatatgggaagtttcaaatatgcaaaagagtagatggaatcaaataataatgaaccctcatgtacccattatctagcttcaaatattaagaactcatggccattcttatttcatatatacttctgttcatttctcttcttctcatgttattttgaagcaaattccaaacatacagttttatccataaatatttttattatgtatctctagaaaatagactttaaaatatttgaaaaaaatttaaattgtggtaaatatatattatttaaactttacaattttaaccatttttagctataattcagtggcattacatatcactgtgcaaccatcatcactatccatctccagaacttttttcatctcgtaaaattgaaaatatgtacccattaaataataattcctcatttccttctcctccagcccctggcaaccaccattccacttcgtatttcagaatttgaccattccgggtacttcatagaagtggaatcatacagtatttgtccttttggaactggcttgtttcacttaacataatggcctcagggttcattcacttcatagtatgtgtcagaattttcttcctttaaggctagtaccctattatatgtttataccatattttgttaatccattcatctgtctgtggactctgtctgtggactctgtggactcatttatagagtttttaaaaatgtgcccaaatatcactatcccatttttaaaaatcagcaattctttaaatttatcaaattaccagttttcaaattcccaattgcatcataagtgtcataagtgttttttttttttcccacagttgtcattgtatttagagattgaatttgaacagaaatttttgactttcaaactcatttgttgtctttcttatgcagagtctggtccagaatttcttccaccaggagctcttccaaatgacttagacaatgctggagttcaagggagccctgttatggagagttatggccaggggtcaccagaggccaacagtttggtctcacccagtggagaaggcctcagccctcacccggtcagctgctctactcttctttgcagagggaaggctgtagctagaagcttccaaggggctcatctaaaagagtatccttctacaggtctccattctggtcctgaaggtgaatgaagtgtctttggggattgaggtacgtggtgaggatctgactgtagccctgcaggcagaagaactgaccctccaacagctgggaaccgttggactctggcaattcctgcatggacagtgctcaggtaaggatggtggccattccaggagaactgggatttatctagggcagctctagcttcttgctcctgtcactgtgtcccaaggttagctgtccttgtgccaagcctatggtcctgtccagcagcagttaggaggagaaactctagtgatgccttcttcttgcagggaacctcccagagctctttgcattcaatggctgttcatcatcttcattacccaggtgctccttaagcttatacaggaagccactgtccacttcttcatttgtgtagctgctgacatcaaactatatctgatccgggaatttctgtcattcatattcagtccttttatatttgtaaattaggagataacaggaaagagctgagcttagcatttaaaaaatattttttaaaatgttgggtagataccaaggaatacttaaaaaatatatgtaaggtatgaaataataaaaatacagtgaacccatgtacactaccacctagtttaataaacagaaccatactattaactttgaagtccccaggagcccctctcttgaatatttctctaccactcacctgtcatagagaatccctattctgaattttgtgttatttatggcagacctgggtggctcagtgggttaagtgtctgtctttggctcaggtcatgatcccagggtcctgggatcgagccccacattgggcttcctgctcagtggggagcctgcttctccgtctctctctgctgcttcccctgcttgtgcttgatgataatacttttggcattggattgctatgaatattaaatatatgtaaagtgcttagaatagtccctgctaattaattttttccttctgtctctctcctcaaaggtacaagttttcaggaatcctcaactttgaagactaaccacatcagaccagctgtgggccttcgctttgaggtggggcctggtgcagctgttcattcctcactggccacacagaacggcttcctgcatttcttgcttcaaggctgtgaccttgagctgttcacttcggtgctcaatggcctggggcccttcttggaggatgaggagatcccagtggtagttcccatgcagattgagctcctgcactccaggatcaccctaaaggtgagaggagctttttggattttacctcagactctgtcaggcaaagaattctggcagtgatagctattcacttcttcccttgtcatggtacaacatggtgactatcaagtgagtaaatgcatattagcattgttagtgaaggttataataatacataaatgtgtgttgcatcaaaatgttctggatttaggtgaggagaccttgtctctagccctgaccatgtctctggcttgcagcatgactgtaaataagcccattagattatctagtcctcagtttaaccatctctagaataggaggtactcagttatgcttctctaccttgcaagagtgtatggatacataattaatggcataaagctgctttaagctgaatggtagaagcatagattgttatctgaagtgctctcagctggttggcggcatcggcttctttcctacaggatgtggtttccttctttcctacaggatgatatcccccccatctatccaacatctccaggccctatccccatcactctagccatggagcatattgtgttgaagcggagtgatgatggtgtgttccacataggcggtgagttgggcttgtcaacctcccggcttctctgccttttttctcctataagggaataggtgataacgaggaactgtttgcgtgtttgcagcagtttgccattcagaacctttacttttttccagctgctcctcaagacagaccatcggctgaagtccataaaattgagaagagccagcccccaaaagaacagatgtttctggtgcccacagaagcttttggacagcaggtagggacctaactgaacagtacccacagacccttaatggctgtaattacagaagctggtaaaactcagagggctgaaaaggttgtctatgctgtgtacagctgggtggttggggttcctgtcacctagcagcaacttctagaagtgcttaatagaggatataagtcaggaactgtaggtaaatggttagtgatcatattatattccacctgttgctgtccttacaactgatgaactctgaagatgggattaggcttttttttttttttttttttttttttgagaaaagccagcataaagcacttttattgcaataataaaacttgaaactcatacgtagtgcgggcaggtgggggtgggggggtaggcagcaataatttctctcaccaaatcactacacaggacagcaaaggggtgagagggggaggaggaaaagccaggaaactctgagatcagccgggggagccgaacatcaaaaaccaggagatactgaagctgtgatgaccagcatcattttctcaagacaacactcaagggtttgtcatgatggctgggctttcattgggtgttatgtgtctacaaacagcaccttcaatttaaactttcaattaaagttcttaaaatttggaaagtggagctcaaatagctatgagattacaaaagtcctgaatatccattagaaaaaccacaggatggaaaacaaaacaaaacaaaacaaagagccaggccatgaagaaggcttcagaggtccctgctggcctggggacagatacctgtagtgtccaatatcgcagtgagaacaatctgcttccaaaaggcagagggtttattattggggggggggggggagagcaggggaggggtagtggaggcagaggctctccccctccccacttcagttgcaggtagggctttaattcaacccaaggacatctctcaactgggagagttacttcggccctcaacagtgcctcaaatctgctatggctttgcagcgcagcagcaagaatgtttaatatataatagataaaaatttcatcaaaaataaataaataaataaaataaagattcttgtaatcccccccaaacatcaattcctattctaaagttaacccatgacttgtgctgttaatacttgactaatacttaagtggaaacctagatccaaaagactgaaactgaaccttcaccccaaaatgaaaacgaaatcaaatgagtaacttgaggtttatggcatatagtttaggtcaacacacacacgaggagaaagggaaagagcaaagctgggtgacagaacacattcagtcggggtcgatgtttatacaaagagtgtagtggaacatcaggaaaagctccatacggactcgcgtgtgcgcatctggaggcgccacatccctccatggcacatccaagaatggggagctcagggaggaagccattcctgttattccagtttcagaagctccacgtcaaagacgagagtggcatttggtgggatgatgcctgggtgcccagtagcaccataggcgtagtctggggagatagtcagtttggctctctgacccacactcatctgggcaaccccttcttcccagcctcggatcacctcctgcttgcctagcataaacttaaagggcttgtttctgtcccgggaggaatcaaatttctttccatcttcaagcatccccgtgtagtgcaccacgcaggtctgaccgcgcttcgggaaggtgcgtccgtctccgggggagatggtctccacctgcaccactcccatggcggccggaggggggggggggggggggggaaaccgccggggggggggggggggggttgaaccaacggggaactgggggggggggcccggtttttttttggccccggggccccccccccccctggccccgggaacggaataaggtttttaaaaaattcggggggggtcccctggacccccaaatttggggatttttctgcttgaattctgactccttattcccttaccagatgtttttgcaaagcgtgttactttatttattaactgtaaattacttattattctccaggtgaaagaattgcataccctacaaaaggaacttacagaaactaaacaagcattggccaatgccaaccaggataaagaaagactgcttcaggagattaggaaatataatcccctctttgagctgtgataacagtggctcagccatgtgtgccaaggggagaggaggaggtcaccagcaatagcaccacctatgacagaaggcagcagccagcactgaaatctgctaaggatgccagagggactggggagcactcaactcactcctcatgctgtccttcctcctagctgttctgatctgggcggaacacagggcaaagaacgactacgttctaaggaatggggggcagctttgcacgtggctcaagcatcatgtcatgcctatataaagccttttggccctttgcacactaggtggatctgctcaacaccatagggccatttcaccacttggtttcatggcagagacatttgtttcctctacaacctgtgcgaacaagagaaagtacccactcctcagtcacccacagagccaccaaagattctatgtcccagagcttcctgtagccgacctgaaaagtctctggcctgagctttggccatggtagtagagtggaataggaaatagccagcagggcaggggctaggagaggcacaggagtaagggagacttggaaactgccttttttgggaaaggagccaagcttataccatcttggctgataccgcaatcacatttttcagggttaaggttcttttgttatactatatcattgtgatgctatggtagaaagtaaactatggtactggctcagttgtgtcatcttacctttctataacataatttatttgaaaatttaaatcaagaaaaaaatacgagctaggctgaaggtataatgtgtaagaatcattaggggagcttgtcctgagcccactgttgtctgctggagtgctctctgtcttccacagctgtacttcagaagtgatttcctctgtctccctgggctccctggcacatctgctctcccagttctgggactttctaccagcactctcctttgcacttggcggtttgggagctgaaaatgtgttttaaactgtaatgtaaacatctcaacttgttgcctctcataaccctctatcactgtggctttttaaaatcatgtaattttggcttaagtaaaaaaacaaaacaaaaccccttcaacctacctaggttttctccttgccccatgaaagagctatttcccccctttctttcctatctgattcttccccagcattctaccttcatccatactgctctgtaatatacttcaacctatgtttattggacagaagttcatcagctaacttaccttgaattggtaagatggtaaaattagtgattcggtggtgtcacataagtcttaatcacatgacatattggagaaagagaaatgttttcctttatgggaaatcatgcctgacttgcatattctagttttttgaggataaaaagaaacatacatccaagaatgaacaagatacaattttctcagactggtaaagaacttttgtcaaggtcttcactaaagcaactttaaaaacaccagttactatgacatacaggaatattttgtcatgcttaggaaacaacttagagacttaagaataaacatctttctggagataatgctaacagaggaacagaggaagtttcctgtgggttgatgcttagtttaaccttaaggtttttataaattacctgaaagtaggatattataatgcagtcagtaaagataaaccagaagggattaaaaaaacaaaacaaaaccacagaaggcccacaagccaaactgtgacaacacaggaaaaggataggtaaggttcagtctagggaagtataaagtaatagaagaatcagcaaggcagcaagctgttagaactcagcacagtaacctaaccattgctgaggagaaggtggggtcaatgtgctgctctggctcaaagcccaaatgagttatcaggaagggctcacagagacaacacagaaaatagggcttcatagaaaaccatttcaatggcttagattatctgtgcactgatagtgaccttatttataaaatacgtggtaaagggaggaaaggtccagagaatagcaaaaattataagggggtggagatacttccacacaaggacacgtgtagaatgttggctctgactctggaaagataaaagttgagggtagtgtgaaatcagatatccagctgagaggaaggacatgctcaccaagtcctgatatactagctctggggcttagcctcatggccttaggtacaagaaagcacttctcatagtaaatcagaaacttaagttgctcattgttcagcaagtgatgctggcagagctatatatgagtggcggaggttttagaggaatccttgtatggtggccttccaaaggaatcatggaaaactagtgctatttgatacaccacaactgagagggtaactgtgttcctctacgcactcccccttaatgctcctttggaggcataatattgaacaaaatgatcactggtcctctcaggtacggcctttctaatgttcttagaggaggccttgaggagggagatcagtggccggaaaatagaatcattcaaacttagactcacccgaattggtttttttattttattaaaaaagattttatttacttattcttgagacacacacacacacagattgagagagagagagagagaggcacagacacaggcagagggagaagcaggctccatgcagggagcccatcatgggactcaatccaaggtctccaggatcacaccctgggtggaaggcaggcactaaactgctgagccacctgggctgccccctgaattggtttaaaatcacattctgattctctttcccttccctcctccccccacctccccagtgtccctctggtccctctcgtatccctccatgcaaagaaaatgcctaatgggcattgcttgatatatcttcactttaagcctgtgcttgctgatatgcaatacaagcaaatctggcaaacatccaggcgaagcccttcagtggccagagttcagtcaggttccaggttctctggatttcttgtccatatgaagagatggagctctagaatttctgactttcctatgtggcatccttggccctgtgtcttgaaatcctcctgcagcaaatggtaggggtcattgtctcaatgcattttattaacaaatatcttgtataatttcatactcctgtttgttggaggaaatacgcataatgaagaaatgtgatctggttgttagtccttaggatagatataatgtaaaggaaaaaaaaaagaaaggaaaacagtagtgctttggactgctatgatttctgtcttggagctttaagactctgaacaagaaataacaatacctcaagaaaatgtctggagtgatagcaccactatccctcaaagacctcagctgctgcacatcaccatttcagctgtgaagcatttacaactatatatcatctatgattgtcaaggtttcctgtttacatgggtgtattggagataggtgttagtgcatatggactagtttaaatatctcttagctgagctgcagggtggttattgatctcaaatttgttttcaactcactggaataattaacctcatttctttgacttaagtccaaaggaatgggttctattcttgtgatggctgcttttgctgttttatgtaaactgaccctcattttgccatgggcctcaaattctatgtacccttttcgtggttctgaaaggaatggtttttgtgtacagaatatatataagggataaacactgcccctcaacataccccataatttaaatgcttgcatttagctcatttacattagttcccccttagcccagttcaccggggcagtggaaggcaggtagtttgaagtattaccatagtgatataggaatttgccattctaaacctttacactaaaggtctgttttttttatcatttaatactcacctatacttctaaaatcagttttagtaatgtgacaacactgtggaaacaaatgaacattgctgaagtgctaatagacatttggttatttgtgaactgcaaaagctgtcattaccttgcgatttaccatagtcattgctgtttcaagagaagctggtgtgctgaaacatcctttagcggactacagccctcacctcgatcttcccccaccttctactagagtaggaatattcccattctctggataggtatggatggtagctcttgttgagtggggattattttccctatcttacaacagacataaggagaaacactctaggagaatcttattgttaggtggctagacttgagatgtgacctttctcccttattatttttaaatttcagcctcatccagtatctcaaattgcaatagatacagttcttataatcgttaaaaaaataaataaaaattcctgttagagctgagagactatctgcctttcccctctccagtttattagttttcagtcaagatttaacctgagtcttacagcatttctttgtggaatgccccactgaaatgtcttcttcactggctacatgtatgtttaaagactggttttaatgtaagatactaaaagtcagatttgctcaactttgtgagtccaagctgtttcccctccatcagggtgctgaacagattgacatcttttaagatgtgctcaggaaagcatcaaaagagaacagctttaaaactcttcttcctataacactgaatgacagaggaaagaattcttggggattgccaattatatacagtaagtagccttattactgctaatcactgtcaataaaaggtcactccattcccccctatttgaggaaaccaatgagaatgtatctaatgaactggaatactggtcagtgttgggaagttttaatgttgcattatctaatcaaaccttgagcgtactggttctgtgaaccgcctgaaaaaagcaaattaaacttactaaacgttggttgtggtatttctgtttataggaacctgaaatatatgggcttttacattatttttaagggtttaaatactctttaattttaatgattctagtagaaaatgggaagggctcaaattttcgaaaaaagccaagaccagttttattctgacaccaaaaaagaatgatgaacttctccccattccaaccaactagacgtaaaatgaatacacatatggcaagttggaaaacagtttaatgatcactcaccaaaatccataggagaactttacacatttacaagggcaaacttttctgctacttccattatcactgtgttcttcatggtaaaatatctcgtgtcaaaagcttctggtagtttcatttacttaaaaccagatggaggaaacaacctaagtcagcaacttcatgcttcagtgtgaaactatcaaagctctcttagaaaggtttttctctctgaaagtagcttccctgtctagaagatgcttaaaggcccatgtaccttcttccaactagccaagaaacagttaaatgcctcaaaatacccaaagaggtcccaatatttagtcaagcatgtatgaaacaggctgcatgccttttagatgtgatgaatatcagagttctgagaaagacattaaaaatcatcatggaatccttggaggactgcgatactaaagcaccagtgcaaaagtctcatgtagtaggaagtccagaaccagtacttcctccttcagtaccaggcctttctaggctttgatctagaaaaagatgatttttttgtgctttgagttggggatctgtcccttcgactttaacctccgaacagcctccctcatatgtttgggttgtagtggtggcatttctccccacttctcacacacatccagtgctaaaaaagaggacaggaagaaagcttcattgtcacacaaagacttcatatcacacaatccatttgaatcctgtaattcccattaacccttcttaagcttgctaaggaaataagacattttcccttcttaagagaatgctgtgaaacaggtcatgttaactttagtataatatatcatatcaggctttgtcataggcaacagtttaaaacatatcttctgcttgaaaaaataaaacattcctctgacaagattagcgatacattgtggccaggttctttcctgacggagagagggcagttcccatgggtcataacactggggactatacctcatccaccacactggtgagcccccgtgattgcttttcttgtgtctttaatttggcatcagaaatgaacaaagtccattggagaaaaataagtttgcttctgtcaccctgggctgaggacaagaatcaaaggagatttcccagatgcttccttgtctctgagtattaaaacttttgaggaataatggtcatgccctcctgaatacaaggtgccccacttggttaactcctaactaatgcaaatggagactcccacaagtactctaataggtcccttagtatagatctgcttgaaaataagaccaccagagtatcaataatactcaccttcttctaccacttccccgacaaagaccttggaaataccagacatagcaataacgacattctgagacacagaggttccagtgatggactggatcagcttgaaagaaggacaaagaccatgaattaagatagtcaagaactggttttggaatacagtacccttaagagtttttctctaaaaaagtgctaaaggctggatgctgaaattaagactattaaaacaaggatttgggtgtacagtgacttattctgtatgtagagaccgtatccttataatataaaactcccaattcataattgaggggcatgttacttttattttcctgcatgaatgatccacccgtttgactaacacctcactcaaaatgccaatggacatagctcatgcatttagttcagctctcatatttgatggaaatgaagtgtggtagtccattcttacccttttaatggctgccttagggaaagctgaccggcgatacatttcataacggttcagctgctcctccgaaaaagaagaaaccaggattctagacaaagattcaggtaattaaagtggcttacaagaatgaatgcttaagatatattattacatcaataaaagcaagtttcggacaattagtgaattttcaaggggtcaatagcattaggctttgtgcatacaaggaatgaagataaaatatttttattcttaaggaacttgagaaaaaagtgaaaatacaacttcctttctacttctttaagcataaaaacttgaataacaatgttgggtcactatataatatactatctagattgtattttcagcactttgctctctccttgtaactctatacctttactacacattgatggtaaacatttgatacataaatttatattcaaaccagtagttagatttgggggaaaatatttgtaaaatatatggaaaatgattaatactttcaaataaatgaaaagatggctatattaatttagaaaacgagcaaatgacatgaatagggaatttgcaaaaataccaatggccaatacagaagaaaaattaaccttcattattaactaaagaaattaaaattaataaaataacattttcatgaatcagacaagtattataaagcacagtattagtaagaatgggaggataaaaaaactcatacctgctggtagagtgtgaagtgaacaacctttctggagaagaatttggaaatgtgtatgaggaatatttgaaaatattcatactgtttgaactggcaattcacttctaggagtttatttaggaaatagatggacaagtatgtgaaggatgtgctcaaagatactcgtcataatgttgtcaaaagaaaaaaaaggaactataggggttatttatctgcataatggaatataacgaagccattgcaactgaggatttatgggcatatttactgacaggaaaatatttagctacacatatcaaacattaaaaacaaatctgaaaaaaaaaaaaaaatctgaaaacaacaacaacaaccaaaacccccaaatctgaagaagtatataatcaaatatatatccggggttactctgggtggtaggattataggtaattattttttccatttttctgtattctctgaataatttccaacgagcccatactacttttataatcagaaaacacaatgaggggtgcctggctggctcagcccaggggagtgtgtgactcttgatctagggcttgtgggtttgagccccatgttgggtgtagagattacttaaaaataaaatcttaaaaagaaaacaaccccaaaacactacaatgaagctacttccaagtaaagaaaattatgacctagatatataattactgatatggaaaacattcaccatatataatatgaaaaacaggttacaaatagtagtatctttgaaaaaaattctagatatgtatgtatagaaaatatcttggagactatataccaaaatatgaacagtgtttatctctggtaataaagtgatatctttctttttacttatatttcctaaaatgtaacataggatatttgctttattttcttttgaatataaaaaagtaaaaaaaatttaaaggccaaagaaacttattaactttgtgtggtcaaagtagagccttggaatggggaaaaaaaatcacaaagtgacttactgcatcttttgaatctcatcttcatccactttttgcttcttctctttcttttctttggtatctatttttatttttttggctgcaggagtaagcaaagaggagtcttccctttcaactgctgttaaatctgagatgtcctgattcttgagctgaaaagatgaaagaaaccctattacatatatattcaagcctacattccagacttgggcaaggtaagagttcattcacattacaacacaacaaacttattattcagtagttttttggtcccaagccctggctgtgccatcatacgtaagacacactctctctcctagagaagtttatagctcagctgtgtaatccagttttccagtttagctatgaacatagctctagtatgtatttacaaaagaaacgatgtgccaaagatcatgaaaaccactctgcctccttgagcccactttcctgacctcattctttagaggggatgtcagaaaagtcctctccaaccagccagctcttctgcctctaaatctatagaactctttattgctgatgattccatctggaaagaacattaaaaaggaggcaccttctcatcaaaacagtgtttctttggatttggaaattttaataatttttttaaaagtaatttctaccctcagctagggcttgaactcatgaccctgagatcaagagtcccatgttctacctattgagccagccaggcgcccctggatttggaacttaaaagtgagcttctctaacacgtagtgctcttctcttcctatctttcattctactgtatcatactaatatttatttcccattgctagactgaaaacttttttttaaaaagattttatttatttatttattcatgagagacacagagaaaagcaaagacataggcagagggaggagcaggctccatgcagggagcccaatgtgggactcaatcccgggtctccaggatcatgccgagccaaaggcagatgtttaactgctgagccacccaggcgtcccctagactgaaaactttttgaagatagatttcttattaatctctccccacataagcatttaacataaatttacttgtactagatgtttaatagcaattaaaatccaaattcatcctctccatcttaatgtaagatcaaaagacacaacaaacctcattaatgggatttaatctgttttccctaaagaggaactcacataaactcatacaggaatatgaggggacaggtgaaagtgaaggtagtatatctttaaaaaacttttccatttcttctctagttatttaatacacattttctaacctctctgtgctttaattttggtgatttctattttccttaaaaatgagccatttttcttagacattaaaatttatttggcctaaacttgaacatcaaatatttctggtttgttctgttcttctcgtttcttgagttgggtgcttatctcctgtttgttaacaaaaatatagaaagctatgaatttttctgtaaataaggtattggccaaagcccataggatttgatgtcacgttctctttggtcaatgcagtagttaaatgttggaaggaggtaaaaatgtgactaacccagtaagtccctcacagtctccattgaacgattctgcagcgtgtaatgacaaagttatgcttgagcaacatctaggagaaaccatatttcggtcaaaggggttctagaatcctggcttctagctcttgcataaagtcttagtgtgacatcaggtcccaattcttcaccaggaaaaccaagaggctatgccaaagtccctgaggggcgcctgggtggcttcctgagtggggaaggaggcactcttgatctcaccgtcgtgttcaagtcccaccttggggggggagagtttacgtaaaaaaaaaaaaaaaaaaaaaaaaaatcccttataagtagcctcgacaggtaagggcaaggattaaaagtattaaacccaatggctaggtctctggaaccgaagcagcattaaagttttgtctcttccctctccccgcccaccttttcatatctagagagttatggtgagttaagagttttatcttagcttggagggaccaaccaggaaggcggtcgggagagcactaaaaatctcggaatactcctctagcctcatcaacacttccctccctacctcgccgtcttcggccgtggcttccttcaagtccccatctccgtccacgtcagtttcctccgggattccgtcagtatctgtaggcccggggaccccgggagcaggggccgtttcatctgactcccttgcctctccacctttttccgtgggcgactcgcaggcattatccatagcggtaagaaaaagagcggagagatcgccctcctgtcagatcctggagctcacgcacgacctactggagcacagcagccccgaagcttacttcctgtcgtcgctctgtgatgacatcactcctaccgctcctcggaggggacagtttgaagcacgtttagagtacttcaggactcccttttaactctgattcggtgacggttggagagggaagactgaggttacagaattcagtttgtggattttccacactgggaaagaagagttgtgttgcttactgaaggacttttttctcttttttccccctccgttctgcctttccaaaaacgaagttaactgcttaatccgcttttctcagagtcaagtttggggacgggagaaaactccattccattgtacgcgggtgtggtgggatgcggctacctggtaaatttataggcggggacacagcttcgtacatttcaattggttagcgatcgtgggcctgtgtgaatcgccagcatttctcttcggttccttatgcaccttaaaaaaaaaaaaaaaaaaaagtcatatagctcgaacagaattgatccaacccatttattcacgccacaactgttgagcgcctacttcgagctagggacagttctagtagcaacaacacatagtttctacccgcataagtgatttttcaattcaccggtcctaaagatcgaggtcggttttacaaacctgacttcttaggtcagtttggttaatctcatcaaaaggagaggaaacggattctactgggaagggaggtctcgtctttgcatatttcactttaacgagccatgtcagagattgggaccatcaagaagtggagggatttttatttaaaaattttcctctctcccgtgattgaggtaagagtggggcattttattcacctctgtatcactaggcccccacagacaccacagatttaatttatgcgtgctcaaagaatggacttggaaatgtaggtgggcgttaccgtatttctctctttgtttgcacgctgcctgggtgaattaccgtatttcctgtcctgtgggctcccagaacctttggggaaggagcgcacttcgggaggcgcctacaggtggactccgtctgtccccttccacccgtacagcgggaatctccaagtcgctttcctcttgccgctggaggcctgtgtccgcactcccgggtccacttcccgcggcccaaagccacctgcgcccgccggccgagccccgcccagctaggtgggcaagggggcggggcgtgggggcgcggtgacgcgtgacgccagatcccggaagtgacgcgctcctggggcgaaaaggcggggggaggggggtggtgtccccggccggtttggggggtgcgttgcccggagacggaaagtttgggagcaggagcaggctcggccgcagccctgggaagggggtccagggggcggtggccctggggatggggaaggagcaggagctgctggaggcggcccgcaccgggcacctcccggccgtggagaagctgctgtcggggaagcggctttcctcgggcttcgggggtggcggcggcggcggcagcggctcctccgggagcggcggcggcggcggcggcggcggcggcctcgggtcctctagccatccgctctccagtctgctcaggtgagtgacgcgccggggcgggaccgccgcccggggatcccctctcccccgcctgtcccctgggtgtcgagagaggtccgcgctccggagagccgtcggggtgggcttgcggcacgccgggccgagggcgggcggcccacggggcgaggggcgcccgtgcaggttcgcgcggcgccgggctgccgtctggcgtcccgactcggctgtggagaatggtgggagtgcccaggcgcagcctccgccgccgcatggcacggccgggcttcacctcgcccgcctcgggtgccagctgccgcttctcacacggcacttcagagcaaaggaatattcattttaaatctccctcacctcgtgcagaaactcccacgccttgcagaatctcgccgctcccctggaggaaattctcatgatttccttcttttgggaacttggaatcttccaccacgccccacgggacctggcttttgttgtttacgttaaaattgtgtctggatttaccacgtcccgagtgttcttttagcccctcttgtgctcggagcttagattctagtgcgttgtaatgaagctcattgggttagtctgctgagtggcgtacgcaggattcgtcaaggggtttattcgtcaagagacaaagctttagaaagagtgatttcggaaactgaggggtgctttaaacttttccgaggtttgttgttaaacacttgatctggagctatctggattcagagaagaaggtcacttttgcctggattggagggggagttggaggcgctttgtcagtgtgagtaaaatgtgttggtcagcagcactttcattgcctgttttcttttccttccttgttcttttgaggttttcaagaagtggaagttcatttagaaatggcttcgttggcttttgttccctattagtttacgtaacttcagttcgagtgagcttggaccaaagcaacctaaggaggtaataaatgttaggtattaagcactaagtacaaacccaggtctacacaggaaggtttttaagtagccgtgtaaggggcatctgggtggctcaaatggttggatgtctgcctctggctcaggtcaagatccagggatccggtcccaccttgtgctccctgctctgcccactcatgctcgcgcgctctcgctctctcgcgctttctctgaaataaatagtctttaaaaaaataagtgaataaaaagcagtgtaagagaagaactctccccaggagttctttcgtggaagctaaaaccagtgctatttgccacagtttctctagcccctagaacaatgttgccacacagttggtactcaggattcattgaacaaatagaaatatcagttaaaggatgacaactttctaaatagactcatggtggtactggcagtaattgttagtagttctgagaaatgagacataactttgggagggaggtggagatcagagcttccaggagaagtacttcagctggctttgagggatgtgaggatttagattaggtgaagttacagtgagagcattccaggctggcaagccatgatcagcggcacagaagcaggaaaggaaacttatctggtgctagtggggcactagaagaacttcctgctggagccttgagtggttgggcttgataaagggtaatagtaatgaatggttacacttccatcttttagagtgacttagtttttcttatgtttatagtcccagtccctagatcagtgcctgacaactcatgggtgttcaatagatgtactttgaacacatgcattaggtttggaatctttcttggattactttgatatttctgcacttctgatgtccgagagatgagagaaagactatacaagtttggaggtgcctatctctaattagatgaataatgtaacttttggaagtttgccagagataaccttaacccttaatatatcctgctgaagtgagaaacttccacatatctcccaccttcaaggatgggtcagattactcttactggtgacattcagagacttgaaattttgctgaagatttagctgccctgtggttaatcaagattgggaaatctttgttgactacagtgtttttacttttggcctcatgctaatatatccggtctctgtcataaagtgtagatggtggctccatttccatgcataagagagttgactcctgacttgctcttgtatctcttgtagagatggcctcagagctgccttagcctctcatccctgtgattcctatgggcagggaggatctgcaggcgctagttacactaggtgtgtcattaattagagatgattctggttcaacctagtgaaagatttctgagcaaatgacactctgtatttaaatagtccccaggtcagcatgtccttcctttttaggtttggaaatagtagagggtaggttccctgtgcccacactccccacctctaaggacctcacaaaagctgtggaatcatagcttcagatctggcctttgcattagctgtcatgtcttaccctcactagtgcagctaactgcaacctgtgtttgtccagctgtttgagtgaccaagtaaggctggcaagaatgggagcttacagctgtagtggatataaatgttctaaaccacatgtgtgtttttctgttcatccaccccagttccacaaaggttttgtatttattcttaagctacaaaatgctccctctctcaccccatttctttactcttacacttcttggacttaggtcttaaccctccctaatggccctaatacagatctctcaggcttctacttctttggaacctatcatctctagtgtacagtagcttattggctcatactttacctgcctacctttcatagtttattgctgtggcctatcagtataatgtttgcatatagtaaccctcaccaacggagaacgtacctgagaatcagatagtccgcaaaaacttctactaggaaaaaaaaagctgttacaaacttcatatctttctgcccttcacttatttattgcacgtttattcagaggcagatagtataatgctcaagaccacttgttttgcagtcagactgcatgaattcacagagtactgccactgctgcctagctgcttgagtttatacaaattgctcagccacttgaagcctcaatttcttttatctgtaaaatggggacattattgtgtgccttataggtatcatcttggatactgtgtgtaagacatttccacagttctggcacattgtaagtgctcactgttaaccatcttcagttcagcacatacagttttgctgtactgcccctgctgtgtgcaaagtactcttccagacatattataaattgtgttctttcacatttggatatgtgttttctggactatggcagattagaaacagtaaataaagaagagggcctgcttaggtaggcacatcagtgctgttcatttatctagtgtttatccatcatctactttgtgctaggctgattgctagatgcactgcaaagtttagctcagacctggcgcatagtaggaactttatgaaaattaccccctctcttgatacgtggtctgtttccttacagcatttatagcagtatgtctgtgtgacagatcgacaaaataagagacagaaaaagcaattaaaatctatcataatttttcccacctcagtaatttgagactattaacatagatgagcatatcttatacacttgcccaagccccaggcatcattgtattgtaatttagtgctgtaactgctgtttattatggctcttagccatcaaatacagattaaattatgttcagtgtagcatgttaatgaaactaggagagacagattttagtttttttatccaatatgattcaaataaaaattttattacttaaaaggacaagcaatagattatttagaaagcatagttatctataatgtctagtcctagaaaggctctggatggcatggattttgctttatataatattacctcattttctgattgttgaacagatgcatgcctttagttggtaccctgagacagacactttgttaaacttctttttaactcatggtatttttcagccctgggtacaaatttttgtgtaatgcagagtttgatatgttgatggtcatactgagactactgatttccaggaaaggaaagcaaattttaaatgagaaggcagtaagatttgacttagaagtgaattctatcaactaaagggccaaaagacctgacaaaaggaaatgttacaggaaaacatcatgtattaccttaaaactgtattgaattatgaactaaatactgatatatatgaacaatgtaaagtgaaatgcattcccaagggttcagaagcttagagaaacaaaaccaaaggctaggattgaggagtagattgtgtcatggtttaggagaattctatacttaatttctcaagcatgagaagagcgaacaagaaaagaagccaaggagtcttagtggagaaattggaaaatttatagacagtagcaataaatgtggctataaattttagtttttgctctaccatttggtgtgtatggggggagactatccagaaatagtcacgagtttgccaaaaatatgaaatattttttgaaataaggaatgaagaatgaaaacttttgaaaaatggaccccactttgggaaccataaaaagttcttccaatatcagaatgtatgacaacttattcgttgtttttaagaaagattcctaatgtttatgtcaggaattcagacttaaaaaaaagaaagaatggttaacataacccttccattacagtggtccttcattcaccccctcgagtggatgtgttgcttggaaatgataatgacatgacaggttttctcatgctggccctgctacttttgcccttctctggtgccagatttcttttgaatatgcctaagttgagcaaaaatgattttaacatcctaaggagtaggacagtgctgaccaagaattgtagaatgtcaagtcctgaaggagaatctcatgggcttgtgtgatctaagttctaattcttccaagagaatgcaacaaaacaaacaaaacacaattatccattaggataaccattttctagatcttacactaagccttcctaattcattaaaaatgattttttaagaacttcctaatatatatctgttaagtatgatttattgggattggagtccttttccttattttggaattgctgtgcatttttgctttctttaaagcaaagtatgactttgtgtgattattttgtatgcaaaaatagtgcctaatcttaaactgagtaaggcatgtaattgtagaaaaagctaatttaacagaaatttgaaaagtcagacatctctttttctgaattctccaattgaagttcagtttttactgtcttagttacaaattagagactgggtacagtgaaacaatcttgtggtctaaagaatttgatttgtatccagtaaacttcagcatgttcacttgtcctgggagattatggtcccagtgaaagttgcatgggtggccagaaaaatcccttcagaagattctttttttcttcttggtttgttcaccccaaacagctgtgaattttggtttgcaaaaaggaagtcgaggctatttctaccctagttttcagcagggaaagtaaatcactgggttttatagctcagagacaccaaggaaaccccaaaagtagatagtggagagtttgttcttggaaatgtcaggctctcctgtgggtaggaacttggtctcttctggacagctctcagaaaatgttccccacactgatttccaaaagattactgggagattttttttgtggtacagaaaattatattgttaaattcatagaacatcttcaaataactttggtgtggttagagttaatggtggtaatactagaaattatatgttatggcttcatatttatcctttcttagtaatttgtagatcaagtttgtttagtttacaaatcaaaaaagagtttttcaaacaagtccattttctctgcttcatttgtgatgttattaccactattaaaaatggtggagatggtccaggaagctgaactgcccccccgggttgcttaactggcagaggtttagcatggctgttgaaggtcaggctctgacccaactctgtcttgtgagttaggcaagttatataacctctctgaacatctgtgtcttcatatgtataatggacatgggatagcagctacttcctgaagcggcatcacatgagctgaaatatgaaaggcacataatgcctggtacatgccagggacttggtacctaggctgctaaaatcatctgttgggaacccgatgcttgacagcttgataaactggaatgataatcctgttgttaaaggacatattttatattgatgccctttcaaaatgtataataattgatagcagaaactcccaaccttttcaaatgtagtcccatttttagaagcctaaaaatggtaatagtggcaaattacaagctgatacaggtccacaatctttggctggaaacattgagatttagtatccagaattttggggttgttggagaggaatagcgagcccctagtggaatctgggtcaacactctgaaacattgtattactgaagtgaaatctgtcaatattcacactaaaggggataaatatgaagcagtttatcagtttaggacgggtttagtacctaaacttttaaaaatttattttcagagatttttggatatctggattgtaaataaaggattatggatctccatatttactatagaaaaattactagacacataaaagcacaaagaagaaaataaaatcatctgtaattccaccacctaaaggaattaactgttgtagttttggtgtatattctttggtctttcttccctgcaatttttttggcagaaatgacgttgttctgtacccactttgtctaaaaatttcatttagtatattataaacactttcctaccattttctcttcaacctcattttaaatgaatgtgatattccatagtggttatgaactaatttgtttaatccctcctctgctgttagataggagttttagttttctgctattggaacggcactgggatgtaccatcttgtatctaacattttgtgcatactcatacttgtaacattttatacacaggatagtagatgtaatttgagtattcagctattgcaaaaaatcatacatggatttgcattttgaggactttatagtcattctaaggacccttaaatctcctgggtccttctgattggaaagcaatgtactgaactatggctgctaaacactacttatatttagaaagttatctttgtgcaggcattagatttttaatggtcaagttgggacctcttgggtcctccttcagaggctaatatttagaagagggccattaataacaaatgcatggaacagtatgctccaagcaaaatgagacaaaagccattttcttttgttgttctagcttttatcaggggaaatttcaaacataaagaagtcaagagaataaaataatgaatccctgtgtaccatatatactcatcaaacaattaccggcttatgaccaattttgttactttatatcatctctccaactaaattattttgaggagaatcctatatatcatattaagtacatccttaaaagatagggactctttaaaaaatattcacaatactgttgtcacatctaaaaactggcaattccttaaaatcatcaaatgtttagttacagttaaaattttccatgttgtctaaaacattttatattttacagttggtttgttcaaatctgtatccaaacaaggtctacacattgttttttttttttttttttcaagattttatttacttatttatgagagacagaggcagagacacaggcagagggagaagcaggctccatgcagggagcccaacgtgggactcagccccgggtccccaggatcacggcatggccaaggcccaaagtggcgtgagccacccaggctgccccctacacattgtattcacattgtattcacttggtatagctcttagtctccttaaatctgtgggtttcatctttgttattttttctccagtttatttttttatttttttaagattttatttatttacttatgtgtgtgtgtgtgagagagagagagagagagagagagagagaggcgcagagacacagacagagggaggagaagcaggctccatgcagggagcctgacgtggcactcaatcctgggtctccgggatcatgccctgggctgaaggtggcgctaaaccactgagccactcgggctgccctccagtttatcggttgaagaaaaaagggtatttgccccatttcccacaatctcagttttgctgattgcatctctgaggtgtcatttaacatgtttatctgtaccttatattttctataagctggaaatcagatctagagacttgatctgattcaggttcaaagtttttggtaggatttcttcctgggggcgtcatgtactccttcattcattcagtctttctttatcatgatgtcagcagccattggggactactacttagatccatgatttaattaaagttggaaaaatggtgatatttcgtttctgttttgccttcttcacttattaaaaggtattttttaaatttatttttattttttagagagggagagagagagaacttgagcaggagcagggcaggagcagagggagaggaagagagagaatcttaagcaggctccatgcccagtgcggagccagatgaccctgagatcaagacctgagcccaaatgaggagtcagatgcttagcaaactgagccacctaggcacctctggaatactttttagagagaaactttgtaaagaagcctcctgctatcaggaggtacagtttattcaggaaagatgagttaaatgcttatttcttttctgttatttgccagttttcagatcaagttggttacttagtagtcttcagaggtgtctaatgagttttttgtaaatgttattatgaaatgtatttaaacatatctatgcttcaataataaccttcttaaaaactttttggggtggagcgtgggagggggcagagggaaagggaaagagaaacttaagcaggctccacgcgcagtgttgagccagatgtggggcttaatctcacaacctgagatcatgacctcagtcaaaattaagagttggatgcttaactgactgagccacctaggtgcccccaataataaccttttaaaaatgttacacttagactgtcagttttactttactatgaaaagcagttgaattggtttataaggaagaagtgttgtgtgtttgtgtattttacttgagtgatatttctactcagtctcccagtttgtgctggttcatatggccatttgcaaatcaagtgttcttatctttgagagtagattagttcagctaggttccaatcttttttctcttttaaattttgtgcgggtcatagatagccctatagatgacaaagccgtaaaaaagatgctctggggacttgaataatcaaatttcttagcttctacttttggaagagcaactttattttttattttttaaagattttatttatttattcatgagaaacacacacacacacagagagagagagagagagagagagagagagagaggcagagacataggcaggagaagtaggctccatgcggggagcctgacatgggactcgatcccaggtctccaggatcaggccctgggctgaaggcggcgctaaaccgctgagccacctgggcttgcccctggaagaccaactttaaatggtgttttcccaccagctttatggattggctctagataagaagctagatgtgtcaaactgagttacttagattattcagcctcatttgttactctgatttcatggtgttatactttttatatgaatattgaagagcccactgagttatcttttattaagtgtaccaagcatatttttccatgtacttattgttgatttctgttactgcattgggaattcccattcacagctctgattttgagttcctgttctgacgtctgtgtattttctttgcttagtttggagctcaaatatatacaaaagcatttcttttgttatattttattcattggttttacatatttggagtaaggttgggcggtttgggtctgggtccttctgcattggcccagattcccccattggctagtcattcaaatgctacattttagagtcaatttaaaagtgataaaagcagcatatggaaccacttatttttttatttttgacagttgttgggacagtctgtgttctactttattttatttttttttaatttttatttatttatgatagtcacacagagagagagagagagagagaggcagagacataggcagagggagaagcaggctccatgcaccgggagcccgacgtgggattcgatcccgggtctccaggatcgcgccctgggccaaaggcaggcgccaaaccgctgcgccacccagggatccctgtgttctactttagagagattttgacctctattagacaatgacagcatccagtgccattatactgactgatttcctggcactttcacattgggctctcagattccttaaagagcattttcattagttaagatgaaaaatgaaaagtaagagaaatatactgaacttctttactcagaaaggcaaatgtatcttaaaacacttcggtttcattgtgccaagtagttatcaataccttggaattggatggtgcatgattcttgcaagactgaggctgtgactctgtctccctgtgatggggtccgtcctttgtcatgattacactgcatgcttatccttgcctgtagtgactagaggtgacatgatgtatggggtgagtcaaactttttactgtgcctggaaaagtagctccaaatggatatcccactaataagaccggtagtcagcattcattgaatatgcattgatcctagattagcagcattgatttttacatttggaaggcattaccaggtgcttgtctttactaggattgagaaagtaaaatttttttgtccatcctgtcatgcattttatgactttcagctttgaatgcatacaattagatctactaattacagtagttctcagtcatagcggaagtttaaaatctcagggattttgattttttctttttttaagaaattcttataggtgaaaggtagacaaagtagtactgttacttgaggtatcagctattataagaaaacacaagctagtttattattgaacctcagaaaaagatccttcttaaaggggatttctgcctgtgtcacagctcttgtctgagtgaaccaacttattgactttgttttcctttcactcgagtaagcattcattgtgatttccctttgtttcctctaaacacaatttgtgtctcgaattatttttccttctggattatagtcaggatccacttaaaagaagttcaaccaccaggaaagcttaccaaacagatcggttcagggctgtttacatgaatcattgcaagattctgaggctttcttgtgtttgtggatctgtagctctttgcggggcctggagaagagccctagtcctggcttagtttgtaacagagcattgttccctgctcttcctctgatgctgtttgataaagcctgtgcatcggttgactcttccctgggttgggtccagctagctgatttcttgcttcttgaggtcgtcccactgtcgtgataaaacgtgcaaaagccagcccatattacagtatttggggtagtgaacttacgagtgaattcataatagctcagagttgttgctatagattgtattgtaggtgagtatgtacatgtgtaccggggagagggatagtttcacttcttgagcaattaatactttgtgccaggaactttacatctatattttctcagtttacctttaaaacgtgcctagtagatagttattgttattcccattttgcagatgaagaagcaaaggttcagggacaggttaaagtgaccagcacagggctatacagaggttacagagccaagagtttctctggctccaaaccgttgcttgtgtagaactatacaggaccacttggagaattccatctctttggtaagattcaaacatcacatactttatgcttaagtaatatcttaccgaaaaagatgaattagggatttatttaaatttaatagttacttttatgacactttgtgccatgcactgttcttagaacagtgaactggttctttttttttttaatttttatttatttatgatagtcgcacagagagagagagagagagagagagaggcagagacacaggcagagggagaagcaggctccatgcactgggagcccgacgtgggatttgatcccgggtctccaggattgcgccctgggccaaaggcaggcgccaaaccgctgcgccacccagggatccctggttctattaaaattctaatatttacaaatattgactccttttgttctcgtgacaactctttgggaaaggcactagtatctttgccattttattgatgagaaaactgatgagaaaacaaagtagtcacatagcttgcccccggtagtaagttaggaagtggtagagcttggttttgaacacaggcagactggctctggagtccttgcccttattttttatgcaactggggattcttctgtttatccaagaatgtaacacaagatccctttggaacactttgactacataaagtgaaaggcttatttaaaaaaaaaaaaattggcaatttccctggaatataggaaaattagatgaggggaatgtctttaaacttatgccaaataatatattagtttagaggatataggggaatgccccgcagctcatgaagaggaaaaagcctcccatattgtttctttcaaacttttcttctagaaaattcccatcttcctctaaagcaggttaatatgttcatgaatttcatctgggagaaaattcagcctcctccaactccttccccaagttcaaagtgataaagatttgttttggacacgtgactgccagatgtaccaccaaggccaaagtgtgtgcaagggaagtaaatctaaacaattggcaagaaaccaggggcctgtatatttgaagttatttcaaactcttgctacccactctgcttttttgcagctctctcctcctgcctcttatgaccaaattttgtatctcaaataataattagtttacccataaaatgattttcagagaatattacctgaccagttcaaatgagcattgatactagtttgaagcctgggatttggggataggagatgttactttccataatccttggtgctttaatcttcacaatcctgtggtagaggtattagtgaccactctactgatgagattcagagaggttaagtgacttgcccaggactgaggctttctatttgggcctttagagtctgatcatggctaccagaaagaaaatcgtctgagctcccaggttgtagaagtagaaggaaaatgtagtattctatatcctagttaaacagctctgaaaacacctatgggtcctatacgcttagcagtaatagaagagctctattactttttacctacaaataccaatacctcagatactgaaattggcagagattccagatttgctactttttaatctatttctatctccataattgtgtatttaagacctagctggagaatagttctcttgctagtcactcatcagcagtcctttggctatcattagcagacccagagcagattttcaaaaaggtttttaagtaaatgattcaggacttactgcttcattttaaagttgaactgtttgattcatttttttaatttttatttttttttaatttattttttaagatttaatttatttgagagagagagtacaggtggggagaaggggcagagggagaggaagagaatcttaaacaggctccaggcccagtgtggagctcaatgtagggctggatctaatgaccctgagatcatgacctgagcagaaatcaagagttggacgcctaactgagccacccaggcatccttgtttgttttttattttttattttttatttatttttttcttatttgttttttaaaagaaagagtgtataagaaattaggatccagtaagtttacttgctatgttttgtcaatcagattgatagagctgtctttttttaatgtcttttctgtacccattatgatctgttagatgcattgtcttcagttaccatcacttctttttacctctctttaatatttactctttacttttactatatcattaagttacagagagaactggtgaaaatggcagccgaggcatacgttagcttctgctcattcaattggcaggtgtttatgaagaggtaattcttgtgagtgagttttcataatcatttaaaaatatctatcggggcacctggtggctcagtcagttgagcatatgcctttggctcaggtcatgatcccagagtcctgggttctagcctcatgttgggaatccccgctcaacagggagtctacttctccctctccctctgctccatcccactcgttctctctctctctctcaaataaataaaatctttaaaaaaaaagtacttatgtttcctgagaggaatgcatatgtaattgtaaattttgtataagctgctggtactagcaaaatggtctaaatccaagatttattttgtgtgtgtgtgtggggggggggtggatagagaggaggtcccactgtaatctataaaattgattgctcataacttgtgtgttttttatcttgatatttatgctttctaactgccttattgttggttttggtcatcattcagaaaaaccaatttaccaataagccacttctttaaaagccaaatcaccagatagaagtacattttttggtggatcaaatcagctgtgagttcagaccacagtctgggtctctaaaaaattgtgaatgttatctaaaaacataatgaccaccattttaccaaattggtggtaaatggtctgaattatttttatttttatttatatttatatttatatttatatttatatttatatttatatttatatttgtatttatttgttttgttttgttttgtttttttgaatgctttcctattgctaaggtgttatctgattttcttttggtgatgaaataatgaggttactggggtcatcatgataatgaatctgactggtatcacatttcctcattaccaggtactgggactcgtgagatattgacacatagaggcttaactgactgcttttttattattgttttgattgtgattcacatttgtttttgtttttgcttttttaagatttacttgtttatttgagagagagtgagagcatgcatatgaattgtggggaagggcagagggaaagggagagaatctcaagcagactttcaactgaggttggagcctgactcaaggctcagtctcatgatcctgaaataatgacctgagtcaaaaccaagagccggccaatcaaccaactaagccacttagatgccccttgattcacagttgttttaacctctttgtttctcattccacacttagtatttatacttagaattgatctttgggttcgtgtggccatctgggtttgagtagagcaaaatctaagtcttgtctctccttccttcatggattttaattttagcttttgatctgttgttgtagatacctggacaaaacctgcaaattaagctttaagttcttcatgtccctagagttttatttttattttattttatttttttaaagattttattaatttattcatgagagacacacacagaaagagagagagagagaggcagagacaggcagaggaagaagcaggctccatgcagagagaccgacgtgggacttgatcctgggtttccaagatcaggccctgggcagaaggcagcgctaaactgctgagccaccctggctgccctcatgtccctagagttttagcttggtctaggccctctctagatccctgggatctgaaaagtacataggtctcctagtcttaatcctctagtctctccatgggctacacagaaaaatcaatctgcatgaaacattgtctccaggaaccttcctcctcccaagtgcacactgcctctgggagagtgcttggagagtagtccctcagggcctcccacctagtaccacctcagccacactctagctgaatgatcttgggaatgtttttgtactttgttttctcatccatgaaacaaggcgatgtttgggtcctactaggggtcctaaggaaggtgcgttagcaagtcttaaaggagttgcagagtcagactgtggcttgatgtcctctcactgtgtgtgggaacggggccaggcctttcatatacctcgtccagaagggtaggtcaggagaggaggaagtctgtctgtcccctcccttgtctatgggagtgtgtaagtaggccattgctcctgtccttgaagctttcataaacaaacattggttagtgactgatcactgtatgttatgcagactcacataggagatttttaggaatacaaaatttgtcagttcccttaagaaattggcttgattcaaacaatgatacagtggccctatcaacttctcagagaactggttgattccaggactggggcagggaaaagaaaaaagacagggacacatcaaaaggacacagaaatcaacctaaaagagctctcaatagctaaagctggaataatttgaacaacaaaataaataacagtagtattagattataaaccaaagaataaaataaatacccacaagttttgaataaataaatgagggtgaagagatagctcttcctttcataagaattccaaataataaatgtataaggaatgaggggaatgaatagaaaatcgctttagtgcaccacagtaataattgctgcaggcaagatctccaatggaggctcaaattagtgggtaaaagtttaaggggaaacaatatttgcatggcctcaaagcatcttccctaaagtatctattgattgctgttacgctttcaacctatgctcacatattctttgaaactcttctctccaggaggtggagtttgattcccctcctcttgagtgtaggctggacttagagactggcttccaaatcacagagcatggaaagggaaaaaagtaattttacagtggaagaacctgacagacaccaccttaaccaagtgatcaaggttaccattagcgatggtaagtcatgttgctatcacttacccctactaggatgtggtaagggggtaacttgacctcttaggttctccgaaatctgtccccacggtgtaatcttgagaaaacagataaactcaagttgaaggacatcctacaagatacctgactagtattctttaaaagtgacagggtcatgaaagacaaggaaagactatggaactgtaagaaattatgagaactaagtgtatagatcaatcttggaacaggaaaggggcatgtgtgtaaaaactggggaaatctgaataaagtctgcagtttagttaatagtatattgtactattacaatataccatatacaatatagtgttaatgtcttaagttttggtcagtgtgccatggatatagaagatgttgacataaggggaaagtgggtgaaaggtatacaggaactccatagtatctttgccattcttctgtaagcctaaaattatttcaaaataaaaactaaatagacgaagtatcagatagtggctctggaatcctattgtctgggttcaagtcttgcctttgccacttaccaattgagagatactaaatgactttcttaatttctttgccttttccctcatctgtaataataattcctcctccttaggtactcagtatgtagccatggatataaacaatgtttgctaaaggattttggaagaggagaagatggtgagggggatatctggctagagtggcctggagatccctcctcctatagactcctgggaggtgggacttgagccctgcccttgaagaaagcccaagctgtagctgatgggagattgctgtggaggaggaaaaggaacagataggggcaaaggtagagaaactgtattgggaaagatctgtttgagcagtgagtaaaccatcccaggagagtgaagactgcctgtggaaccaatgagggggaggctggcagtggcagggtgggtgagtgccagcttggatgctggcttgatcaggtgtaggctttagctctaggcctgagagaggtggggagggggggagtacgaaaggaaatgggcaagaaagaggagaaagggaagggggaaggaaggagggagggagagagagagagattgaaaaattgtttcagtcccaacaggattgtggttgtactttgagtatctgttgattgaggaaatatattatgacagaatgactgtgaaggtagtaataatctgcagtaagtgtgttttattaagtgtggtagcttctctgtacctctaggatattgtaatatgtgtgggtgagacctttattctgcctcctgacaatgtccactgaccttttatagtaacactttggccccaaggctaagaatcactgctctaggtgaccaggagtcttcagtgtgcaagcatactttgacttcagagccctgtctttggggctgtcttccatcacacagagagtgtgtttctttaaaaaaaaaaaaaatcttgaggtttaacttatgtacagagtacatggacattaagtgtacagaacagtgtagtgttatcagtgtatatatctgtgtagttatcaagtagatcaagatatagaacatatccaagacttcagaaggctctcttggtcactgcccagccaaaaatgcccttccttgaggaaaccactattctgacttctcttgccatcagtttttgcctgggaatgtgtttctttttctccccctatacgtaagtccatgtggtacagagaaactggaacagggatgggtgtgtatgtgccaaatactacactagacagatttccaggcttaaataaattctcccataaaaccacagacctaggctttgtgttacttatctaaattcaatcccatatctcactgactgaagagtctgtgctttttccatgacaacatgctctgtgccttcaattgacatttgccataataattatcatcatcattagtgtaaagtcactttaatagttttaaattttttaatttaaaaatttttatttattcatttaacagagtgcaagagagcacaagcagggggagctgcagagggagagggagagacaagctccccactgagcagggagcccaacatggggctcgatcccaggaccctggaaccatgacatgagctgaaggcagatgcccaaactgagccacccaggcgcccctttttctttttcctttcagtagtttacatggtagtcataaagcagcagttaacacccaatcccctttcagtgcttttttttctaactctcttggatgtagggggagttgtgctgatttggaaccaaagaacaatggcagtttcttcatttactggatgccagaccatgtgctagtcagtggagttagaaaaagaatctcaattccaacttctaatcttgtaaggggggacggagataatagtgtgataagtcctgtgaagcagagggatgctgtgagatcacatagaattaaaagggcagggttgcgggtggaggcagctccaggtgtgagggaaacgtgcctcctagaagaagtgaagttcgagtggagtttcagagctcataggagttgtataggcaaagaagagggaaagcgggggctccttttagctggagtgagagtgtatggtgtattcagggaatgagtatatggagagtatggtgcattcaggaaactacaggtaattgcctggtgggagtgatagtggtggggtgctatggagtagggaaagacaatctgagatagcaggcaaaggcaaggccctcatgcccctcttaaggagctgggttttgtcctgaaagtaatgatggatttgcaattttggaagatcacttcaggtttttgggaaatggatccatggggttgaaattgagtaggacggcaattcgattaaggctagtaactatgggtagggagaggaggccaaattggagagatatttaggaggtcacctgaacaggccttggtagttgttgatttgcaattgagaggttgatgactactacatagaatttaaatacgatgttaccatgtaaagagaatggatttttttaggactggatttctgtaagtcacaactgaaatgacctacttttcctcctcctcagcacaaggaccttgtttgctttaaaacagccccattacttatttgggggtcatagcagtttgtaaatggaggcctacagttgtatgatacctttttaaaaatcagacagataaattagtcttctggtttgttttattcatcctttgttccttgtaatgaaagctaaatatcccaagtgggtatttccagagaagacccacaaatccctaaatggaaggagcccagtgatatggaaagaagaaaaggcagaccttattcctttcaggattttcagttatttatttactgagacatgtgcagaaagccaaaccagcacctcttgtgaaatggtgtatagacttgattctaagggttttatgcagtttagagccaaccctgtctttgcttttgcctgctaaaacaagctcctctctgtgcacaggatagcagcaagggggatccttaaacccaccgggctattatctagatgcccaggacttcctcactcacaatcctggtccttagctatgggaatgtatcctcctgaagctcagggaccacgtgcataggactgaaaacttctagaaaaggcaacacaagctgcctgggccttgtgattggcagcatctggagttccaaccctgaatggtcccaaaccacaccctttatgttgaggggaagcttttctctccagtcagccaaaatccagccatctgcctgccccaactccaaattttctattataaattcttggcatcttagagcaagagatgttgtgtgggggcagagaatccttagatgaacagaagagaaacggcagtttggctccagagacttctataataaaactgcaagatacatttcttgcctctggaatcactatgtagtgttctgagccaccatgaagctccgctattccagtttacaagttgtgcccagggactgttaatgcttttacaacaacacaagttcttgtttacccagaaaggctcattgcagtttgaagttgtagagtgaacaagcatgctaggtgtggaacaatttatgagtgacttcagtggagtgttttgatgaaatctaataatcacatgctaatctaacacctttgatcatatgcatgatcattattgtgctgcatggtaattataagcagttcacataagtggctgtagttagtattaagttttatgtggccaaatccaattttcacaggttcttgtttattaatttgttggttctccagcatctataattagcatcaatgtcagcattttgcattgatacctcatgtagtctgattctcatcactggcatgctttggttcccctgtgtttaaaacagagaagtctagattctcttctatagaaccccctggagggagagagttgtcctcagtcccattctctctccccaaccaacctcaacctcagagcaactcctacaacatctccctgatctcaggtattttgaaagtcaggggtctttagagaattgaaggtccagttcctgagaatgagtggcctgcccaggggtaggagagcacactctgttggggtgagagactccttcacatctgagaggagttgacaacatattaaagagtaaggattgaaataactgaaaacttctcacttagatagtaaggatttaatagacatttatttatagaactatcttattctaccacacagttgattttaggttttaagagtgcgcttacaagagtagtgtgaggggcacctgggtggctcagtcagttaagcagctgacttgattttggctctggtcgttatctcagggtggtgagattgagccccgtgtctggctccatgttcagtggagcctgcttgaaatcttcactctgcctttgctccaccgtccctcccccccccccccccggttatgcgctcttgctctctctctcaaataaatcttttttttttttttaagattttatttatttattcatgggagacacagagagaaagagaggcagagacacaggcagaggaatgggagaagcaggcttcatgcagggagcccgatgcaggactcgattccagatctccaagatcacaccctgggctgaaggcagcgctaaaccactgagccaccagggctgccctttcttttctttttttttttttttaagaatactttgatatcttggttagaggttcattgaaaagaaatgatacattttagatggaatgagatacagaattggttttgagtgatgtttttaatctacccttgtgtatctatgtggcatgtagtgatgggtggttcagtttttggtggtgagatgcagagccttttattgtggtcctgctgcctgagtgtgtattgtctatttttattgtggttaacctgacccgccatttggttccctaaggttagaatttcctttcctgtacttgatgaatgctatcagcttctgtagaagtgaactttgttctttcttcaaacatttattgactttctgtgctgtgataggttctgtgctaggagctaggtacagaaagatgatcaaatatctcgactttaaataataccttttgcatttacctctgtaatctcttttggcctcaactacccctgtaaaatgcagaaaggctcttcatgtacccacaataaagataagtaatcacagagcaatgaaccaagttgtttaagattgcatatcataatagtggctgagctgaagcctcggtctcttgaccccccaagtattcactaggtaggaaagattaaataaacagtctttgaatctaaaaccaatcagtcaggaaggatggcatcttctccgagaagtttatgcagacatttttaaaaaattcatacaaatgattgagacatacttttgaaaatttgagaattaaaaacattcagaatttaggggtgcctggatggcacagttgtttgggtgtccagttcttggttttggcttgggtcatgatctcatggttgtgaaattgagccctgcatcaggatccgggctcagtgtgaagtctacttgggattctctctccttctatccctcttgcttgtgcgagtatgctcactcactctctcataaataaataaatcttaaaaaaaattcagaatttagacagtaaattttaaaaactcaaaaaaaaaaaaaaaaacctcatagtttgctcaacaaaaatattcatcacctagtaaatcaccctgggcctagaatgatatagtcatcaccttttgatttatatgtattttcaggaagatactgttcagtttatttttaaattggtttgggaggggatccctgggtggctcagcagtttcgtgcctgccttcggcccagggcatgatcctggagtcccaggatcgagtcctgtatcgggctccctgaatggagcctgcttcttcctctgcctatatctctacctctctctctgtgtgtctctcatgaataaataaataaaatctttttaaaaaaattggtttgggagatcgtaggtttcttctaagattgaggaggaaatgtttttgaaaattcggttagccaatattgagttggctaggatgagaaaaacagagctaagtaaggtaatgtgccagcccattttcttgcgcagctagaaatcctccagggtctaatagccatttgaggtttattctgtgaaaaaggcctttgggttctttgtgttattgactcttttcagtttctgaagaacttaggaaggaaaatttcctcacaagtgaagtgagaagagaagagcattaaacattgcattgtagactccaagaaaacagtgtttattgaacacaggcctgtctgaaggctctgagtatggcaacaggatgtgtcacagagttattttttcctggtgctcttagtgagggcttctggcagcagcagtaagagggctgaggtggctcggtatagtcagagagtatggacttgagaccttgctgaactgaggtgcttagttgtatgatcttgacagattgcttgacagattgtatctcgttttttcagccataaaatcgggatgatcttggggcacctgggtggctgagtgtttgagcgtctgctttcagctcaggtcataatcctggggtccaggacgagtcccacatcaggctccccggggggaagcctgcttctccctctgtcactgcctctctctgtctctcataaacaaacaaacaaacaaacaaataaatcctttagaaaataaataaatacaacttttttagaaaggaaagtttagagtatcctgtatctagaaggtcctcagtgggaagtattaactagctctttatgtatgtttatttctgggatcatttgaagtctgtctcacccatcagaatatacattccatgaaggccaagcccatatctgtctggtttgctaacaagtatccctgtccctatggcagtgcctagagcttagtagatacttctatacttggtaagtgaaggagtccccacagtactgtagcatctgagaaaaaatgtagacctgctgtcaataagcatagatctatatttgttagcatctgggcacttcaggtctaggcaggttttggggttttttgttttttgtttttttgttttgttttgttttgtttttgtaggtctttctttttttcttttttggttgatgaggtacagtttgggtttttgtattcccaagatttcctatttccttctgggggattttcttcttctaagtcagcttgtttgatgaaaatgcaataatggggatgcctgggtgctcagtggttgagcatctgccttcagcttgggtcgtgatcccggggtcctgggatcgagtcccacattggcctccccagagggagcctgcttctccctctgcctatgtctctgcctttctctgtgtctcttatgaataaataaataaaatgtctaaaacaacaataacaacaacaacaacataactctcttttaaaaaatgcaataatgaagtgaaagaaaatactggctatggttttgttttgaggtgactggcatattcttgaagccctgatctctgagcccctcagtggtttggggtccactcttggcttaaggcagagcctgattctctccactctcgtcttctcagagaatgtatttagttccaggactgagctgttttccttcttgtagtctgttaaaagcttctgagggatttgagggtaagggagcatcgtgtctgcatcttactttttgacacattaaggaaatctggacacagagatttatgaaagggtgagcccagagtcaatcacaggacacttttcaacaaatattgctgaattggagttaaaatgttaattaatatgaaaatgaaaaattactttgaattgagactgctgcttcctctgtgttctcaatggagcctaccgtggaagaataattagacaaaatgctctctataaagcatctattttaagaagaatgattcaaagaggaactcaggtccaagaaatgttcatcagcaaacaaaaactgaattgccaggtttgccagatgtctcgttttaaagaaagttttcctcatttggtctcttgtaagagtcttccctttggcactgaaatatgttctgcccccatgtaacttaaaaagtttcacaatgttcagaatcccatctctgaaggtcttataattccgtgtggttcagctgggaattgcattgcataaaaataagggcaaaaaaatactacactactggactacagagttctgggaaattttcctaagttatttagtatatacagtcttggtctttggctcaacatttattgagcaccagctgtgaacagacacttctcattctttaaggcagcaagcagcaacatcactgctgcctgcagtgtggttgtccctcattaaaggtatactcgacagccctcctaccttacctggggtaacagaatagaatggctatggttcaagggggctttcctttttatagttagaagacaaagtactttctaaagggcatctcttttgggggtacaacataaaacacttctgcgaattccttaatttgatccactgctgaacctctccctgcaggctgtctcagtgtcccgtgtacattggcagatgaagagcaagggagagaagacagagaagtttaaggagctagctgagcagcctctcctgctttgcccaagcatggcaggcagggctgcctagggagatacgggagtaggtccttggctgagtggagaggctcttcctgtgtggtttatggaaaggcagctttcacttgaggtacatttagacatcagtaatgttttcttttgcaccttttcatttgtgtgacctctttactttgcatccatccaagttcccctgcccctctaaatgttccaaattacctatcacaacccctctaacatagctaggttggacttggtgttagaaaatcagaattcacattaaagtgcaaatgaagtggcaatctgccctgtcccactatgtttgtctgttaaactaaccaaaaaatctgatggtgtgctgcaggaaaaaacctttgagatagaggttctttgctttcttccagctgggtagaataaaggggcattttgtccctacggaatccacagctgactgctctgtatgccctccttgctcactgacctcttctctggacctaaggctgggcccagctgggccccacctcaccaccctgtggcttccctgtaggtgtttcgctctggtgagggtcacaacagtttatgagggtggagctgtgggtgggagggagccgataagcaacttccagaaatcccagactctacagtccttagagagaggaagaggctgtctctggtctccagctgagctccctgtacctggtatcacatacaactggctctccttgagaaggcttttctgctcccctcaaattttctgtctcaggctcactccagaaatgtttccctgtttctcattctgccctctctgttttgtgcctagaaccagcccctgacttgttccttccagagaccaagtttagccagcattgaactcaaagccttgagagtttgtggttgtagaacaaccttctggttgagaatcaaaggatgtggaattccgtgcagttggggagtgggattggcgattctgtttcaaggcaggcataacttgggagaggcagtgtgcacggtgctcaggaatatagattttgggactgctcagcctgggtccaaatgccagctctctgcatagcagtaagttatttaaactctctgtgcctcggttttcttacttccaaattgggaatattaatagtacctacctacctcatagtgtccttgtgaggatctttaatatttaatgtatggagatgttttgaacagcacctggcacatggtagatgcttattcaatgaaacctttatgactgttacacaaggtgaggctgtggggctgctgaagtggctgccaacaggttcatccccgacctgcctctgtgctttctatgtagaacattatgatgaggacaagaaagtggcaaaaggtatctctggatgactttcacaaaagctatcacatgtgttagcatgttgtctcaagatctccttaaagctggctactaaatctgtttcctgaattttacagtccaacgaaaattattctgttgccttctgatctattgaaagaaaaaattgatgcaagcataagaagtttttttttttaacagaacaccatgtaattttgcatattaaatgtgactttgacacgttacggtttcattttgaagtttatatacaccttaaaaaacttgatcctgaatgaatatcaggtatgattggtaaactgtaatgtttgtagttctttatgcaagaagttagaagttagtcccttggaaaggttccctcaggagactattgtttctagaaaacattaaatattggcttggagcaccttttcaggatcgtggcttgcccttgagcccagtctctttaatgtgtgaggcttgtgctttatggctcatttctctttcttcatttctcaccactggtggctctgtactggatgcttcagcatgatttaatttaacaaatattaaatgcccatttgcaattcccttggacctgggccctgtactgactcacatctagagctgtacataacacctcttcctctaaaaccttcatggtctgatttttgcagcttctggtctcatcttagggaaagcagtagttatggtggttaagtgcctagactctgcagtcagacagcatggattcaaatcctagctctgccacttgcaaatggtataaccttggagaaagttcttaacctctttgtttcatctttaatggcagtaatagtagtgagtgtctcacactgttcagataattacaagaggtgatccatagtacatttagcatgttccaggtacatagattagcttctcagcaagtggtagctattattattgctgttgttgtcataaatatttcctgcgggaagtcttccaattctacatgtgaaggggagggagcctttcctttgtgctcccagaacctgttctgtaacttctggtgttgcatttgtcatgcagtgttgtaatttccttgctgtcttgtttctgtccactgcaagccccttcagatactcaaggtctctgtcttggctacagttgtatcctcattacctggtatacattatttttttcttctccctgctctaaaatgttagggtaggtgctttcttcttcttcttcttcttcttttgtattttaaaaaaggagtccttacctaaattgctgttgattttttttttttaatttacttaatccctacacccaacttggggcttcaactcatgaccccgagatcaagtgttgcacacacttccaaccaaaccagccaggctccccagctgctgtagatttttttttttttttaagattttgtttatttagtgaaagggaataaaggggaaaggagaaaaaatgagtgggaaatatcagaaagggagatagaatacgagagactcctaactctgggaaatgaacaaggggtggtggaaagggaggtgggtagggggtggggtgactgggtgacaggcactgaggggggcacttgatgggatgagcactgggtgttatggtatatgttggcaaattgaactccaataaaaaaaagattataaaaaaagattaaaaaaaaagatttttatttattcatgagagacatagagagagagagagagaggcagagataaaggcagagggagaaacaggctccatgcaggaagcctgatgcgggactcgacccccggtgtcctggatcacgccctgggccaaaggcaggcaccaaactgctgagccacctgggctgacctgctgttgattttttttttttttttaagattttatttatttattcatgatagacatagagagagagagagagagagagagagagagaggcagagatacaggcagagggaaaagcagactccatgccaggagcccgacgcgagactcaatcccgggaccccaggatcatgccctgggccaaaggcaggcgccaaaccgctgagccacccagagatcctccccactgttgatttttgatgaatgggtctgcttgcctgttttgtcatgagccaagaggtacaaatgtttccctataccctcattagggcagtttttaaagatgcatcaaatttgggggatgaaaaatcacatttattaagcctattgtgctaggctctttagatacattcttatgaatttttcttcagcttctctgagttaggtgtgaatagacccatttaagaattgtgcaaggtgggcagccccagtggcttagcggttaagcgccactttcggcccagggcgtgatcctggaggcctgggatcaagtcccacatcaggctccctgcatggagcctgcttctccctctgcctgtgtcttggcctctctctctctgtttctaataaataaataaaatcttaaaaaaaaaaaaaaagaattgtgtaaggtgctcaagcatcattcagctttagtaaatgtcagagttgggctctaaacctagtctgattgttccctagcccacagttaaaccattgcagagccttattgtctctactcttaaggagcagtacaagtagacttcaaaactaatcaaagggcttgattctgttgggaagatactgagttggatatgatctcatatattgagcaactgcagtactttaatagcataaaacgttgagactgtcctgcaagcagataaagattttggacataaacaagcttgggaacattagggagaagagagcagagaatcatctatttttatagtttcatttcttagttttccaagagttaaaaatagagctaatcatgccctctaggcccctggatctttggttggtacaaaaaacttagtgtatccaaaggatagtcttatagactttctatcaaaataggccattgtcaaagaataggttctacctctcttctgaatatgttttttttttggacaacaaaacacagatgggcttggaaactaaggtttactggggacagagatgatttaagtggtaagataagctaatcagaataatacagtgtttgttttttattccaggaaacattagagtaccagccttttgtaatattgttaaattttaattttctatttgcaatattaaaaaacaacagagtgggaatggcatgctcttaggtgattaattagtgccccagggctgagctgtttctagtgtaataggcctgccaacttgcatggccacctaaaggaatccccttctcctctggtttgttcagtccctcacccaaactgactacacaaggaccactcagaggagcttcctaatatagctgctgatgaaagccttggcttcaaaaatatcgaaggctccttctagctatgaaattgtataagaactctgaagatacagaagaaaggaaaatctttgttgttcattttaagtccttcagaaatgttcacatcttttcaacgttaacatcttcaacaaattttatttaaaatttttttctaatggtaggtacctgtgcaatgacttctcttctcaaaaagcccaagtgtaacttaaagctttctgatcagaagatggtgaaggtaacgacttatttatcaagacaactgatgtttgttgttcacaacagcgtgagccactttggggagttcttttgggacgcggatccatctagtcaaacttgcagactcagtgttgttagcatctgttggctagtgaaagaatcaggcacttttgtaaacaaatgttatgagcattagaggtttgtggggagactcagaagaacgtatctaagatcttttgaataaatcgataccctcctctaggttgttgcatacagatcatttaaaaccttgttctttgctctgtttcctgtgtggattattcccctctgtccttgtaattgacattctttttttgactaagcctctgaatgtaagggtaaggcaacagcagctaaaatttcaagcacacttaactgtatttgaagcactgtgccaacactttacattgaatcttcccaaaacctcatgaatgggtactgttatccgcattttatggatgaagacactgagtcatagagaagctaagtaacatgtctaaggccagagagctagctaatggatgagccaggattcgatgtggctctggcccacattcctaaccacaacactgttcctgtcagggctggaggcatcatgagaaatgtagactttccaattgaagctgttattttcatacattgttttggccacagacatcaccttcccattgtgatcagcacacctggttttgttttccagcagatttgcagaggtgaaatctgtcctcataggactgaagtttcctttacacacatataagactgctcaggcccactcacagttagcctttgtagctctggggcccaccccaatggaagacagagaaagagggtccagagtacggaggcccaagtgttcctccagggagcagccagaaaagccaccacaggaggaaccagcaagaactaaaggagaagtctcagaaggccatgacagagaaaccaaggaaaagtttgatcaactgtatcaagtgctttagagatcatgcaaaatgaaaacagaaatcagatgagttgctgatctttgagggtgcagttccattaaagtgggaaatgctgatggtggccttgtgaggctgtgcacgagtgtgtagggagtccactctgaggctgttgtatatggaacactgacttccagagtttggcaaggacagtaagaattgaaataggatggcttttggagccatggaacccagtgaagctctattcttctgtgtggttctctgttctaactatatccaaaggcagtagaaaaacctgggggaagggagcaattgaagatgctgctacagtaatgttaatcgcacatattgaacgcttactgggtgccgggtactggataagcatatttcctgttgtgtcttttttaatgtcacattaattcttatttaataaggttaagccacttgtccacactcagaatgctgctatgttgtgtagtttgaaactgaggtctgctgggctacatcatgggtatgatggaatgagcagattataggggagatagagtctgagaagggagatgcttttcttcttttgagaccctgggagaggattcctgaattctggtagagagaggaagacggattaactaactctctgactcttagttacgtgtgctgtgctcagtggcaggctccatatgctcctcatagcttcgtacacaaaaagcctgcaagttgtctgaaggatgtctgctttttttttttttttttttttttttatggtccaagcccttttgcggaggcaggatcttcagacatctagaggaggtttaaaaaaaagtgaatacactaggaatgttggcttggctccacagcctcccaggatctatttgtacttggcattgaatggagggtttttttggtgtgtgtattttcttttctcgtgtatttatggatgttaatatgaaccattcagccaggtctatgaagtctgatagaggttggtcagagtttggttttagataagttttcctctagtttttctttcaacaaaatccttatgcatttattggccccagagacctgtgtcctcagtactcactacagtcctcataaagtcgttgaagatttgtacaaattttttacttcagaaagcttctacagtggtgaacatagttgctttaaaaaaagcttctacaagtgcagtttccctgtttttccaacctttaacccttcctaaaggagacattctttgggggcaagttgttaagtttcgtgtttctctgcagcactgctatttctgaatgtggtttggcaaccactgacaaagggacttttgggtttccaaatgggtggctcctgctatttcaagaaaatctgtgtgaaacaatcaaggacatggaggaggaggcaaaatgatagagacaaaggcataagaatctgctagtatatttatcaatattatccgatcttagaagagtcttaattgcctctagtgtcattcttatttttcctaattatgtcaatcttttttgcctctttgttgttgaagactaatttttaaaaattggtgctcagcagttactattttgtttatttctcttagtcttttaagtgttctcatatttcttccttgcatttatttacaaggagacattgaattcttagtaccttaccagtctgtatgaattatagttacacattactcttttctttttctcagaagccttgactgtcttagcagactcttgatttctttcctgtcccccataaatgattatttcttaataaaatccatttgtttggggccttcggtaaaccctcttttaatatatttttctcctcctagtttctgtagaatggctttactgaagtcctatatgatagatgacatgaaaggtgcaggaaaaaggagtctcattggtccctggtcatgaccagatactgagcatgtaattaggccttggagcaaaggccttcacacattgtgtatgatagccctatggacccagggctaaaagagtaagaaacttagcacctttctagagaaatagctgagaaaccatggaggcctcagtgataaaacatgaaggaagagccttttccccaagaattagagaattttatttatttttattattattattttttaaatttttatttatttatgatagtcacacagagagagagagagagagagaggcagagacataggcagaggaagaagcaggctccatgcaccaggagcccgatgtgggattcgatcccgggtctccaggatcgtgccctgggccaaaggcaggcgctaaaccactgcgccacccagggatcccgagaattttattgagggtgattttgttcatagaattctggtgaactgtgtctggaaatgagaaaactgaggaaaaagtaattttagcttgaagctgggttcaggggtggggagtgctctttgggattcagaccaaatggagctgtctttagttctttagagcagtgattatcaaccaggaatgatcctccccattctctgacattgatgatgtttgttgtcaacgatgcaggggtggggagtggtgctactggtatctagtgggatgctatgaatatatacaatatacaaaacagttaccccagggatgctatgaatatatacaatacacaaaacagttaccccaaaccaagaattatctggccaaaatatcagtagtgagaaagttgagaaaccctgctttagagagagtcttgagagcttttcaccaggagggattagaattaggaagactagaggaggctgtaaaaacactcggatcttattatatgcactaacgtgtccaggctaacatgaagcaaaactatgactaaggttgtatttgtgtatttctcgctctggtgtagttttgtcttctgatgattacaagttatagaaaagaaattttgatgttcctagccactggtgtgctatcctgcagaggacataggtgagggatgctcatcagtaacagtggcagaacattctggagtcttggactctccacagcagtctctgggtgacggccgcttgggaaacttacttgtggtagttgagaaacttctttgatggctcatggcctcccttgaccatccataaccttctattggattggtttgaggaagaaagacagcccctcaaatgtttctaggattttctgaaagtacagtgttctcagcctcttagagccattcctcttggggctaatgatgttagatgtgtgatttctgtctttgacttatactagtgcagggatgggagaatgttgatgatgccaaagatcctttctttaaggagacatcatcatttaattcgtagtttccaaaatggaaccttttgaattgttttgtgactcccttctaatttgtgtcatagcacttattcgaattcttaaaacaagtatttcttaccattgaatcccagatcccaaaactgtggactttgaggtgcagagtgtgtagacaaggagacaaaatgtgttctatctccgtacttgaggtggatttttatattggaacactcacattagtcagatgttagtttaaagagtttatggctcactcatggacggccttgttaccctggttccagcctcccaggaggagaaaatctcctctttcagctgctgctagacactagaaccagtccctgattgtgggtttgaccttgtttcttgtcatcaattaaccaggtattagtagtgtgcagcttggggttgggctgtagggcatatagacatgaatcctgctagcgagtaacttaaaatcatggtgcagtataaagcagtgtgtaattattatatagtgattaggagtacaggctctggcaccaggcttgaatcctgactccagggctttctgctgtgtattttgaggcagataggctaagtttgtctcagtttgtccatttgtaaaatgagaataattccattaggttgttgtaaggattaaattaacataaaatatttggaatggtgcctagcacatactaagtattcaatgacttttttttttttacatgaagaggtacaaaatataggaactagaggaattcagaggaggaggaggtaagttgaggcagatgtggtcagaagaggtttcattggtgggccttgacatgagctgtaggtttgagtcgggcaaagagaacattgtgcatgagggtaagaagggacttgatgtgttttagaagctataaggaaacattaaggtaatgggaatttagtttgggttatgtgattttatgtgtgggaggtgggagagattgataaaatctaacactattctaagggttcattactatagaagggcaccaggggcaatttgggtcacaaggcatttctgagctgtggaatgacataaggacccagaaattcaaacagatgagtctggtaaactgagagagtgggttgaagtaaggagaatgacaagggtcagaaggccagctaggaagctgttctgtaaattatctcatctgggtcaagactaagtgatagccatgggaataaagaggaaaggataggtgtaggtagtcttttgaagtagtgctaacatataggacttgatgcttgttggagacacagggggagacaagtatgaggtgagctgaatcttccatcctgtacgaatggctgtgtaaaaatctggtcagagagagaatgaaaaggaggagcaggttaggggaaggtttcatgagaaacaagaaagtagttacccctcacaaccaagagcaactctaagagcagctccattccccaaactgagaggacttcctttgggctgcaatttgcatgcaggagcagtaggcaacattagcatttcccctgcttgttcagggcgttcagcttaacttggtctgctgtaagcatggcccagacttggcacttaccgtagcacttagtggctactgttcaacttgactgccagttcccccagatactcttgagcacaggcttctcagagaattgagtggtatttgggccacagccctgttttccctgagggagcctctgaaccttgatagaggttggagatactatctccccttccctgttttcacaaaccacagacttctgctgtttcaaatatctataaaaaaaactcggttaccatgataaggcaccaatggtgatatgattgcttttgagattgcaaaggaagaaacatagtggaagaaggggagcagacttacagagccccaggcaccacaggattgtctgaaaggtctcagattttcatgcttggaatcactctgtcaggagcactctgtcacagagatgacactgcagtcttctgataaggaagggccctggcctcccccaggccagggctatagcccaaaagcccaaataaaggcattatcccagcaggggggattgggctaaggaccttctccatatttgctttgtttcagtgattcttttttgaacagatttttggtttgtctttgttttctgtttttttccttccctgctttgtgtcagacactgttctaatattttccaggtactggctcattgaatcttcacaacaatcccatttgaggaggatacagttgctaccctattttatagatgaggaaactgaggcacagcatggccgagcaccttgcccacagttgcacatctagtactgtggctggggttcaaatcctggcaggctagctcttgggtctctgttcttcgttaccttgtctcctgggctctcatcggttagctggggccatcgtttttaaggtggcattttctctttcctcttttagaggaatttgttttaggaatgtcacatataatgtaagagggaatgggtgcttttttgagtcctatagacctgctgtgaagactagctgtgctcccttattcactgtgtaaccttgggcaggtctcttaacctcttttagcctcagcttctaagtctatgtaacaaagataagactggtcatgaagatgtaagacagtttttgtaaagtgcctagaatttagcagttgcggggtcttgagcccacaggattcaaaccctagccacagtactaggtgtgtaactctggacaaggggcttcaccatgctgtgcctcagtttcctcatctgtaaaatagggtaacaactgtactctcctcataagagatctttgtatagagagggagagagagatatcaatgacagataactaaaaaagaaaaatctctttcatggatttcagaagtcctacaacagcaacacagagagtaaaccagaattatatgggaaaaaggtaaaagtgaggcctaatagagactttttaggtctctgggtctcataactaaaagtaatggttatatacctgaaacaaatgtagcattgtatggtatctatacttcaattaaaaaaactttttggggtgcgtggtggctcagtcagttaagtgtctaacttttgatttcagcttgggtcacgatctcaggatagatcgtagatcgattgccacattgggctctgcactcagcatgaagcctgcttaagattctctcattctaactcttcccacccctcatcacatgcgtgcactctttctcaaagaacaagacaaacaaaacaaaacacctctttaaaataatgaaagtaatggttaaccaatacaatctttatagtaaagagagagagaaaatatttcaaaagcataaaaaaaatgaagaaaaaattttaagcaaactggcagatggctaaatactccaatgacaatggtaaagaacaaaactacctctactaggatagatatctggatgattactcatttttcattacttttagggggaggacttagcaagggaggaggggtggtaggttcatctctccaaggctgtgtttggaaggccaacaactgaagtaggtaaagcttaggaaaggaatggagagagaagtttctgtgagaaggaaagtaagtggatggtcctggaggcaatacaagcgcaagctgcagagcccagcaaaacaggattcatactccagccttaccacatattctctgtgtgactcgggcaagctgttgaattcttttaaatcccagattcctataaaatagggatgtcaatgtttactgcacagaattccattagggttgatgaagatgactgtggcaggccctaattgtctttcccccttcttttggccttcttccctgttcttctgctcgactctaatgaagccagtttctctgcctttgcacaatttcctgtcatggaaattaacagcaattttgcaaacttaggaatgttatgtcttctaagaagtatcatttgcttcataccctgatagctaccacagatgtagccaagtccccttcctagttggtaagctacccatgagaagtgacccttcttccttagtactttggtataggggacggttttatgcttatctcaaataaaggcttggaccttcatgctttcttagctttgagatttttcagaaacatgttttatctttgtaaaaagaatctgtatcccctccctttctgctttttttgctccttacaaatgacattatttcatggagccaccaagtcttaagaagtatttaaatcttataaaaacctggatgacttaaaatggttgaaggagggaactgctgtaccttttcttccaaccagtctaggttgaggatgaagccaatttgctgagttctttttccttcatttaggaaagtctcttatagtctacatgcaagcctgggaaaatccacactcagatgaatgtatgacaaataatacccctttatgttctggacacttccaaagagctaacgggtagagaaatggttgtgtaagaagcaaaaaatagaagattaataatcaaagttttttttttctgtaagatctctttttcacaataatatatttttatgagtgaatctgttgtgtttgtaaaatagagactgtaggagaaccacctgtatttatttctgcaattccatggtaatagccactatgcagaataggtagtgttgaatgatgactcaacattttactattctcacactttcagataatgtacacttatctttatcttttccttcgttttatgtattactttctaactgaagaatctgtatgcataccctttagatcagaggcttggaacattgactgtatttgagtctgtattcaaagtttaataaacatatattgcagaagagtgtgttaccctaaaacaatcaatagcttctggagaagagatgaggtgaactgttataggctgaggcttccagcagccagttggatgactgtgggtagttctgacacagtttaagataacagagagaaactgaggatctggaatggaattaggccttcagttctagcctcaactctgccttagagtcatttctccccttttgaccatgcttttttcatatataatataagggagttggtttggatgcttcctagggtcccttctagctccaaagcttctgattcttagcagctttctgcttgtattagagacaagacagatacaggttcataggccataatgtgtgtgttattcttgttctttaacttggtcatatcgaccaaatggtgtgtggtggtggtgctttttcttaaagcttattgaggtatatttcacatgctataaaattcacctacttagagtatacagtttagtagtttatagtatagccacagccttgaacagatatcaccatagtcttatttatttttatttttcttaaagattttatttatttagttggagagagagagcatgagcagagagagggagaagcagccccctcactgagcagagagcccaatgcagggcttaattccaggacctgagatcataacctgagcctaaggcagatgcttaaccgactaagccactcaggtgcctcatcacatagtcttaattttagaacattttttatcattcccaaaaagaaactcccatacacattggaattcactccccatttcctccaatctccccaggtaactactatctttctttttctatggatttgccaattctggacatttcatacaaatggaagataaaaacagataaaagaagaaacctgggggtacctgggtggctctgttggttaagcgtctgccttcggctcaggtcatgatcccagggccctaggatggagtcctatgtcattgggctccctgttcagcagggagtctgctgttccctctccctctgttccacccctccccgcccccatgcactctctctctcaaataaataaaatctataaatgaatgaatgaagaaactcaagcaacctggtgtgtgaaataagcggaaaaagtgatccatgacagtctggattgtgcctggagtcttagcataatgttttccgggttcgtctacattatagcaagtatcggtacttcattttattaaattgccaagtaatacttcattgtatggggatgccagatttacttatccattcagctgatgaaaatttagattgtgtccatgttttggtcattatgaataatgctactttgaacattaatgtacaaattttgtgtgggcataggctttcatttctcttggagtgagttgctgagttctatggtaactctctttacctttttcaggacctgataaattgttttccaaaatgacggcaccgtttttgcagtcccatcagtgtttgagggtgcccgttttttcttatccttgctagcatttgttattgtacattttattttagctatcctagtgggcataaagtgattttttatttgcttttccctcatagctaatgatattgagcaacttttcatgtgcttattagccatttgtatatcttttttggagagctgtcttttaaaatcctttggccacatctgattagttatttttatttttattgttgagtgagaagagtgagtccttttttaaagttttttttggcagtgtggaatttaaatttgtgtcactgatcattccagcactactttggtagactaaatatcactggttaaatggattttttgaagtcaatattagaagtggaagcttgaaaagattttaaatgcagggtggccgaagggtcatgcatggagtgatgggaagaaggttgttttgtggggtttttttgttttgttttgttttgtttttttgttttgttttgtgtttatacatggaaaaactttaagttttctggaagcaactgcccttccttcaaacatttgacttcctttgatagcataccatgcctgatttcttcccacctccttgtggctttgactgacatcttccaaaagcattttcagggctaatggctttgaaaaatactaatgaattagatggaaattaatgcaatcaaacattgttttcatttgaggatattgtgggtttaaaaaaaaaaggcagtcaatagctgatattttatggcttgttattccagaaagtgtggctctagactggtatactgtgatatctggaggaatgagctggagaaagggagaagaatggaagaaccaaccaaataactgtgtatgttggtagattgaaagctttgttttttcttttgctctccttaaaattgaagcatttttaagaaagttgatgagaaaggaaactctcatcttagttcccaggatacttacaacactaggtgaaatgggcttctattcaccgaagtctttggagcttgcctagagcttggttagctttaaattattttggccttattcaaggaccctgtctagttattgtccatgttttcatttgcatgtgggtatagctcaggggtcttccctgtgctccttcccttgggacttaacacaagaagaaaaaaaatcttgcaattttgccgcttagtgagtgttggaaactgggcttcatgacaagttggctctgaaccaagcttccttgctcttacacatgtgaaacctgtttcttttggctaaggtatttaaagaaaaaaaagtatctacatctcagctaaaacaatcttgccctactctcctccctttccgttaccccgcttctcttaaacttgttccctctttcttccttcccaatttattaagactgctgtggctcactttttccagttaattcaaagagcaggctgctcaggtttcttctgtcgcatgtttttatctcccttagagcagtggccatgttaggccatttgcattcactctaatataagaaaatctttttgagttttgtcctttcaatatgcttgggagatctgaccctgttttcatgcatggggatggactgatttacattttttaatgcccatcttctgaatccgaagtaagactacctagtgtttgcattaaaaactgccaagattaaatgtggagctgggactttctgacattgttggactttattttttgtacttgaattggtgaaaggaaaatgcttacagtaataagttggtatcctcattcctggggtttttgacatctgctgtgttaaaactaaatcatggaggcataaaactctttaatatatgttgttaaaagccccactggataaaatacacattaatattttattttattttttattttattttttatttttttattttattttattttattttatttttattttttattttttatttttatttatttattttttttttatttatagagacagagagagagagagggaggcagagacacaggcagagggagaagcaggctccgtgtagggaggctgacgtgggactggatcctgggcatccaggatcacaccccaggctgcaggcggcgctaaaccgctgctccacaggggctgcccacattaacattttaatattaaaagtgtgatcgagggcaacccccggtggctcagcggttcagcgctgccttcagcccagggcgtgatcctggagacccggatcgagtctcatgtcaggctccctgcatggagcctgcttctgcgtctgcctgtctctgcctctctctctctctctctctctcatacataaataaaatctaaaaaaaaaaaaaagtgtcatcgatacctcctgtagatctctggccaccaccaactgtgtaagaagaaccatgaaagaaaaaaggtgcaagttacttatttaaaataaataacttgggtcacctgggtggctcagtggttaagcatctgccttcagctcaggtcttgatcccggggtcctaggatcgagtcttgcatgaggctacctgtgaggagcctgcttctccctctgtctatgtctctacctctctctgtgtgtctctcatgaataaataaataaatctttaaaaataactcccccgtgaagtggtgatggagttatcctgtccccagcaactgggaagggagctttaggaacttgttttcaagtgctcagcacgccctactctgtagtgtgcatccaagaagtatgcatcatagggagagaggtagatgaggaaagcattgaaagggaagaggcagtgtatatttggagaaaggtgatattttgctgaatcaatggggatatgaagcagtgaaaaagaaagtaagaatgggaagtataagttgtgactggaccacacaagtaaccaatctttcactgagtcattttggcctcattttgaagtctgaggggtgccactgaaggttttagagtagcttaggaatgattagactctggctttaggaaaattaacctggcaaaaatctttatagtgttcatcgtggggaaactaaattaggacaaggtgctagggggcaacctgggtttagcaccaccttcggggcagggcgtaatcctggagacccaggattgggtcccatgtcaggctccctacatggagcctgcttctccctctgcctgtgtctctcatgaataaataaataaaagtcttaaaaaaaaaaaaaaaggacaaagtcccagggcctaaaataagtcagttgttttgtagcctgtactcttctagaatttgctcttttatatataatatattatatatatatatatataacttttataatataatcatataatatatattatatatattatatatttggtcatatatatatatatatatcatggacatgttcctttgtcattgaactttctttctttttttcttttcctttccttcctttctaaaagattttatttatttgaaagagagagtgagccagtgagagagaacacaaacagggggagctagatataccacttttattaccaataaaagtgtttgacagttgtggccttgagctgcagccaaatgagcgcactcattttaacatctgaagtggacaacaggcttacagactaatcactagcagaagtgtcacaggagccattccctgaagggcaggctctttacttcttgggatgggacagatcagaaaacatgcttcctgcagactgagaatacaagtctctttcacagcttcactgaactgagttcacaagtgttctcaacaaactcacttaatttgatcctgtatgtttcatcagatttgtggaatttgcttgcagatcttgttgcttgagaggacatctaggttgcagtatgcatttgttaaatattgttatcacaaattagtccagtttgccttagcaatattatgataggcacaatggtgaagtaaggatttagttgccttttgctatttgctttcaagcaatcagaagtaaaaagaataaggcagcccggatggctcagtggtttagtgccgcctttggtccagggcgtgatcctggagacctgggattgagtcccatgtcgggcttcctgcacggagcctgcttctccctctgcctgtgtctctgcctctctttctctctctctctctctgtgtgtgtgtgtgtctctcatgaataaataaataaaatctttaaaaaaataaaaagaatatgctaaggacaataaatgctttgcatttatttgaatagtgtttgttaatggcttcctcattctgcttcaaagaaatatctgcaaagtatatgacagtacaaaagtcaaccacagcaagcttgaacagtcaggagtattttctgtttctctgcccttttcatgtcttgctcatctaagaaacgtgactgctgctcccagcacttgtgggcggtggctgaagctgcttgactagactttaaaggaagtgctgtggtacaagcataatgagttttagtcagcttgatcctgtttagatggccactaatgctctcatttccagatttgacttcgcagggactattcacttatcttttgagccaagaatagtcctaagataagaggttatgtggattaagaacagagtgcattttgcaccatctaatgagcactttgtgtctctaaagttgagattccacaaagggagctctggaaaacaactgcccataaatttagaagatactgaaaagattaattatacattccttatctcactgagcaccctgagctgaccgatatagttcactgacctgaagatggatccaagaagtctggaatgtgctgtttcacattgtttctcttgagaaatgtatttgatcaatgtgcagagccttcggggcaatacacttggtatgacctttatccttgaggtacctatgggagtctgtatgtgacatacacgatgaggatgaggatttggaggaaaaatggaaatgagagatgatttacattgtatcagtctatataactgagaaatacttttttctgattattcttagtagacagtcttttctatacatttgatataaaattgagccaagattaggaatgctactaatcctaacttttctaaaacaatataattttaaaattattaagataatgcatcttcatgatgggaaaagtcagtataaaaatctataatgtctctttattccttcagttttttcagttctatgaatatatatattttaaatttttttcctatgctttacaaatatattccatttttgttttgataatgatacataatttgcagtataaaaatctataatgtctctttattccttcagttttttcagttctatgaatatatatattttaaatttttttcctatgctttacaaatatattccatttttgttttgataatgatacataatttgcaggttgggtttctttacttaacacattgacattagttaattgaaggatttttttaaatcaccaatgagtattgagtcaacaaatattttgtatctaatgaaaggaacatatgatttttcctctttaatatgttaatagatacatcagatttgatgttcaacactcctgacattctttttttttaatttaatttaattttttttttttaatttttatttatgatagtcacacacagagagagagagaggcagagacataggcagagggagaagcaggccccatgcactgggagcccgacgtgggattcgatcccgggtctccaggatcgcgccctgggccaaaggcaggcgccaaaccgctgcgccacccagggatccccactcctgacattcttagtatcactttagtcagtccttaaaatgaacagctgctcttttttaaagacatttcagagatgtcaccaagcagcagtgtgtgacctgggctaggatacctgagaggggcgtggtctgacttaggctggaaatagggctgagcacacagtgtaggagtcaggaaattgaattgagatccgacactttgggagctgttctcagtgtagttgttggtggttagaagttatacctttattaagaaaaaaaagaaggagagagagaaaagaagtgataccttattaggggttaataatatcatcagtctacaaagtattggatctaaggaacattgtcctagttgtaaccttgaggagtttgcatacagagaggttttagcactatgactgctttcaatttttggagtttattatgtctaattttctttcagagtcctttggggagatgtcttagtggccaggtggaatttctcatgccattctgcaattaaaatatttgggtgtctttcaagtactaggtcacaaccatggtcatttcatttcttcgaggaatctgattccaagggtaaatttctctgctttaccagctctttctagaataactggtgacttagcagtacatgacagagtaattggagatgtgctgtgaacagtcatcataagtgccagagctcaagtactcttgggtttatatggtctagatttaagattagtagcttgaaagagatgtgatctgttggcttctcagagctaagacagtttaaacatttaggtttcatgctcccaatctaaagagtgactgaatgggtgatctctacagtttcttttatctccataatatttcaattttgtgtaatcgcacccacttctcttagactcatccctcagttgagaactgaagattgcaggcaggggtgggaagttagcatcttggcttgtgtttaaattgtgtcacccttgttggcttatgccccgtttcattctgatgctgatttttgtcttcccaggttttggactatacattgctatttctggcattagtgttcattttttagggactgtgggattttttcagtagacttaatttttaaatttatagaaaaaattgctcaaaggacagattcctatataccccttccactccctcacccccacagtttattattaacatgctatatgcatggtattagcattctgactgtgtgatacgcttgttataattgatgaaccaatattgatatgccattattaactactctactagggttcactctgtgttgcacagttttgacaaatgcataatgtatatacccatcattacaataatcatacaagataatttcactgacctaaaaataacctgtgtttcatctatttacttatcctccacacccccctgagtcccaggcaacctctgatcttttactgtctttaattgttttgcctctactggaatgtcatatacagttaaccattgaataacatgggggttaggggtactaacagtcaaaaatctgcatataacctttgcctccccccaaacctatactaatctctcacagtaggccaaaagcctttctaacaacataaacacttgattaacacatattttgtatattgtttgtactgtatactgtattactacaataaagtaagccagagttaagaaaatcataagagaaaatatatttgtattattgtactgtatttattttttaaaaatccatgtataagtggacctgctcatttcaaatctgtatgttcaagggtcaactgtagttagactatatgttgcctttccagactggcttctttcacttagtaatgcacatttaagtttcctctatgtcttttaggcttgatagctcatttccttttagcagaataatattccatttcctgggtgtagcaaagtttatccattcacctactgaaggacatcttggttgcttccaagttttggcaattatgaataaagctggtataaacattcatttgcaagtttttatggacatacattttcagctcatttgagtacttcaagtgcaattactagatcatatggtaagtctatagttttgtaagaaattgccaaacttaactttcaaagtgattgttcgcattcccgatcacttcgcattcccacaggcaatgaatgagaatcttgttgcttcacatcttcaccaatattttgtgttatgtttctgattttatttaattgtagtttaatttgcagttccctaattccctaattcaacatgtgatgttgagtatcttttcatatgctttgttaccacccatatgtcttctttggcaaggtgtctgttcagatcttttgcctgtttttaagttgcattgtttgttttcttattgctgaattttaagagttatttgtatgtattggatacatgtcctttatcagatatgtgtttttctcccagtctgtgtcttgtcttttcattctcctaacagtctttttcaatgagcagactttttttatttcaatgaagtccagcttattaatatttcccttcatggctcatgtttctgatgctgtatccatagagtccaagctcatctagattttctcctattatcttctagaattttatagttttgcattttacatttaggtctatgatccattttatgttcattttgtaagagacataaggtctatgtctaaattcattttttgcatatggatgtctagttgttgcaacaccatttgttttaaaggctatcctttctccattgaattactttcgttcctttgtcaaagattcatatatttctgtgactatttttgggctctgtgttctattgatcttttgtctgtttggtggtagtgttgtttttgtttgtttttgtttctgccaataccaaacagtcttgataattgcagtttcagtaagtcttgaagtcagatactgtcagtcctccaacttgttcttctccttcaatgttgtgttagctattctgtcttttgcctttccattaaaactttagaatcagtttattgatatccacaaaataacttgctgagattttgattgggattgttgaatctatagatcagtttggtaagaattgatatcttactaatattgaatcttcctattcatgaacatggaatgcctctctatttagatctttgatttctttcatcagagttttatcattttcctcatatagatcttgttcatattttgttagattcatactaaagtatttcattttgcagtgctaattattgtaagtggtgttatgtttttaatgtcaacttcagtggttcattactagtatctaggaaagcaattgacttttgtatagtttgtgtcctgcacccttactataattactgagttttaggaggattattttttgattcttcaggattttgcatgttatgttttatttctttcccaatctgaatacttaaaaatttttttaaaaaataatctctatcccaatatggggctcaaactcatgaccctaagatcaagagttgcacacttctctgactgagccagccaagcacccctcaattggaatactttttatttcctttttttaagtaggcttcaccctaactcacgaccctgagatcaagacctgagctgagatcaagagtcgaatgttcaaccatctgagccacccctttgtttttccttttcttactgcattagctaggacactgagtaggagtgatgaaggggggacatccttgttttgttcttgatcttaggggaaagcatctagtttctcatcattaagtatgatattagctacaggtatatttattcttaatcaaatgtggaggctcttctttattcctaattttctgagaatttttatcatgagggggtgttgggtttttgtcagatgctttttctgcatatcttgatatgaacatatgatttctcttctttaccttgttgatatgataggttacattaattgattctcaaatgttgaaccactcttgtatacctggaataaattccactcagtcatggcatataattctattcatgtattgttatgtttgatttactagtctttttttgaagatatttgcatctatgtcatgagagaaagtggtctgtaattttcttttcttgtaatatctttgtctggttttggtattaaggtagtgctggcctcttcaaatgagttaggaggtcttccctttgctttgcttttctggaagagattgcagagaattggtatcatttctttaaatgtttggtaaaattaattagtgaaaccatctgggcatggtgccttgtgttttgtaaggttattaatttttatgtcagtttttaaactagatataagaccattcagatgatctatttcttgtgtgaattttggtaagaattcatctatttcctttttttctttttaaagattgtatttatttatttgagagagagagagcacataagctgggtgaggggcagaaggagatagagaagtagactttttgctgagcagggagcccaacgcgatgcggggctcaatcccaggaccctgagatcgatcatgacctgagctgaaggcagatacttaattgactgagccacccaggtaccccctctccttttaaagattgattgattgatttgagagagcattcacaagcaagggggaaggggcacagggaaagggagaggatctcaagcagactacccgctgagcatggacccctcccccctacatggggctctatcccaggatcctgagatcatgactggagccaaaatcaagagtcagacacttaactaactgagacactcaggtgcccccaaaatttgtctgtttcatgtaaattatgaaatttgtggatatagagttgtttataatcttttattatcctattaaagtccatgggatcagtaataatgactcctctttcatttttgatgttagtaattgtgtcttctctttttttccttgattagcctggctagacatttattaattatatcaatcttttcaaagaaccagttggaaggacgggatttttggttcatgttataggtaagaggcataatcttgactttgagtcagtctctaaatttttgccagtaatcgctgtatttgtgtgtgcacaaaggcataagtatgaagatctaatacagagatatcattagaactttttaaggactttcattaataagactaaggctttcattattaacagaatggtgggtcagggagaacaactttgcttgctggctccctatgctagctatgtatcactgggcaagtgacttcacctgtctttagttttatgtactaatcgcttctctgagcatgttaaaacttgtagcgcgcaagttcttattttactgtttagaatgaaaaatagagctaacataaagtgtctaatatatacctagtagactctgtttgcagctattgtatttctaaaacacatcttagactcattaaagattctctgggttaaaaaaaaaaagattctctgggtttcttcatactctaggtctttgggaagtgataagggctttcctcttattcattgatatgtgaagctgtatttcttcccatagagagtttttggtttttgtaaatggctgcctcttgacttgtacatttaaaatttgagaaagaaaaagttgtttgtgggaaagccatccagtttgggaaactattttccagcctttatggtcaagtctcttatttctgatttggtagatactggacacagcatggccttgctttttctgtcaggtgttttgccatggttcctagtcatccagtgtgagtgctgatttttggccagactccaaggacagggtaatgggtgcttttggggaaaggtaggaaaggaattgggcaaatagcacagatttgggaggctgattaaatgcagatcgcagcagagttcctgagacaggctctgggattaaactagattgaaacatagtacaaatagagacaaaaaagtgagtggacttagttaaagccaaaagttctgttgttgttttgttttgttttgtttttaattttccaaagtaatgtgccttgtttagctgttttcactaatggaaattgcaactaggtggctacagcacttactaagttagggagaaatgactttaaaaattagttttttggggtttttttttttttaagattttattcatttattagtgagagacagagatagagagagagagaggcagagacacaggcagagggagaagcaggcttcacgcagggagcccgatgcggactcaattccgggatccaggatcacgccctgggccaaaggcagatgctcaaccactgagccacccaggtgtccctaaaaattagtttattttttatttttattttttaaaagattttatttatttatttatgagaatacacagagaggagagagagagaggcagagacacaggcagaaggagaagcaggctccacgcagggagcccgacgtgggactcaatccctggtctctaggatcacgccctgggctgaaggcagcgctaaaccgctgagccacccgggctgccctctaaaaataagtttaatcagaaaagcttaacacagcaaaattcatctgtataacctgttaagtatgtattttcagaaataattgccttgttttctttaagaacagagtgtgatttttagatatgaaaccatctgcttgggggaagttactttggctatgtagaatgaaagcagggagggggttactagtaaagtgattctgagaaggagatagttacttatatcctgagtctcttggttcagagtagatggtggcacttgaataagaagtcttggtcatggaccagatgccgggggtggggtgggggggcacagttagccacagccgagagattacttgctgccccttagccccctcagagtgctctggcttcatctgcaaacctcatggacttcacctcacctcctttcctttcacctggccttacagtaccagaccattcctcacactgggatttacccattcgcagaatgactctgagccttaacaatgagagtgtttaattgtgtgctggactgaatgttcaaacctcttggtcacttcatgaagagaagaagtaagggaaggaaggcagggaaggtgatggaaggagagagctcaggacaaatgtcatatgaggaaggaaggaaggtttctcctcgcaggtggtatagtaaaaagaacatttcacaggaagataggcggcttccattttcagtctagttcagctatttactggctgttttcttttcttttcttttttttttttttttttttttttactggctgttttcttttccgcagttttcccgtctctaaattaaaagttttgggcaagatggttttaggcactggagattgagagaggaataaaaacaaggcccctgcccttgaggagttcatactctgatgaaggagacaggtttgttgtaagcaaataaaacagagtattggaaggttttgaatagaggactataaagaaaagctgtgggtgaagttaattcagtctgaaaagtgggatgacatttcactggggctttgaaggatgtttgagatttcacagagtttaaaataggatgagtcagaatagcaagcataaagacaggggacacgtagctggtgtccaggatgtgtacaagagtgtggaaggtggtagagtcaggtgactgggtaactgggaagggcttgggaagatccttattgcatggcagactacgaagctttccccataggcaagagagagccatcaaaagctctttgggaggaatatctgattgtgtacgtattttagaaagttaatagtgacaacattgtagaaaaaaaaatttttttaagattttgtttatttgacaaagagagagagtgtgcacaagcaaggagaatgggaggggaagaagcagactctccgctgaacagggagcccaatgacctgagccgaaggcagacgtttaaccgactgagccacccaggcaccccaaaagtgttttttattttttgttgagagagagagacttaaggcaatcaagatcattttggagattatttcaggagtaagatagcaattttggaagtggagaggaagggacaaatttgtgaacagttttaggatgtggaatatctgggattcggtaaccccctgttgactcactcacctcccctaacctcactgtcacttaaactagaggtaaagagccattatgtacaattcctacaacatcccctaaagtccactagcctttgaaatcactgactcatttgttcccttcccctggggactggtactgccctcttttgggcaagcttgttcttagcctctgtaattgaagagctccattcagaagcaaatgggaataattgattttcatccgccagaggctggaaaaatcaaacaccacaagaggtttttttaaaaaggaggccaagtccagaaatcaattttctccatactccttcttaaaagaactcttaagaatctcataaacagaatttgtgtccctgaaatagatctggcttcacttaaaaaaagaaaaaaaagaaaaaagaaaaggtaggcgtgtatttggggaggggttaaaaattgtctcactattgataaaacagtaaggaagagtttgttgaagaccactgcaagtgaaaaaagatgaggctcccttctgaatataacaaggacaagtagggatttatagccaaggagcagggagggtaaagggtcaggggatgaaacattcctaagaggaagcagcagggtagggggattcttgctaaactgacctaactggattcttgccaaaggcaggccaaggacttaaaccgcaaaggtgggggatgagaaactgtatcagatagggtggggaaagctcttgttgaacttaacaggattcttgctaaaacttacctcagcagtccaaagacaggatgaggaccaaagtcaaggcctagttgaaaagaatactcagaggaacctgactaaagtttggtcaaggagagaagtgagtctttatcagtttgtgtatgtgtgtgtgtacgtctgtgtatatatttgtgtgttctattacataagtaatgcatgactcactccccagaactcatcagtctaaactgtttggtacatagccttccatatataagcaaaggattagaaaaatacaccattccaacagaaatgagatcatactctatatactgttatgcaggtgcatttcccacatcatatatcttgcatgttttctcgtgtcagcacgtatatactgactgttctcattctttagaatgccttgcctcactttagatcctgagtcaagcccttatatttttttcaggttttttcatgcacattctctcatttattccataaaaataaccagtttacagggtttttcacccacattctcccatttattccataaaaataaccctctcaggttagggagagggcaagtgacatctctactgtacataggggttaggttatttactagagattttgcagcttaatctgtttgaagtctaggctttacacatatgggtcagttgcatgtgtgaataaaattgagatctttgacattaagatttcatgttagccacatccataatactatttttgtctgtggtgcttgggcccttaggaacatggtgtatgtaggacctggaatctcataataaatttcatttgaggtgttcatcccttttgcaggtattaacttccatatattgaaatttttgtcattttaatttccttaaaacaacggtagtcatcttaaatacctttagattaaatgaattcagtcaatttgtatctttatactgttgatactttcaatagttaccttaagtaatgaagtttgtcactaattggatttctgaaaatgttattaagagtctttcagttaactgcctctactccttgccctctgggacttattttctacctagaacgtagtgcctttctctctcagccctttttattagtttcctatgaccctggtgagaaagaaaaggagcaagacagaatgaatgaggagtagggaatgtgaagcagggcagaaataagagagtatgagctatgggggagtcatcttattcatgaatgagaaaaatagtggggagagcatatttcaagaagttgcatatagcacagtggttaagattttggagttaaacccagtgtcacccattctagctctatacccccggttaagttatttacctctcaacttgtcagtttcctaggactcccttttagagttctggtgaaaagtaaatagttatttaatccgcttaattaaagtctacttgggtcaaggtaaacatttaatgtttgctgttgtttctaggccttttagagtcaaaattaaagaaatgggtctcaaagtctggatggagtaaagtgaccatataatttattgtccaggtcaggatgctgttaataattattctgggacaacagatataagtcaagatttatgatttctctaaggcaaggcatctttgtcctcaaatgtgactgattaaggtaccctaccttcccacctcagcccagtgaagcccctggactttgacaagccagggagcaaatcattcttataagcacttattcagacacacacacagacacacacacagacacagacacacacacattttcactaaacaagagaagaaatagtgctttttctttctaggtaacatgttatcttagggtggaatgaatctgcatgcatatgtagtaaaatttgtgcagtatttttttttttaagatttcatttatttattcatgagagacacacacacacacagagacagagggagaaacaggctccatgcagggagggaccccaatgtgggactcgaccccgggtctccaggatcacaccctgggccgaaagcggcgctaaaccactgagttacccgggctgccctgtgcagtatttttttacctaagaaatcacttggcaggggcgcctaggtggctcagtcggttaggtgtctgcctttggctcaggtcgtgatctcagggtcatggggccaagcccccacatcaggctccctgctcagagtctgcttttcctctccctccctgctcagtctctctctctctctctctctctctctctctaataaataaaatatttaagaaaggaaagaaggaacttgacagaagatatttgagttcttatagtctctataatctaaaaattaccatacttttctttgagtagctagtcccccctcatgccattagatgtagatttctcttaatctttgagcttgcagcgtgtggcaggtgcactgctttcttggcagtgagtatatagtggtaagcatagttgtttgtattctagtgagaaagacagtcaaatagtgacaaatacagaactccacaaactgaaattggagcaataagggcaaagtaaaagaagctctataagtagctcatgaagagccagtcttgcctggcctgggaagaaaagaaaggagttccctgaggaggagagctttgctcaagctggataggaattaaagaggtcagttggaatggggagttgaagaggagggacaaaggagcctggccttctaggacaggagaccctgagtggaagaatgcagaaaaccatgaagtgtctgcttttacaagatcaccttggctgcagtgtgatcacacattctccctgctgtctgcaaatcctgctcatcccttttcttgctaatggaatgccattcatcccagccttcttcccttagcgtttgcacagttctttatttatttttttttagaagatttatttatttattttttttatgatagacacagagagaggcagagacacaggaggagggagaagcaggctccatgccgggagcccaacgtgggactcgatccaatccggggactccaggatcacgccctgggccaaaggcaggcgccaaacccctgagccacccagggatcccccgcacagttcttttataacacaaatcacattgcattatactttttgtttctgtgtctctgaagttctttagagcagggacttggtctcatttactgcaaggtacctagaaaagcacaatggcatttctctttcttccttctgggctccagatactatgtagttgctgcttgggaaggtggcacgagacaggcacagtccctgctgtcatagagcatacagtgtgacagctgtttgtcttgctcggggactgaacgcattgactgattcgccagttcgaatcagaattttgaactctagaggtcattttcatgcagtttagtactaacttttcttgcagctatggaacagaaacagtgttaagaagccatgtcaaggtaaattgaatcaaataaaagataagggccccaaagtaatagtgtaaaccatgggggagctatggcttggaaaaatttcatttatacatcaatccttctgaatacattatagtaacagcagagaactcctttagtggcgttcgcttcatggcagcatacctcctaggtgtcatgtccaagtccacagtgagacagcagtttcattgtgcaccccctcatgctgccagctcagattctggccccctgctgtagacattggaggcagtgctaggcttacctcagaaagtagccattcttgcagtgaatgtccaaggactgtctccctgccataatgcaacttgctgacatgtgtgtgtatgtggtctagaagcagaagggccccgaatagaatgccgtagagagcaacactggacgtaaccagtgtgtctcttctgaacaccgttgttcttggcagaaggcaaaggagcactctttgctggctttgtggaccaaggaggccatccttccaaggtagagggtgtcagtcatgtcagctgggaagttaaaaggaagcattgcctttctgctggtgtttctccctcatgagggaataaagccttcaaggtcactgcctctcattgtgctcaaaacataaaacacatggccacaaaaagccacagttaccagaattatacatttcatagtttattagggcttatccaatctgtcatgtagtgtcagaattgtttctgacgtttttaccagaaggccatttacacacacctgagttcctttccggtaaccatttccagctcatagccctctgtagctgtatcatccatattttggattattatgcttattgctgttgtttctggatttttaacttttaggcatcctctgtcagtctttgttgtgaagaggttttagccttcttgcactgtgttaatccactgcctcttcacccatcagatagttcacaatttttagttatagcagtaactaatgtttatgttgatattataatggctgttagtattattcacctgctggcccaattagcatactacaatctgatttttttttcctatacagtccactaactacctatcttgtcagtcttctagtttcctatgcccagctcattcttaattcccaaactacaaccatattttttaaatccttaaatgctattttccacatcccgggcagacatatctgtagatcttatcagtttctttttctcctacaggcaggcctctggagccctgcgtcctttagccacgcttgaggcttgctgcatggctgatcccctttgccttttttttttgccccatttcctggatgtctgttttcccctttcttggtttgctcatttatttggtaaagcatatcctcgagttgcttcctgataaaaggtgtgtgggaggtaaaatttgagacccggcatgtctaaaaataactttattctcttctcatacttgtctgataatttgtctgctatagaattctaggttggaaatcatttcacctcttgaattttgaaatcatcactcttttgtcttatggcttccagagatactattgaaaattctgatgccactcgatcctttgtgtgccaactgttttttattcctggaaaatgtattctctttatcccatgacttctgaaatgtattcagaaatttcacagtgttccttggggatgggtctttttaaaaattattcattgtactgagcataggatggactctcaactggaagttcgtatccttcagttctaggagaatctctcaagttttgtctttgataatattctcctttctgcttttctcttctctctggaactcttggtcttataatctgcttatcttttctcttgtatttcccatctttttctttggttacactttttgtgagacttactcagatgtatcttctagctctttatttctgctgtccttttttagttgccaaaaactttgcactgattattgcagtttttttctggtcctgtttttgtgtgataatagtttgttgttgctgctgttgttttgggttgagattttatttggttttctgatttctattcctttgagtccctttattctgttttgtgctgtttaatttcatgttaaacaccctcctcaaatgtctttggttgtcattttcatttaagagcaagtcactaaagaaccaattgcatggtctgtatagaggtgggaagaacttgacaaggataggttttatatcatatagagtgattgggcaggaacccacctgctttgatggggaatcccccaaagtcaggatctgttgaatttttccagggagtcctttggcttctgcaggaaagactcttccaagtttctgtttggggatgggagtggggctgccagcattctgggagcagagctgagatcacatccttcaggatatagacttccttttagggtttctgttttcagtaccgtgcttctctgccttctgctgttcctgatgtccccacctctggagctcatctagttcaatttcttcacagaacagatctaccttctcctgcctggatacagggagtaaccatctactggctgccctagatgtaaccagagatgtaatgctctaacacctccatataaacagaatttgtatcaagttcttgtttttaactgctccttacccctggcttcatgtaccacctggtatctctaatccctgagccttcccaggctatgtatgtgtgaaggcaaaaaaggcatccccttttatggccacggggattcactttctcagttctgctaacttctatacttttcattttccaaaaaatgttgacattttatgttcactgttctctttctcctgtcccttgttggtttttacttgcattttaatggggttcaggagtgagcagaaataaaatacatgttcagtttttcacccttaacttgattttaggggaggttgcactgtttctggagttatgtgtctaattgcttcatgttggtgagctgtgtctttttccaaagatcacaagcttctttgacattggggatgatttcaggggctccttgttacctcttcgtttaaaccttaatagttaagtatgtagaaggcattttagtgaggatgtgtcaaatttgagtaacatgaagtctttttaaaattagactggctttggataatgtttcattatattgaaaaactgccagccccacttcaagttcagagagaaatatgcctttgctaggataactgaaagaggaaaacagcaaaggcctttggcagaaaaactgctatttagaccttaatgacttcatgaaactgtatggaaaactgctcagaacctcttacccctcatgtttattgccattgctctctcttcatagagctgtgctagagaaggccctttcctggcttagcactctgagagcctttgacctcctgagaattagcacaggaggtggacagagctccaagttgtttcaacagtcaagttcaagatcctggagaaactgggaaaaacatgcactgacagtcaaacatgggattttgtttcagggctgcatgaattagctgtatgatgattagcaggtcattcgaacttcagttttcttacctataaagatggaaataacactctgtactttggtactccataatatggttgtaggggtcaaatgtggggaacacacatgcaggtaaacacttgaacatgatcattttaaattaattacgtaaccaacacagggcattcgggaccctcatcgacccacctgctgactagacatctatgtgtgggagtccaaatccatttcaaccctgaataatctggttcaaactttctctccctcccctcttttcttctcccctacctgacaacatcaccatcacaaaacaaagtgaccctggttttcctcccgaatttactctcatttggctcttaatttttcccttctcacccaccctcatgctcctaccctgatttagccaccagattttcttttcattgattctatcctttttcctctgtcctccttatgactgccttcattcaggtcctcacttcatgcctgaattgctaacttccagccaggctccctggatctagtcacacacttcttcctctccatcatctacacaactgcttagcataatgattttttttttcaaattctgaaatatataagaccatcacaacagcatggtaaatagcaagttagctgttgaggttcccatctcctagctgttaacagaaggatttctctaaaacatacatctgattctcctcaaaacttcagtagtttccgtgacctttcatagctggctctgcctgcctctccatgcttgcattcaccatcctttcacttctgtgctccggccacttccagttacttgtgttgccccagcaaactggggcaacttgggagaccgtgaattgaggtgtttcctctttgtttcttctgtctggcagattccttctcaacattaaggctctgtccaaggatcttctcttctgtaaagcctctcatatttccatttccctataagctgccctttgcgtatgtatgtaagctacttccttcccagaatgtcacacactgttcagtattgtcatttgtttacttgtgtgacttccccagtctactcaaggatggagactctgtagcaccctggcatatggaagatagtgcataaacatttattgaattaaactggattgaacactgctggcgcatcgagatgccattatttgtgtaaagtaagcagtcaagtagctgggcagccacacgaagcaagcttactgccagcagagaccactatggggtatcattgggtcttgagacctgattccatggagtagtcacagatgaaaatgtgctgggtactttggtgctaactatggttcttctctctctgtactttatggacagacatctcaaatgcagtattcttatggtcccatcaagagactgttgccatttttaatgattaggtgtagcaagtctgttactgcaaagagaccttgtctatttaggtagcaggttggtaaaaacccagtgttagaagttgcatagtggtggccccaagtcaattccctgcatagttctgtgctcttggaaacatgagggatttccctaaagagcttaaaatatatggtgcagggcagcccgggtggctcagcggtttagcaccaccttcagcccagggcctgattctgaagacccaggatcgagtcccacatcaggctccctgcatggagcctgcttcttcctctgcctgtgtctctgcctctgtgtgtgtgtgtgtgtgtgtgtgtgtgtgtgtgtgtgtgtgtgtgtctcatgaataaataaaatctttaaaaatatatatatatggtgcagatgagcagcataaagaattcacaatagttcaaggtcaaaaatgataaatgccgtggtgaagctgccatagatgatctggaaaatctgaggtgagtgagattaatatcagccagtgcagtcaggaaaggtgtcatgggcgagggcacatttgaatgggccactttctgtactggatagagtgtctccatgtattttctgttcttacttgatttcacagagacttccggtttttgcctgagttttgctaggtctgaagagcgatatgtacctttaaatatgggtgtcatcggggatccctgggtggctcagcagtttggtgcctgcctttggcccagggcgtgatcctgaagacccaggatcgagtcccgcattgggttcccggcatggagcctgcttctccctcctcctgtgttctctgcctctctctctctctctctctctctctctctcataaataaataaatctttaaaaaaaataaatatgggtgtcatcaatggacctcttaattcaaattgaaggaactctgattcccttttagagattttgtgtttgatccccatggtttggacttattttgaaagtgctccccctctcctttagtgtggactttgtgtctttccccaagcctgatgtatagtaggtgcttatggttacttcgctgaccttaactcacctgggtggcctctgtgagcctgatccctgcgctcagagccccctgcactcagagccccctgctcctccttgctctccagttacacatcaagcctgctccttctcaggctgtttgcatatgatgttttctctacctgtcctccccaacacacacactgcacctttcttcccttcattcacatctcttctccgaggttcaccttcttaatggggtctttcctgagcctgtcagccttatttaaattgtcagcctgtcacattttattctcttactttgctttgtttctttatggtacttatcattacccaccaccatatttctatttatttgtttatttgctcactctacctccctctagattcaagatccatgaaggcagagactttgtcttttcccatttgcatttccaggccatggaacagggcccggcacatagaggcccacttcacttatctattgaatacatgcaaagtagcctcatgagcaggccctccgtcagcacctgtcccactgtagagagtggactgtgtctatatggctggcctgttcttcttcatcactacttccagagccagcatgccacctgccatggatcaatgtgtagtcagtttgtaaatggatggagagaggcctttcaggtgggactcaaaggccacaggttctcatcagccatattcttccttgccctctccagtgtctttagatgccatcccaaatgtaggcacttctgagtcccagaaggcaagacttgctgtctgtgtggttgggttgctgtgacacagcttaggcttctcaaccctaatactattaaactggttcaaaccagttctcgttttcatgagccagttaagtcctggggagcctatcacagaagaattaacagatgcagaacaagatttgaaggattaagggacttgtcctacaactgacaagtggcagaggtagctaactacagagcctcaactcttagcctgggtactatagttgcttcattcagggtcactggcactcttctaagacccatcaagggtagtgtgagggtttgttttacaaatcaagggcagcaattgcatttctgtacgatctatacaggttagacttggtttcagaatctcctggactgtccctctgtcacgccacccattttcttggtgcattgtattttgcttttgtttattggtgaacaaccctttggtatttactatcagaaaaacctaataggacagctgtgatagagaggaagacccagactgtaaatagctctttcttgggctgccataaaggaagaaacttgggtggagggggatgttactaccatcctgtgtgaagcgaaaattctaagcagagagattcagttctctgttttcatttagatgttatttaatatattccccattcgcccaaatttctagatggatattcagaggagatgctagttagggaaaaaagcaggggaggcggggaagatcttattagttggagatgttgcagctttatgcagggaagtctttttctttcttccttgtcctttggaattgtttttagggatatacaagggtaaccacctctagaccagagacatggaggtaggtgttagagagtgaaagaaagcttgctcagtcctgcctttctgttaaaagcaagggcagtttaagtcttatattcaggttattttgggacctggactgagatcattgtggagctaacaggttcctgaacgagtcctcagagcccacagacctgtgctcctgaccacctgacccagtactggtattttctttttcccaactcctgttggtttattccagtcatcttgctgttggattgttattccagccttgtactacgacatctttatgtcctcttgtcatcccagttaggtcataaagtccttgtgtggccaaatgccagactccaaatgtgaagtttgggatctgccaccgatttggggccaattatttgttttttgattctaagtgtgtcatctatttcttaatagaatgacgatgttttgtctggtgggtcactttgaaaatgagtatgagtatgaaaatcatacatcctagatttccagacccatttcactttctatcattctcattgtcaggtacaggcatacaatttttggtttagaaaatgaggttatcatatacatgtgacaaagagatataattgcttttaattctttgcttggaaagtgctgtacgaatccaagctcaatggaggatagggatgccaggatgtacctcaggctcctgacgctgttaccagcatccttaattgacaatcaacaaataacctggatactaaagcatacgtatcttctcttttcacttaaaatttatcttaagattttaaacctaatgtagacatgctcattaaagtgacccaggtcacacatatataaccacttattattaacagttctcttttccctgtgcatagtttctttcccctcttttaaaaaattattagtataaaaacacatgaatgcatttctcattgtgttttaaacagtgtgttgaaatacagagcagaacatgagaatctctcttcaccatctgtagtgtcccccaatacacatttccttacccttggtaaccactgtcaactcttggcaaccacttttcccatcactctccaccctatatgtgtatgtacattcatacttctaaagcaaggactcatattttgtgtactacacaatgactactttttttttttttttgcttacccataacacagtatgttttgggaaatttttctgtgtcaggacacatagtcccaacttgttttttcccctttgttgtggttcttattgttaatggttatgtaataattcatcatatgggcatacctggtatataactgcccacctgttgacagacatgaagtttgtagtttttgctttcacagtgaagcagtcctttataagcaaatatctttgtgcatgtgtacaagtatttctgttgaatagttgccaggaagtggaaatgctggctcaaactgaatacctatttttggtttggcggatgctgccaaattgtcttcccagaggaattcaccaattcaaactcataccagtggtatataagagtgcttgttttcctgatctttataaatactgttattctcattttattgtcagtctgattggtgaaaagcagtgtgtgattagttttttaattttaagtaatctctaaacgcagtgtggggctcaaactcataaccctgagatcaagagtcacatgctctactgactgagccagccagatgccgtagagtgtgattattttaatttcatttttctaggctgtacctctgtagatcagaccttgtctaatttctgctttttaggaattcctcaacattgtcagttacttgatgagtctttctctttttcttgcctgaatctacctgtttgtctgtcttatcatctatccatctgtggtgtagggtgggacttgtttctatacttcatagaactttagataggaatggagtaaacttgtgtactgaatccagtatcctggtcagtttcccggatagtttctttctatatggtattaatagttttgtttcttttttctccttaacatcatattataatctcttttctttcttattacatagcaatataaattgtgatatcagtgtgatgttctactatattccttagttatttatcataatcatttctctattgatggacttttgggctatttccaaaatttattgttataactaatgctgtgtcctacatctaagcataaaggctttgggcccaaatggttttactggtaattctttatgatttaggtgctctatgctaataatgattcctgaatatagaaatgggtagatggctgcccagctgatctgtgacccagacctaatactaatatccaatagccataccacaagaaacaaaaactttatttttttaaatattttattaatttattcatgaaagacacacacacacacacacacacacagagaggcagagacacaggcagagggagtagcaggctccatgcagggagcccgatgcgggactctatcctgggattccaggatcacaccctgggccaaaggcaggcacccaaccgctgagccacccagggcctcccaaacaaaaactttagatcagcctcatttatgaatgcagttgtgagaatcctaattaaaatactcttaagtagacactcttaagtacagttcaccaagatagacataatagataatggccaaattagaggaatgaaagaatggctcagtattaaacctattgataacaacatgttagttggttaaatgtagaaaaactgggattattgttacagatgcagaaaatgcatttaaattaactatttttttaaaagtgttttttttttttttatttttaagtaatctctataccctatgtggggcttaaactcacaaccctgagatccagagtcacatgctctgctgactgagtcagccaggcacccctaaatgactatttttaataacatttttaaaaggaaaaaaaagatacttctggggtgcctgggtggctcaattggttaagcatctgcctttgattcaaatcatgatcccagggtcttgggatcaagccacacattgggctccctgctccctgcttctccctcttcctctgcctgcttctcccctatacttgtgctcgctcgctctctctctttctctctctctgtgtcaaatgaataaataaaatctttttttaaaaaaataagatacttactttacatgttacagagtatctcaaaccaactgccaacagtagagacattcattaaaagcaagaacaaaacaagactgtcctctgctatttaatattattttggaaattctggccaaggggcctctgggtggctcagtcaattgagcatctgactcttgattttggttgggtcctgatctcaccatcatgagatcaagcctgcatcgggctcacactgagcagggagcctgcttgaggttctctccttcccccctcttaaaaaaaaaaaaaaaagctgctctggcagtgcagtaaggtgcgaaacagaggtaaaaattaaggctttgaggattaagttagatgacacttcagctttcatagtacagtattttttttaagattttatttattcatgagagaaacacacacacacacacacagagacagagacagaggcagagagagaagcaggctccatgcaggaagctcaatgtaggactcgatcttgggaccctgagatcacaccctgagccaaaggcagatgctcaaccactaagccacccaggcatcaaaatagttttcgattcaaataaagcattcaaattatagatctttttactcttctttttaacaataagacatttacaaaggaaagacccattgtctcttgcatcttaacacacgtcctgatgcttttattaatgtggattctttcatcttggttcttgctggttaagtcatccagattatctgtaggtctgtgttgaagtctctcttaagtcttcggtcaccagtgcagagcttggtattaaatacctgtgactgaatggttgattctgtgctatttttgatgatctttcaatgaactgtttttacaatcctgggagtattcagaggcacaagtcccagactgagtgaataatgtggttaaaaatgagaagggtacatggggtgcctggctggctcagttggtagagggcatgtgactcctctcagggttgtgagtttgagccctacgttgtgggtagagtttacttagaggaaaatgcacaaaagaagatgtaacacttcaatggcttgtcatggagcagaattcaaacatatgaagagaaatggatttaattttttaaaaattaaaaaaaaaaaaaagatgagaagggtaccgaagagcaagctcttaaatgatgacactattatcttgacacctgacaccctgttcagcaaacaattgtgtatccttggtgttgtgcatttctgtagtaaatagctactgtcctttatcagaagtcatgtggatgtaactggtttggttaaacaccacagagaattattttctaagcgattagctggctctaaatttggtttgtgacttcagtcttttttccccccacctctatagcatctggagagggccaaatgtgaactgtgttgacagcactggctatacacctctacaccatgctgctttgaatggccataagtaagtattaatgtgctatattcttgtcctactctctagaacccaggccttttggtggtctttttgggtttctataaagaattaccaagcagtagtgttgaggaacaggggaaaaacaaaactaaattcagtccaaccagagtttctgagtctcttttagtgtataatttaagcatcctactccaccccttaaaaaacttcaaaagctaagttttaccttttcttctgtttgtccttttctacttggaaaatggtgcagggctacatgatgatctgaatataaaggtcatatttgggcagccagatcataaaggtgctggataatctcttaggtaaccagcacctttgtaacctgaaaatagattaagtggtcataagaaacgtccctcctattaaagtagttatttatttactctgtctttttgcttgccattcttccctcgtacagttagccttgtaaacaaaggaccatttttaaggagaaaaatacctaaatcatacggcctatttaattctcttaggtgttggttagtagttgttgggtgggatttctacagaaagttttctggagaagctgtgctttgggaggaagtctaaaagaagatgacacaggtataaatggtttggcagccttttccagagggcactgtcctccaaatgagagagaatgtgatggctcagcccaagggcaggcactgtagtggaggacattgagtagaattgccaggacttggaagaatggaaaccagagtgcagtagtgtagagggtgataaggagagtttgaggcatcatgctctaggagatacaaagaagtttcatttttataaggagggattattggaacccttttagattctgttgagccaggagcagggtgcttgccaccttgtgatattctgtatcacttgtacagtatttggcccagcctaatggactctgatgtgccaaaaagaggtgatgattgtttcctcctacatgaaacttttctgaaatatatcagatgtgctcattatgtcttctctctggccatcttcgacaaagctaacaaggactctgtagtgaaccctcccaacccactcaataactagtggggtcacccaaattaaagcgaatcttgaacttaagtgactagggcttgttagccaagtttatctccagatgctgtttttgtttacagtgggggttttctttgaccccatgcacatggaaataattatacatttgtatctgcttcattagcggtgtcaccactaagaaagccaaccccttctttctggatgtatcaaatgataccatatgtgtctggcttatgtttgcagcgactttaattctgctctgcctgtctgctcttagctcccacataaccaaatgctctgaatgatgtggtgaataatgatacttgttttgcatgactacctttatgtaaattttatccccatatgctgtttaaacatcacaagcaaggaaacattgcaaggtttagacaaggggaccagacatattcaaaataatggaatatagatggattgtctagaaaacctagagaaatgaggaggtgataggcagtatcggtttggctcaagatgtttcagctgcatatcagcagctgtacatgtagctcatggaataaaaggaggagactgggtgatgagctcaggtagaagggggccaagtgagctagtatctgaaagggcttcatgctgctcacatgtgaagcgctgttctgcaaactcatcattgatttttgccttctagggatgtggttgaggttcttttgaggaacgatgcgctgaccaacgtggctgattctaaaggctgttaccctctgcacttggcagcctggaaaggagatgcccagatagtgcggttgctcatccatcaagggccctcacacaccagagtcaacgaacaggttggaaggaagagaagtgttcttccattcggtgatagcccgaccgtggtgggcctagcactgtttcagttccatagcacagatctcagggaaccagctcttccaggccctacaaatggttcccctcatcccagcactatgcttgtgagtgcaccagggagatcttaaaccccaaggatgcattttacatgcatttacattgtgcaggtttggagtcatgctataatgaagatctaaatacctcacatgcaaaatgggaaataatgcaaatcccggaaaattgcctagaggccattgcaaacctgcaggcttaattaattatacattgtgtttagaccattcacatggcagtgcaacgttagccagtaaatagcaatcctcccagtatgtatcagtgctctgtggaccatgctgttgtcttacctacatcacagctggcagaagtggacagacttgtaccgggactgaaaaaggaactcacaaaaacatctgagtaacctcagaggtcagaggtaattcagcagagtgaaaatcatttacacttcagagtgtcatgtcaacttcagagtgaccatgctttgacaaagcagagataattcttagaaaataaaaaagacagcatttgagcaaaaataccttaaaatggccatggattaggtactctgagaccatacttcctcttttttacattgattcctttggaaaaagttctacttccataatgcaagttctagacagtcctctgataaaatatcgtttcctgtagtttggatctgagatcatgtgtccctttgagaggaggtgggctttctgtgtgtgacaagccattctgtgttcctctgtgctctgaactaaagcaggtactttttttagttgcttgaatgagagagatgctgctctttctcagtgagctcgggactattctcctaatgactttgctgagaggagattgttacattacctgtaggattagatcaaggttattcctcaaaaaataggaaatcactcttgcgagcccacctatcagcaaggctatgcacattctcattgagctgttaagagcatgactgactcagaaggggagctttactctgagttgtttaagaaaattaaagcaatgtgcccaaatctctcaatttggagattgtgtgtttgtagctgttaatcagcttccctctcccctctcaggctgttttttctggataggtaagccacagaaatttaagatcattgatgaggatgtttttaagaatgaaaattgtctctagaattgcagctttagaatctaaatgcagttttactcctcctggctaaagtgattataatttctcctatctggaggaaatgtacaaggaggtttgcttttaatctaatattcctcaatgttaaacaaactattaatgggtgttaaacacccattaagtccttctcgtttaagaaattttcggcaaccatttctaatcctgtctttgctcacttttgccttggaacacagctgcttggatttttgaaccacttgaatgtgctagcttgtcctgctcacagctgcctcccccctggagtatcctgttgataggtgggacaccagcccagtgttctgagtatctgacaggcaggtgggtggggcaggggctgggcaagacgtttgcaatagctggaagaacctaatggctcgagatagtagtaccacattgatctatttaaaaaccattaatgtggttccagttggatgcttggataagagggggtgatgagtgctgtgccctcaaacctgccttccccattaacttcctttccaggcacccagaaggcagatccgagttgttctcatgttgggccccctcggagctgggcattgctttgatatatttcatccattttatcatcacattttcttttcctctcctttttatagaatactcttgagatcaaagaattcaaaaagtacggcccctttgacccttatatcaatgccaaggtgtgtactttgctgccaggatttctctgcatcatttctccaagctgcgctccctctttggtcctctctggcttctactcttgtccactcaggctcctcatcatcaccctggctattgtctgcttcggcccatctgcttttggcttgtctgggaatgggaaagtgcagcttcagtgggtttgggctttatttttaaaacccatgctaattctggaaaggttgggtgcttttcctagaatgtctgaagagcttagaaatggccgaaatggggaaagagaaggaaccataatatacacataatttaccattgtgattgctaaattcatttaaattcaaaaaagaaaaattcaattaagaaatgtcaaacacattagctttttaataagcatagaaaaatggttaaattgtacttgctggattagctttttttttttttttcctctgctttatttcttttaacgtagaatctaattttcaatagctggtagtggagatgttggggaagggatatggtgactcttgttttactcttaaaagctgtcccttgtgactccctccatatttcctagagttcgtgcctttcttcctaggacttgaaagcctcagttgcttctccccagccattagcttctctcactgcttgctcattcttggcccttggaagggctctgaaatagaaaaggaagtcacagggtcaagcagggcactggcctcaagtctccctccttgtgaggctggggagagtagtggcctggtaggcctggtgatgaacggctcagcccctctggccttggccacatcaagaggcagagcttgtgcgttggtaatggttagcctctctcctcagtgctctcacctgctggttttgatctgaaccattcacgttgaggtttgctttttggcatcagtctggagtttggttgagtcagtgcattattcacattagctcctttcccttgctctgaatatagtaacctcagggaagagaaacataaggtacttctgcatgttgccagatacaaggcagatattccttaagaaatactgatttagcaaatggacctccccgtgggctggatctccacagcttctgtgggccatttattcagctgtctggccttgatgggaatggcagataagcagtttgggaatagtggaatccattagcttttgtttggccctttctctataaattctgttttctaatattcaaaataggaagatactttgttttcttcttttttgggacatagtgtagtagaggagaaaactcttaaatgtcacagcctttcaagtcaggcctaagtttgaattctgtgctactgcttactggttttgttgacttctataagttacatttctgtaagcctcagtttcctcttctgtaaagtgcagtgtactatctgtctaccttgctggattaatttgaagttaaaaataagagaatgtacattaagtacaactatctagtaactagtaatatttgaaatctgacttttaaagggtatataccttgtggtatttctgaaacggcactttggaatttgttctttgttactggtgggttgaagcttaatgaaacattgctcaattagtctatttagggttttgttttgtggggaggcaccttgaagtgattgttttcccactcggtggttagttcagttagcttctaaagctctgattaaagggtaggcctttggttcttaaaagcacattttcttaccccttgatttcccacacaaaaaagaaaattggtctaaatggaataagagcatacttctctttctgaaaatactgccctttgcctccctcccaccccgcaaagaccaaatgatacaaactgcacaaagagataaagttgtttggattttactacaaatgcaaattctccttgagctagtttgactctaacttcactaggttttatcctaatttgcaggtttttattgacctagattgtgtctgggaattgttttgtgtgctaagtccattcaggcacctgtagaaattaggagttctgggagcagaggtggttttcatgagctttcatcttctttgacatatggagccttttctttttcagcaactcagcataaatcagtccaaaatgtaggtcattcatagctaaggtgcaactactaaaattgtttatttgccccctttaaaaataattttaacttactctgaatatcataagatgagcaatagtcaacttggttttagatctattttcctgcacacttaaaaataattaagtttcagagctggaagagacctggaagttgtcttgaccaattgcctccacattctggtgagcttatctggttgcacctgaagcttttgtaaaactttttatcttgaaaaaattttcaatttacataaagttgcaagcatgattcagtagactgcattgtactcttcacctaggttcaccagttgttaacattctatcacatttgcatgcatgttttctctctcaaacatatatgtatattgttgctatagttgatgatgaactgtttgatacttagtcatgacatcatgactgtttaaccttggaacttcagcatgtgtctcctaaaaacaagggcattcacttgtgtaatcacagtacagttatcaaaatcagaaaattcaacattgatagaatactagaatctaatacagaatctgtgttcagatttcaccagtttctccaataatatcctttagagcaatttttttcctggcccaggatacaacctaggatcatatataatctggaacaattctttcacccttcttagtgtttcatgactaagaaatacaaacattatgtctctggctgtgaccgaaccaccaacctttcagtaacagctaaacacgctaaccatttgccacagagacccccaacattgacagtttagattcaggaatgccacaggagtgatgttatatccttccttcacgtcacaaggcacatgatgtcagtttgtcttgctttttaccatgatagatgattgcttggtcaagttggtacctgctaggttggtaagcattttaataacaatcttcctgggctttaccctctgaggtgctaccttggcaggcctggggacttagttacttttaagcactcatgtaattccaggatgaagccagtttgagagctactgatctaggccaactttccatccggaataggaatcctcttctctcacctgaaagatgagccatctaccctttgtttcatctggttggttgtttctcttggtaacgaccaggcttaccacttggcagcatctttttggattctactgattttggtttcttatacttgactgatacctgtcttcttaaacattccatcttgttggttagggttctgccttccagagcactgcagagtaagtctaactcttcttccatgtggactctgttctcacgtttctcctttgtctgctaaatttcaggaggcccagtttgtccttttgttccaattttagtatatttctgaaacctatacctctgctgctacagagatctctgttgtttctaacttaagtatttatcaacagtggacaagagtacagttgggctaaaatctaagcactgggaagtgatggtttagaatagtttcaaaaaaaaaaaaatagaatagtttcaagacgagaaaagccaccaaatgtttctgtatagttttctattgcttgtagtttatgcatatgttagataaatagacgtagacaatgcagaaatataacggatttacacgttaaatggggtctccatatgtaaagtatattggtatcttttttcttagaggtactaactgtagcaaggagaaatgaaagtgagtatcctcaagatgggcaggaatggagagtttgtgcaaagaccttggggaaaattggggtatttgatcttagtctccttcctcagtccaaatacatagtaatatgattctgggaactcttgaggtatatggtgagcacctgtggtgtgacttggtaggtgtgaaagaggaagattccaggtcatgacaaatctgtacttccttggaatcctcccttcctttgggtccctgaatcaacacttagtggcttcctgccctgatagttgtcccgttcaaaggggagcaggtaggaagagctcattataatggcctgtgttcaataatcgagagatggggtcaccacagacttcaactcaagagtattatagttaccagaccaggtttgacaaagactgaagcatgaaaaagatgctttctacactgtgaatttgagtacaacattctgcagagatgtggttaggccatttttaacagaagcaggaaatttgtctggtagtgatcaagactttgctttcagtaaggcagctttgtggtagttgctttagttctcaaaaaaaaaaaaaaacagaaaatttttcttttcttttcttttttttttttctcctgctggatagtttagagttttacagttcttcaggccctaacggtatactactatttttttttttaacaaaatcgaggacagattattcgagttgttgggagacaacttggatataaaagagacagcagtgtctgcctcagagtaaacaagtttttctgaattggagtcttaataagaataagctgactttcttggccctgctgtcatgctaatcttgagatgtaaaaccctgagaatcctcttaaaacttctctgggttgctgctctgccctggaaccactgtaaagaaagctcctgtgtattttgttgatgtagctgcctttcatggtgagaacatgaagtgacagctctaagttggctcagggagcacctggtgttcaattggaaatgggcattccaaatgggggtcttaagtggttggtttggcactgggaaccccaaagatctgctttctgcccagagtttccccttcccttcagacttttaggttgacatgtaacccaccccttgggcccagttgtatcctaggaggccattgctaaccagctgtgtcctgtggccagtgaaggctgcctgcacttcagctgctgttctctttgagctgtgtttgagctcagtgctgcttcctctatttatctgtgtgcatttatctttgcatgtggctcctgctaccaccttttctgtccttatttcatttaaaatttcttctttctatcattctgaccttgggggcttcactcccagtggctctggatctttctggtacacttggtgtagctggaaaaagtgatgcagtcaaatgccagattgaaagcagatggaattgcatgtgtgtttgggtaactcctggacttacttttaatgtaattaatagaattaaagcagttgtggaaacattgcatttttaccttttgatcactgaaaggtgcacaatattgacttgatggacacatcaccctctaagctttgtttccctaaagtggcagaagactcctggttaaacttaggaatctcaaaatcttgtgggagaattattttcattagtgcatctaaaaaaggggagaagtcatggaaattactttattcctgctctaattatacattggcagtagtagtaaaagaaggagcacaattggaatgactaacattttgctcctgatggttgaagcacaaacttctcctatttcatcccaggttctacctgttttgaaacaaaattggcattaaaggaccatggggttgtgaatttgaattgatggtcctgttacaactttgaatattttgcacctctcacaaaacattcccgtgtgtgtgattgtgattgaatctttcctacataagaaacacttccctgtgttgtcatttgtgcatgcattgtttggtgcaggctctgggagtaggcacagggtgacagcaggcccccctctcccccaagttcctctgtgacagagctccagtacctccctccccctggaaatggctgtggctgatatctgaatgagcgtgatgagcatgatgctccactctgttactttgattgttggctggttgatttgcatgcaagaagctatgcaaatgacacactctttcaagaaagctttcatataaggcagtggatggtcaacaaatctagaatcagtactgcagggctaactgaatataaactgtaaaaccagttgaagtttaaaatgagtcaatggcagtgatactattggcattcatgtgttccagggcttcggcccaaggcctgccaccttccctcagttcacctccttgcaaggagatacttccttcatggcacacaggaggagactataaatctgatagtctctgatgacagctcccctctggcagtactggggcacagtgtggctgatgggagtggccaggcttatttgctggggagtatatctggaatctgaccgacttctagtagcctccaaatatcgctgctatttttctcatttaaatttcagtggttttccacgtgtgcatcccaagtcatatgccagtctgccagttacctttctgacaggatctgcttgttaaactctttagaacaacgacaacgagacggccctgcattgtgcggcacagtacggccacacagaggtggtgaaggtccttttagaggagctgacggaccccaccatgcgcaacaacaagtttgagacccctctggacctggccgcgctgtacgggagactagaggtggtgaagatgctcctcaatgcacaccccaacctcttgagctgcaacactaaaaagcacacccctctgcacctggcagcaaggaatggccacaaagctgtggtccaggtcctccttgacgccggcatggatagcaactaccaggtagtggggcacatctacctcctgggctcagggggcctggtctctctagggaaggcacaagtaccatgctgctgggctgtgttctcatttagcacgtttctcaccacgtgtcaaatgcttccatttgttgactcattttaatgtgaaaacttcagggaaactcctcaagtgagtccattactgttttattgttattttttatgtttttcttttcaggggtaacatatagtcattatgccctgaaaagatgtgcttgcggactccctctcaaaattagaacagtttcattatcttcctatacaggtgttcccaccgcacgcattggccacctgcaaagtcccctcaacttgatcttgccagcaggagacttggcatttccctgctgtctttaggatttgcattgaccaaaccacatgggacgtcaaggtggttttttgtttttcccctggtacttttcttctcattactcctttcagccaggaagggggagctttgaggagctctcaccaataggtggctccaagagctgctacacagttattcctgtgtggcctgatggtggcatttcaaacacacttcatgtctgggccacaattgtggttccggaatacagacaagaaaagtaggaaagataatgacagaggactttgtgtggtttattttattttcctgccccttcttgtctatatcccgtttgtcgtgtggagccacaccaaacctgggtcactgttctgatgacatgctgctctgcgctctcgtttgctttccagacggagaagggcagtgctttgcatgaggctgctctgtttggcaagactgatgtggtgcaaatcctgctggctgcaggtgagaggtcggcagcgctctcgtctacacagcatgcccggggtgggcttgtttctccctagcctccctggagggggatttttgctggctgccctccaacccaatgtatgtatgtctccattggttgattgcaagtgtacaaattgttctacaagagctggattaaatgtctttggatgaaaaatgttggttgtgctactgggagcgttaggagtcctggaattggaccccctttaaggctgtcttgcaactgctcactccccctgttcaacctggtgtgcctttctaggaatcgatgtcaacatcaaagataaccgtggcctgactgccctagacactgtccgggaactgccttctcaaaagagccagcagatagcagcacttattgaaggtacccgttcatctgcctgtcgggttggcctggggacacactagccaaaccaaggaatttgtatttgctgaagctttttttgtctttccacgtagatcacatgactggaaaaagaagtgcaaaagaggttgataaaaccctcaggtcccagggacctctcatctccaatatggactccatatcccagaagtctcagggtaaggcggcctttctctgccaaccaatgggctctcaccttgaagagttgaactggctttggtagaatgcaaaaagcttcatttaaataataacttcagggggttgggagtacttaataagttcataatcaaatgtattggtttccagctagtatatgaacttttttttattggatataccttaggcctttgagcttggacctcttctttcctactttatcttattctctaatttatagttggctctgtgaggtctgttttgggatgtgtcatagacagggtgatctcaagatgaattcaaatctcaaggaaacctttttctatacacacgctatcatgctttaagcacagttggccctcaataaataataaacgagtgtcatctggttggtagacagtatatggcagattttgatactatatcatttggctaacaaatgcagtctgggcactaggttgggcagtccagcctctccatcattagcccctgaaatccaccatttcagatttatcgagcagccttttgggtcccaggtatgatgaacaagaaagacaaaatactgactgacaccttccttcaggtatttacaaagcacggtaaagacagccagaggaacagaacaaaaccagacactggaaggggaaagggatttttcagaggagtgcaggatgaggttagagggtgctcggcctgtcttcactgtggagtcctcgtctaccccctcctccaccacccccatacattttcttgacctcataatctactagtaatgggattagtagttcactaagatgttagctttcaaggattttacagttacggttttgactatttgccagagacccggagatggctgatccacaacagtccgtaacttttcagagtcgcagactcagatcccaggtagtctgaggttcctaggtctctggtgagtgagtttaaccttgcacagcctccaagatgtcagaaaggcatcacagaatttaaaggattacttaagtttgcagttatactttgctacgttctatggtttaaggttatgctgtgatggcattgaggtccttgggaattcataaaggtcttggggaggtatccctcatagacgtcaaggatttgctatagtgaattagagaaaaatctctttaagtctcagggtataaagagcaactgaaactctctgtattgattcctgtccctggagcaaagcagtcattttcttttcctgctctcagctactgttcatcaaattcaggctgatgaggggctttgggtggttgcagtggttggaaatccgaaactgctctccagccattgactctcactctctgaccttttcaggtgatgtggagaaagcagtgactgaactgatcattgattttgacacaaatgctgaagaggagggtccctacgaggcgctatataatgccgtctcctgccattcgttggacagcatggccagtgggcgatcgtctgaccgagactctgtgaacaaggagactgaggcagcaggagtgaaggctgctggagtgaggcctgtatgtggcctggggccctcaccaagctggggactgtgttgtcagcctgtgcttcactggggcatggcagagggactgtgctccgagggtggctcgctttccagaggcctgcaccctgcttccgtgtccctctgggcactgtcacatctcactcttgcttagtgtggctaaatcgtatagagtgccttgaggtcgaattttggtttttctgatttcagcataatatgtgtgcattgtcctgttagttttgggccttagagcagatcgaagcattttattcccctttggcatctgctacttctgtctttggggtctctgctgtgtattgttagttttctctctggagagcagttccacggtgaaagagctcagtgaagtaagttcttgactacctggagtgcatttgcaccttccatttgccctcggagcattatccatttggatctggacagattctgccttcagcagggcggtagcaaggcttaatcagacatcatatgtgttagcatgcagcattcccattttttcccaattacaatctctccagccatttctttcccaaggtctaccttcccatctcactgcttctttctctagtacttgcttctgcttccagtcttgtccatccttctcaagatgttttactctctttttctccctcagggttttactctgagcctaagcctgaatccatagtcccatcaaccttcctttctgcattgccgggcacaagaatttcaggcttagagcaccacatttttgccgaacttgccgttgctctaacagaatcccagtgatcccaacttgcagcatattttcaggtgtatattaattcttcctgttggagaggctggcctttctgtttggtctgaatcttccccatgactatttggatgaccctttggctaccaggtgatccttttcagatgtgcctggggatggcttgatgtttcttcatgttcttttttggttaggctctgtgccttgtcctagaatagtcccatcatttctgtatggattttggcaaagcccaccagtcttgcagtagaccgccatagtgggtattatcaagggctgataaaaccccccgtgagcggtggaagcacacatacatgccaagcaccaccagcacggtgcttccgtggtcagagctggtttgtttcactttcacctgtggagaagagcatcgctttatggtccttacaggtgatgtccattagagggagctggaggctttacaagaagaacgcagggttcctgaagtaagctctgaatgacccagttcctgtgggtttagccgctcgctgatttatagtctctttgttccgtcccactccaggaatctatcctctggtggtcttgctaagtaaaaactgacgcatttgggggtggtggtgggggggcgtttgcgtgctttgctatttttactatgttgtggctgtgctaccttcctggcctttggtaattaactgtggccaagggactgactgttctgtgtcttacaaatgcaatggacggtgagcataaatcagcctggtgcttacaggacctgggtcagggttttcacattagaaaagcagaggcttttgcttctctctctctttccagagtccctggtgatcacttcttgcacaagaagagctcgtattgttttttctaggctcctttagtcttgagaaggcttctgggatggaccctttttgctgttgttgtgtttcatttcatttttcctcagctatctttaccccagggttggataactggtgtagattacaggcctgctgcttttcccatccccttccttgtggaggtgacacctggaaggaaccaagcttgtttctgcactcctgcagttagacagctaggaaaagtggatccgagtggacaatctgatctaatagttttgtttggcttgaaaagacgaatctgttttgaagttgttgccgtggggcatccatctggttccagtaactattggaagggctgatttatcaagaatactgagtgccgaggcatattttaacagagagagatcatggatgccaaatgctaaccaaatgctaactgaccctggtggctcctgggacatgggagacatcctgcagacttctctgaggctcttgcataattcagcaggtgcctccaccctggcttttataaatattcctgttctagcaacacagtacactaacctacaagccagggaatgaggctacaagccaacttctggttcaggtttgtggtaggaatgttgattatgaagcatggtttggactttggactgttgatagtgctgacgatattgcaggtacaacggcaaacctctccagctttctgccaccagatgttgtgtgtattcctaaagtcatctacctcgcttgacctcatgaatctctgcttaagggtgcttcttgctctagggcatggattggcaacatatggcccacagacagctgcccatttttgtgaataaagttttattggaatgcagccacactcatctacatatcttctctgtctacattgtactacagtggcagggttgaccacaaagcctaaaatatttcctctcttggagaggccctttgagaaagagcttaccagtccttgctatagggcagataactgacaaatactccatttttaaataagctgagatgaaaggttttcatatatgaatgatacataatagtaatcattgaaggaggtgaccaaggattagagacctgttctgagctttgatgaataaatgggggtagcatttgagtttgaacagaaattgatatttttatctttgattactttcctcattacttccttaataacttgggtttgttagaacttagacaaattggttcttttgatttacttcctctttttaacattgtcagaaagttgagccattggccttcctaggctagagttttattatggatatgatgaaggacattttctgatgatgcagctccatggtttcagtgctaatatttctcaccatggtgtagaatatgaaagaagtgtttacaatctccgccacaaacatcaaaaagcgaggcgcgtgctgattgaattttacgtgtgtatgtgtgtggaggaggtggtatatgtgcagatactaagccatctgtttagatacagatccttgagtttagtctctcaggggagttctttacagtattctttttcatttccaagggctaagataagaacagaaagttagatatttgaaaaaagaggtagtgaaatactttttctcttctacagagggaacgtccaccacctcctgcaaagccaccacccgatgaagaggaggaagagcgcatagataagaagtattttcccttgacagcttctgaggtagagggttgagggtttattgccatcactgaaatatgattttttggaaaatacgttgatgtgtgcttaaagacgactgtgctttttcattttcttatcgcctctttggatcagtaaatttgtattgtgtatgtcagtaatctggaacaagacctttccaactcactcagaagtattaagcaaagaattttaatggagctgtctagcagacgggcattattgatctacattgcatattaattataaccatgcctaatttcttctggctccagtagctaaagagtttgattttttgctttttttttttcctgtgtcatcttttgacacaaaatgtagactatgcccctaatcactgttgtagagactatgtcacattagcaagctttggtgcttctgccccaagtgtcatatttctgttttcatatttttcttcttcatttcacgtgaagaatctaccaagacaaatatggaaaatgtcacaaagactcaattagaagagaagtgggagttgtgggggtgggagaaatcaaagaagtttatttgagaagtctagtccatcttttttaaaaaataaatattatcatagagtcaatagttcaatattacctcttggttatatgaagaaaatatcttctatgatctttcattttcagaatgctcctttaatacttcccactgtgcagaaaatgttcagtatttatttaaaatattacataatttggttactttacagctcattcagtggcctattgttctttaatttaaaaatcagctgtggggaatgtctgggtggctcagcggtttagcgctgcctttggcccagagcataatcctggagtcccgggattgagttccatgtcgggctccttgcatggaacctgcttttccctctgcctgtgtctctgcctctctgtctctcatgaataaataaaataaaatctttaaaaggagaaacctggagcagattcattggagctatgtctctataaatgccttatgccacttcttttttattttttttcaattttttatattggagttcaatttgccaacatttagcataacacccagtgctcatcccaagtgccccgctcagtgcccatcacccagtcactccaaccccccgcccacctccctttccactaccccttgttcatttcccagttaggtgtctctcatgttttgtcaccctcactgatattttcactcattttctctccttttcctttattacctttcactaatttttatattccccaaatgaatgagaccatataatgtttgtccttttctgatcgacttatttcactcagcataataccctccaggtccacccacgtcggagcaaatggtgggtatttgtcatttctaatggctgagtaatattccattgtatacatagaccacatcttctttatccattcatctttcgatggacaccgaggcgccttccacagtttggctattgtggacattgctgctataaacgtcggtgtgcaggtgtcccggcgtttcactggatctgtatctttggggtaaatccccagcagtgcaattgctgggtcatagggcagatctatttttaactctttgaggaacctccacacagttttccagagtggctgcaccagttcacatttccaccaacagtgcaagagggttcccctttctccacatcctctccaacatttgttgtttcctgtcttgttaattttccccattctcattggtgtgaggtggtatctcattgtggttttgatttatatttccctgatggccaatgatgcggagcattttctcatgtgcttgttggccatgtctatgtcttcctctgtgaaattgctgttcatgtcttttgtccatttcatgattggattgtttgtttctttgctgttgggtttaataagttctttatagatcttggatactagccctttatctgatatgtcatttgcaaataccttctcccattctgtaggttgtcttttagttttgttgactgtttcttttgctgtgcagaagctttttatcttgatgaagtcccaataattcatttttgcttttgtttctcttgccttcatggatgtatcttgcaagaggttgctgtggccaagttcaaaaagggtgttgcctgtgttctcctctaggattttgatggaatcttgtctcacatttagatctttcatccattttgagtttatctttgtgtctggatgtatgaaaatggtctcgtttcattcttctgcgtgtggatgtccaattttcccagcaccatttattgaagagactgtcttttttccagtggatagtctttcttgctttgtcgaatattagttgaccgtaaagttgagggtccacttctggattctctgttctgttccattgatctatgtgtctgtttttgtgccagtaccacactgtcttgatgaccacagctttgtagtacaaccttaaatctggcattgtgatgcccccagctatggttttcttttttaatattcccctggctattcaaggtcttttctgattccacacaaatcttaagatgatgttccaactctctaaagaaagtccatggtattttgatagggattgcattaaatgtgtaaattgccctgggtagcatggacattttcacaatattaattcttccaatccatgagtgtggaatagtttttcacctctttgtgtctttctcaatttctttcagaagcgttctgtagtttttagggtatagatcctttacctctttggttaggtttattcctaggtatcttatgcttttgggtgcaattgtaaataggattgactccttaatttctctttcttcagtctcattgttagtgtatagaaatgccactgatttctgggcattgattttgtatcctgccacactgccgaattgctgtatgagttctagcaatcttggggtggagtcttttgggttttctatgtacagtatcatctcatctgtgaagggagagtttgtcttcttctttgccaatttgaacgtcttttatttctttttgttgcctgattgcagagcttatgccacctctttaacaatgacttggattagaattcctaatgtccaaggataagggcaaggctcttaaagaaatattagataatgaggactttctgttctcccaaggcttttcagagcataaaatttgtcaaaaaagtgtcaagagaggggtacctgggtggctcagtcagttgagcatctgtcttcagctcaggtcatgatctcgggtcctgggatctggcctcatgtgaggcttcctgctcagtggggagtctgcttctctctacccgtcctctcaaattaaaaaaataaaatcttaaaaaaaataaaaacagtgtcaagagatggatggagaaatctccatattactcttctggataagggactctgagatacttataggacttatttctgaatagcctgggagtctgaatcagttggaccactgcagtcagaagttagaagaccatgagaaccccggctttgcttacttagtgattataagtgcataaataaagagatgatgtggtctacatcattatccttttaatgatcaagatagattatttttgctatagtttgaatgaataggtcttctccaaaagtgaagggttttttttttgttttgatttgtttttttttgttgttgttgttgttgttttgactctagtcttctttgtctcgatttcttatactctaatagctttactaccgtaacactcatatcctaggaagcactggctcatcacagtttagacttttatatttggcacgcaatcagcttcagtgtttgtgtcctattcccaagacttgccattgtcagatgacctgtagaagtcttttaaggggggacaactggacagctcagtggttgagcgtctgcctttggctcaggtcatgatcctggggttctggattgagtcctgcatcaagctccccacagggaccctgcttctccctctgcctatgtttctgcctctttttctgtgtctctaataaataaataaataaaatcttaagaaagagaagccattaaaggaagctgagtatggctggccctaggagagcttattagattaatgaccaggtcacgaaactggcttaaagaaattaaacacacatgtgtgtgcacacatgctattgagatgtttttgccctgccaaatgggctgccagctgcatcatactgaccatggtcttttcagtgttcagatgtgttaaacattcatgggaaggtgcagctactatggtatctcttcccagaaaactgcccacaccccgaccagtcactcagttggttacagttaggtggtgactggtagtagcttctctctggtgcaaaaatattgctttacttatagcagaaaatatggctttttggctttgatttattgccagccctagaagaaaggggcagaaaagattagggaataatctagtaaagagcagaatcctttctattgaaaatccgttattgctatattcagtgtgacacagggcttcttgagtgggagttaggaaggctcaaagcaaagcagtctattgctttattatgagattttaatccccataactggtgggagccaggactaaagcagaaaagatcaccctagaagttgtctgggtgtgagcaggggactctcactagagagtctgaagaagggaaagagttacaaattggatggaaagtcctatttcccaggaaaaaatgaggccatcttggtccagaatcaggggaagtgaattttatggccctggttctttctgctagttgctctctatgtaaccttgggcaagtccctagacccacctgggaacctggtttgggcatctgcaaaatgacagagccaggtgctcttgagctgtgattttaatggtttgggtctctcccagcatttgttgcttctatgcttcagttgttgtgcaaggagccaggcacagaatgaatgaaggtcgagtggacctgattttccagatggaagtcatcagctgtcctgcttaagaaaaaaggatattataggctgggtatccagactgtcaactacctctcagacaagcatgcctggggctatatgagggcccttgctgtgtgcagaacacttactggaatcagatttccagggctctggctaagtgatagctatgggtgtgtaaacctgcagaacacaaattcctgtctgtaaagcctgtggtattaagttgacactgtatgaactgcttaatggtccctctttgttcctttaattgtgttcctatgaagaggtgaaaggagtaactaatacaggcaaatggctcgttgtaatgaaatagcttttagcttccaggtggctttcagtaagtggaggtccctgctgtgcttagcagaatttcagaaaggaactatcattctgcctttggagtggcagtcttgttaccaaacaggagccacagcctctcatttagtctgaggccactagaatccttgttgtctcattaggctgtaatactgtgagctacatctcccagaagcaaaaccctgatgagtcacaaacccgattcatttccagtgagctgtgaggcatatctgaaggaagaggtttctgcatgtaccagagaatcacatttgttaggctaccattatttgttaggtggacttgcgagttcctctgaacccctttgttcataatctatcccttctcctagccaaactgcacaagaagaggttttgtggaatcaatttaaacttgtattgccataagtgtagtaggaagccagcttttgagagaaacttccctgtaacccccagggacctatgaagaaaggctcacaaaaatagagaaggatacacagggtactttgtttctggtaaatgtcagtcattcagggtcagtcagaagtcatttgattccttcttgagaaggtggaaaggattccagccttggagtagtatgtgtgcatattaggaaagaatcatggagagagaaggcctttgtgatgcaccctagctaaaaactgcttggaagctactatccactgaaaagagaccgtgtagaccactgtgatgatgggagaggaagcaagggaagggtggatcttagattttcttaatggctttttgaaggataaaatgaggtaagaaaaggagagtgttttaatcaaaggccattgagatttgaggtacaggtgcatatccagagaagcagatgtggttccctgtgaccctggagctgtttaccttctctccccatctcccttcttctctggtgaaaaaggagccaataatctcgaatttgttctgcacaacctgtcctggtattagctaccccataagaagttctatggtgttttctctcttaggtcttggccatgaggccctggattcagggaagtgcagccagggaggaggacgagcatccttatgagctgttgttaacagcagaaacaaagaagctgggatccatggatggggacggaaaaccaaaaggtacaccccctcccccaccctgctcccaacagaagcaacctcaacaggattttttaaatgtgtgatcctgggtgggaaggagagggtgacagtccttgagatggggaagttgggtgtcacagcgttggaggtggcaggtatattatgacctttcattttaataccccgtgtcagagttggcttgcccccctttagcacgcaaaggaaggaggtggtgttaggtcagacagaccaggtggtccctgtggaaggagagatggaccacagtgttacaaagattgatttggggtctcaagtcagaaaccctcaagtgaatgctgtggaaaaaccagcccaacaagtcggtccctttgggtttaggctgacagcacaggctctgctttgagtcctgacctcagagtgagatgctcctggggaggggcctgtgattggctgccatccggtaactagaatgctctgtcgccttggcctacttttattgcctctgcaaaaatctgtttcctctgtgagggagtgagtgctgcaggaccgagagccaggccaccgacctaaacgcagtcacaacagaggtgagcatgctgccctaccggaggatgggcgacagcctctgttctcagaaagaacaaggggcagtgccattcccactgcactttgaaggaactactgtggcctcttccagctctttatagcttccaggtactaggtcctccatggggtattatttggcgcctcccctcaatcctgacagtcactgtttggtaagaatggggggtgcaatggtttctttggaaccaccttttactgggcctgtcggagggtagggggtgacaaagagaacatgtgcatagtatgtgtatgacattgtagatattctttttaacgatcgggtttaaaaggtttctcttccagcacacagaaactttgtggtcatttttatagtagttgttttggtttggtttttttaggtttccatttggagctttctctaaaaagttataatttaaatacagtaacatttaccctttttgtgtacagttccgtgagttgtgacaagtacagttatataactaccaccccagtcaaaatatagaatggttttatcataccaaaaattctcttgtgtccttctataattggtcctacacccttcccttacctctggcaaccactgtttttatgtcaatcccaataattttgccttttccagaatgtcctataaatgggaatagtgcagtatgtactctttgagtcaggtaccttgcacttagcataattcactgaaaattcatccatgttgttgtgtatatcagtaatttgttatttttcattgccaagtagtactctgctgtgtggatgtagcacagtttatccatcctctagttgaggggcatttgggtcatttatagttcttagcaattacaaataaaactataaacatttgcagggttttatgtgaacattgtttcacacctcttggaaaaacactaaagttgggattgctgggtcctaggtaaccataggtcctaggtaactatatgtcacactttataagagactgccaggtcatgatcctgaggtcctgggatcgagtcccgcatcgggctccttgcagggagcctacttctccctctgcctctctctctgcctctctctgtgtctctcatgaataaataaaaatcttggaaaggaaaggaaaggaaaggaaaggaaaggaaaggaaaggaaaggaaaggaaaggaaaggaaaggaaaggaaaggaaaagaaggaaggaaggaaggaaggaaggaaggaaggaaggaaggaaggaaggaaggaaggaaggaaggagaaagaaagagagagaaaggaaagaaagaaagaaagaaagaaagaaagaaagaaataaagaaagaaagaaagaaagaaagaaagaaagaaagaaagaaagaaagaaagaaagaaagaaagaaaggaaaagaaataagagagggagagagggagggagggagggagggagggaggaaggaaggaaggaaggaaggaaggaaggaaggaaggaaggaaaaagaaaaagaaagtaactgccacaccattttccagagtggttataccattttgcttttccatcagagttacagttgctagtgtcctccctagcacttgatattgtcagttttttaaaaattgtagtcattctagtgagtgtgtagtactatttcattgtggatttaatttgtattcccctaatgacttatgatgtgaacatctattaatgtgatcatttgacatccatatagctagtgaagtgtctgttgaactcttttactcatttttaaaaattgagttgtttgtgttctgattattgagttgcaagagttctttatatattttggacattatcagatatgtaactttctcctagtctgtgatttgtctctattcccttaacagtgtcttttgaagagcagaggttcttaattttgatgacattccatgtaccttttctattgttttattctttcttttggataagatcataaatattttttcctatatttccttctagaaattttgtaggttcaagtatatatttaggtgtgtgacccattttgaggtaattttttaatgtgatatgtggtataggtagagattcattttttgcatatggatagccaattgtttgaatgatctgtcaaagaccatccttttcttgccttggtcactttgctattctttttcagaattgttttagatattctatttcctttatctttccatacaaaaatttagaatgagctggttgatttctataaaaagtcctgctggatttttattgggattgtgttggatctgtatagcaatttggagagctatcttaactgtagtgagtcttctaatcatattggtaggcttttaattgaaacatttagagaggacagccccagtggtgcagcggtttagcaccgcctgcagcctggggtgtgatcctgggaaccctggatcgagtcctacatcgggctgcctgtatggagcctgcttctccctctggctgtgcctctgccccccccgccccgcccctctctctgtctctatgaataaataaataaaatctttaaaaaaaaaaaaaaagaaacatttagagagagtgtagtagagcaccaatgcattctctagttgtttaagaataaatcatactgaaattaacccttaaataacaagtacctagttaatgtaatgctctatttgaaagctgttcttagggaagaatttttagcatcaaggaggaagtagattatgattctttctctctttcaaaggcttattctggacccactataagatagctggctcagcatttggaaggatgaaaaagagaaagtcagacaaacttcatacataaggctggtctccttggctgccaactccaggaactttctttttttttttttttaagattttatttattcatgagagacagagagagagaagacagagagagagagagagagagagagagaggcagagacacaggcagagggagaagcaggccccatgcagggagcccaacatgggactcgataccaggtctccaggatcacaccctgggctgaaggcggctctaaaccactgagccacctgggatgcccctccaggaactttcaatcctcaagtcaagagatctccaggttaaggagggaactgccacagaggacttaaggcctcacatctcctcctcctttgctttggttccttccagcgtggcaatactgggctaactgttaaaagtagtggtgcaggaagcagatttaattggaccacagcatgtggggtgtgcctgcccccaggcaagctgttggatcactcaaagagcttttagacaaaggagttgagacattaaatatgaaaataggctctgccagtttctcagtagcctggaagaaatgcctgctagagttgataactgagccagtcagcagatgatattatagattagtacacagtcaatcttatctgctcttccactaatgtcattatcttaagcagcttttatgaattaattcatcaattctcaaaaggccgtgttaataagattactagagctttcagccctccttactataattcaagaacttaaggttaggagtaggatgggagattgtttaaagtaagtttaaaaagtatatttgtattagctcacaggaaaaagaaaattcaaacaatatagaagtgaatacaagtaaaatggtcaagtcttgtcaccacttggctactcacagttggtagaggtgaccatagtttgaaagtgtagtgtctgcttcaggccttttgctatctttatttttcaaaaagtgactatgtgagatcattttgtttttaacctaaaataggaccatatttaatgaactgttttgcattcttgttttgtttttttaatttaccttgtctatagatcatgggtacaatttttagttcttaaagatctaccttattcttttcaaatggtcgttaactatcccatgactaatttttccattctctagtagatggatgtttacatttcctccagtatttctctgttttaaatgaaactgctatgggctttctatacacatattcttacatgcttccaaatgtatttccttttttaaaaaagttttttagggatccctgggtggcacagcggtttggcacctgcctttggcccagggcgcgatcctggagacccgggatcgaatcccacatcgggctcccggtacatggagcctgcttctccctctgcctgtgtctctgcctctctctctctctgtgactatcataaataaataaaaaattaaaaaaaaaattttttttaaagattttattttctttgttagagcaagtgagcatgagtagggggaggagcagaaggagaagcagactccccgctgagcaaggagccaatcccaagaccccggaatcatgacctgagccaaagacaggcacttacttaatcatctgagccacccaggcacctcaagagtatttcttaaaagacattgataggaagtagaattagctagtcagagtttaggtacatgtctaggtctaactggtgaagctgaattgccctctctagatggtaaaggagaatacactctcccattccttcaccaacatggcatattagcactctttaatggtttttttaccatgataagccaaagaaatgtcttttgtaattggtctctgcctgatccccagtgaaattgagcatcttggtcattagtgttaggtagtctgtgagttatctatctttttttcctatttttatacttagaaaagtaattaatggtggtggaaacagttcatgttctgataatatttggccaaagtgatactcagaagaaagtttatatccttaaatttatttgttataaatcaagaaagaccagagttacttgggtggctcagttggttaagcatctgactctcgatttcagctcaactcttgatttcagggtcgtgagtttaagccctgtaatggactctgtgcccaacaaccaaccaataaacaaacaaacaaactaaaacttaaccaaaagaaagtagcagagaggaattaataaagataaaagcatactttatggtgtgcatgttacacctcatttagttaaagaaaaaataaagaagaaaataaaagcagaaataataaagtaaaaaaaaaaaacaaaccagtagatttgaccattataatgaaaacttgtttgcttaaaaattttttttgattatttaatcaagaaaagaggggaaaaaacacaacatggaggaataacataatgaacacatacaaacaatttagagattttaaaaattaatagtaagactttatagaaataaatttttgtgcttagtttgagttgctgccatcctccaggatgaattgtctaggagacttactcgtccatcacaatgaccaattgcagtagagtttctggtggcatttagtgctcagtgactaagcatcttgcactatctatgctaattccacaattgctggattgctgtttatgtcagtagatataacaaaaattgacagaaggagaaagcagcccatgaagtagaaaactcattcctccagaaaggtactaggcccagatggttttatgatagttttttccaatgaggtattcctctgttatttaaatgatttccaacatagaagtcttctgaaatatattattcagggctagcataattagcaatgaaagcagtgtttctccagtttcatgtggcatagtcattaatttccctttggcatttaactctttgcccactggacattctggacatactgttcagagaaacagtagacaactttccaggtttgatagcaaatgggaaagtagccaagagctctaaaaatcgttgttctctgtgatgctcttttgcagcatccactaatagtgcttaggtcccggtgaagtggttacttagctgaggacagtgatacatgtggactctttggcacacagctacattctgaggtttttaagaagcaagtaagtcaatattcctgagagccatgcatttagacctaagtgaagtttgtgcatgagcatgatgaagacgtctatcgttttggaggggaggaaaatgttctcttcgcttcttcctctactcccacatccagagtgctgccaatcccgagcctatagggaaatctatagtgtaagccttggcttttccttttgccagcttgggattcttaggtgtacatccatgtgcagccccatttttacatttggtttagtaagacttcaggaagaaggccagataagtgttcaatctaccatcctcacctggaagcccaggccagattctcatgatctattccaaggaataagtttggatgcttttcccaaaagcaaaaaaaacattaaatgacacagtttaataattaagccttatcttcagcagcttcctcttctctcacctttgtgcattagaggaactcctgccaaaagccctacagtataactgtcttgctcttatcaatttatatttctgagttgaaatagttgcttttctttccattgtggaacatggaaagtccaaaccttgtgaactgtacattcatattttctcccatgaaatgtattgacaaccatttatatacatatgtatacatgagacatatgtaaaatacataaaagggcagaatatgttaaaattctataaagtggtacaaagtaattttggagttcaaaataggaataaattatgttagtgcaggagatcagggatggctttgtgaaggaaatagcatttgagcttaaccccaaaatagagaattcttcttgctaggcagaagtaaggaggaagaagaggccattccagccagagggagtggcataaacaacggtaaggtgttgggagatgatagagctcatgtttagaaaatggtaagtaatccagttcagctggaacaaagaactggttgtagagtattggatctcaaatgtcagtcattattccaaagacagtgcagtgttgttgaagctttttgagtgagatggcaagatagaagccatgcttttatcattgtggaatcttagattgcagttgggggagactagaggcaggaatactttgaagtcaagagacttcaaggaatctcttgaaggaaattagggtccaacaatcaaatatgggagaatcaggaagagagggtattaaggatgattctgaggttttgagcctgggaaaataatgtgcagctaacaaatgggggattgaggagggatatgcttgaaggaagatgtcaagttcagttttgagtttgagggtttcaggtcctaggagaacatccagctaaagacactccataaacacttagaaatgtgagtctagttttcaggagagatagaaaggttagaaatgcagattcactgatcatccaaattgaggtgatggttaatgtaaaagataatcagttgctgagagaaaaactagaaagagtgaagaagtcaagaatacaacctatatttagaatcacaagggtaaagaaacacaggaagataaccaggataatgcagtgccttcgagctgaggctgaaaaagatggaaccccaaaataactgttgtttaaacaagatagaagtccataaacaaggaatccagggctagcatggcaattcatggtggtcaaggaaccagtctttttctgccatctcatggttcaaggtgactattcaggttcatactgtcagcacaggaaggaaggaaggggagaaaggagggtgctttaaagttctcaaaaattgcacacaccactttcacttataactcataggccagaatttggttatgtgactatacccacctacaaagaagctgggaaatgtagtcttcaatataagtggctgtgagccaatctaaaaaaatcccatgacccagaaagaaggagagagagagtaccagggataactggtaaactgtgtcaaatgatacagaaagaactaggcgaatgaagactagcaaaagggttcagcagttagaaggccattggtaaattcaggatggggagatacttctcggaggtacgtgggaaaagatcaatctgtccccaggttttaacgtgttattgacagtagttaaggaggtttctctggtcagagtcttctcaggaaattggtgtgattctatccaagagtggaggtgctgtgggaaagatgacaatctgaacaaagtgggggagatgaggaattcatcctacagtgacagcacagttttccagagatagatacaagagtgggtaggcctgctagtccacttggatccttgctctatggcctgaggaagccgtttaacctgtgtgagcctgactttctacatgtaaggtagggatacagattcttacctcatggttgctgtgaatattaagaaaaggcttagccgggtgtccagcatagaataactagtacctaacaccatgtagctgttgaacgctggctgagctaaagaaattggtagaggactcagtcagttgtttcttgagtattcagtggggctcaacattccagcaactggagaagagaaggcaaatggtcacgatacccagtgttggaactggcagaagatcaaggggacagagatgtcaagtgtgctgttaaattaggcacggttaagtatcatggctggttggaaaccgatccaagcagagctggtatactggggcgggggtgggggaggttcaggggccagaggtcccccagcaggagtgaacagactgcccaagaggagctgaaggaaatgggggagctgtaaggtaatcaggaccgagtcaaggcaggacagtcctgagtccccaaactgggctgtacctatgggtgttgcagtgggtagagatgggtcctgacctgaacattccccactgtgctgctacacgtcaccctgcactaaacttgcaagactattggacagtccccatcagtggagtcttattctgtctagttcacagggcccacagagaagaaaccagcctcctttgcagagttgggagaaaggaaaccagcctctgtgtgcagtgttagtgtgaagagcagttcggaaatggttgtaaatgaagaatgatgataatgattgtagctaccacttaatgagtgcttctcagggacacccatgtgctgagcccgtctacactgattaggtcattgtgtatctcatgacaaatcttccgggtgggggctatttttatcactgtgcaatagatgaggaagaagttcaacgttagagctgggtcttcagccctagtctggctgaatccaaagcctgtttagccatgaggttaaaccattttcatccagggccctgctgctatacacattcttaaagtcctagaactggaagattagttcatctaataaaaatcaaatcttactaactctcacagccctagagaaatgcatcccagcctttctttctctctttcccttttttttctctctctctccctctctttttccttccttccttccttccttccttccttccttccttccttccttccttccttccttccttccttccttccttccttccttccttccttcttcttcttcccttctttccttctttccttccctctctccctccctcccttcccagagagggagaaaaaaaatcacagagcttggactataatttggacctcctgaatcccagtccagacctctttctgtttctctggttgccgtggaccagaaaatggactttaggtctacttgtcttatcagatcacagtggctggcaagtgtctgcataacctagttagcaccttccttctgaggaaaacacagtgaccttccataagtagccctgtacttgggcattttcctggacacacacactttctggttcccactgccgtgactgggcatttagagggttccaatcctaatggaataaagaaagtggagcagtctgggtaactggggtaaccttcttcaggttggagggttgatttgacttagcaagttctcatacaagccacatttttttaaccttaatctaaacagacaggggggtgactgaaaatgtgtaaatgttaaaatgttattattcagaagcccttgagatccccatggatcatcatcataattagaatgcaacacagaagaccccttgcttcagcagttcacagggtaaaaggaaaatgaatgttcagaatgaataaagattgaaagttgaaggggctggtaattagcatgctggtgtgtgccattcagtagagcagctggccttgatatgtggggagagtaaggaaacagctgtccttgtgtcccggcccattgtttctctcctagaagggcaggctgtgggactgctgagggcagctcaggaggaggatcagaagctgcatagttctgaggtgggagtgcagtgattcccagtaagagggagagcctcaggcctgatggtcctcttctgcaagtctgggagtcccaggagtgcccacacacgaggttcacatccctgatttttctaatgtgtttctgccaaactggaagcctgtcaaggtcttacttgtccttcagcacccagctgatactcttctgagaatccttctggttgaaagtaatcactctccctcctgctcactgtgtttttggtttatacttttctaaaagcatctattaattttggcgttgaattctagtcatttcttctgatagctggtaagcccattggggaaactcagagtcttcatctttttagctcctaggtgctccctgaaggcaaacattttgcacatgcccagccacagttctggggcccatttcccacttcagccttctcactgtattatcttctatctcctccttctgctgtccagagctgtaaggataatgaaggcaatggatactctcacacatcatgtatactgtctttggtgatcttttcgacagacctatgagcaacagactagttgttggtctgatctgtgagcaaagtatattgtaatggatctggtgtggagaataataataattgttaacatctcttgagagctggcatgtgccaggtgtggttcttgacatgtataatttaattctcacaacaattctatgaagtcagtgctgtggtgatcccaaaattatagatgagaattctgggcacagagaagttaagtaatttgctcaagatctggttcatgatcagtacattatattgttgccaccttgttcctaagagacctaatattatcctgactttgcagaaggaaaggatcactgagtagttcttttcctacctacaatttgccaggatatctagcttagtcttggatatggttttctatggggaagagatcactagcttattaagatcctgaagatctttgatcctgacaagcttttcaaccaccaaggtatctttcctagagaattgcctgggtaagtcatataatcctaagaatcctttcccaagctttcttatactccataaagtactggtaggttatgtttcccctaatgggattatggccctcaggaattcttcctcttcacttatttcctccttccataagtttccattccttctttctgcccacttccttcccccggcatctgtctggtattaagctcttggcatcggtctctctttcttcattgatggctagcatgaatgggtggctgttagacaaggccttcattgtcagctcccacagcagcagtcagaacattctccatggcctggcttctgaggtccacccaggcagcatgagccaggctgactcccagttctggactccagtgtttctcttttgttgttggactcctctccctccccaaaatattgtgaaataaggagctagatgctggcacaaaggattagaagcctgtgttcctgctaccagagtcctctttttgtattcaaatgtagtcagaggaacgttgcaccttgggccaaactctaggacattggccattttgggtagggtctgagaggtaccaattttgactctccccatcagcctctcctaggaagcactgttggtctgaaccaccagtagatggtcatgtgtcatcctctctggccccaccttgcaacgctacagggcagttttgttcaggctgccagttgtcatacgcggaattcatagctgtgaagtcatggcttcctggggctgagttaagctggacggaactcttatgtatgtgtgtacaacgttttttcttcctagagaaatgatttgagttgttcagggcttgttcagtgcgctggacctgacctttgggggatacagtttgtgagttaggggtgtgaaaatcccgaagcagtcaagtgtagaggaaggagattccaaagttcatactcctggactcctgtggataagtaatcagtgccataaagtggagctaattggctgcctccttgaagccccagcaggcttaccaaaagctaaacagactgtggagactgaaccattttcttgagaaagtgaggtgagtggaaccatgtccatgctcaggcctcagggtgatgggctcaatatgagaactggttgttggcggtcttaaaggcggtcttggaaaagccagcattgtgggactttggcattgggcatgggcagtaaacactgtgtcttaacgcatcatgtttataaagcacccccctcctcacctcacgaccctgttcagttgtggaactgagcttcaaggagtcttgggctgcaggcaggctattgagggagagtgggtgctatgtaagaagttcctgagagaagcccctaggcagggatctgcagcactccccaaaggggagaaatttgccatcacagtgtggttaagacttggatactcatcaccattggagcataaaagggatttttaacaactatgcagtccatcctacttattttagataccgaagctcagcaggatgaggtcacacagctagagaggagcataaccaggaccagagtcaggtgttcagaaaagcctaggttaaagtcttctcccccaccaccttggacaaaccactaaaggcctgagggccttagatttctcatctgtaaaaataattgaacttgatcctttgggttctaagattctctgaacccacgaacagtacttaggaactttgggcagactagggaatttagtatctatactgtagattccaattatagagaaaataacactgaatatcagcttaggaacatgagctagtgctgggcacagggttgttcatctatcctgcttatgtgggtgaaaatctctcatgggtctgagttcattcagggcaagtcccttaggtgtcctagtgtgatactgatgttggactctgatttggtcaattatttatgccactccagggcagggtatttgatatcttgggtgagtatacagtcgtagttggcctcatgagctggtagtgtcagatttctgggatgttgaggaggccttgagagaactgcaaatgtttctgggccttgacaaattagaccatcctgttttcagtggatcagctgaggctaaacttaagcaaataggagcagctgggaggctttggaaggagtgagatgtgcacattctcaaaaaaaaaaaaaaaaaaaaaaaagtctgtgctccctgaggaaggaaggatgaggcgtggagccctgagcagcccccctgtgaggaaggaagcagttatttctctgctgttttgttttgcacgttcagtcaaagaattccagaagttgcaggttgtggatcctgacctccattttttcaccctctgttgctgcttgccagaggaagggagggcgggtggctctaaataacactttggcctttatggaaatgtatcagatgttccaggagtgagtcttgcctgctccctggcgctctctctctctctctctctctctctctctctttctctttctcacttttactccagatttgctgtctccttacccgtgtcctttctgtaggatatagttagtacttctcgccttatatagcaaggtctggtcgttaatgttaacagaaacttaacaacagggaaggctgccagctagcattaatcaggccagtgtttggaatttcataaatgctctgactttgggtacaaattgaacattaagaacaatatgaaactgttttcttccttcctctctcttcttctttccctctgccctctctccagcccatccagcttttctctctttccccgtttttgaattcctcagctctgccgtacactcgctgcactggaactttgttgatttttgccacatttaattttttatttctctgtctctccgtccactccaagaccacaggcggagcagcagcagccggagccaggactctgcggaggggcaggacgggcaggtcccagagcagttctcaggtctcctccacggctcctccccggtgtgtgaggtggggcaggaccctttccagctgctctctgccactggccagagccatccagaagggtcccccgcacagggcgcctgtcacgaggccagcatgcagctggaggagacgggtgtacacgctcctggagcctccccacccagtgtcctggaccagggtaagagagtgggttacccggccggcctgcccaccaccaccagccaatcgcaccccgaaactttgactcacacagcatcgcaacaccctggtggtgccgaggaagaaaaagaccggagtgggactaggagccgagcccctcccaccagcaaacccaaagctgaactcaaactcagccgcagcttgtccaagtctgactctgatctcctgacctgctcacccacggaggacactacaatggggagccggagcgagtccttgtctaactgcagcatcgggaagaagaggctggagaaatcgccctcctttgcctctgagtgggatgaggtaaggccacgtgacattaaagggagctgggctggccacagcccaccacagctaccctgtgtgctgactcccgggcccaggacatgtgggccagggttgccctggttccttcatactgtgactagagcatttctgacaactgtgatgaggcaagcccaagttgctggggcaggggatcttactgtccagatggcaaaggataggcccattcatggttaaaactagagggtggcggctccaagcagagcaagtctgagggtgaggcagttcctagaaatgacacgctgtttggaaatatttggatcccattagccaccatccagggagtcatacataccctgaagctgcttaagaagagctagaaaacctagtaggagtcttcagaaggaagaaggaaggtccagagtcagctaggagggggtaagaagggtgagctttgggatgcctgggtggctcagcggttgggcgcctgcctttggctcaggtcgtgatcctgggatccaggatcaagtcctgaatcaggctccctgcgaggagccttctccctctgtgtctctgcctctctctctctctctctctctctctctctctctctccccccctccgcccccccccgtctgtgtctctcatgaataaataaataaatctttaaaaaaaaaaaaagggtgagctttgggagaagctgctgaaaagggatcagatgggcttttctattctccactcctccatgatttttcatactgcattcccctggaagaccaaacgtctctcccaacagaaacattctgcccgtcccacattcccgggttgatgaggcagagggctaggtggttccaaaaacaaggagagattagagaggagaaaacatttggagtctgaggcccgggttcctttcacaaccattgttagagaatagttagaaatatgtacctgaatattttttcagtgacctgtgacatgtcttactaggcacaagaatgtgtttgtcaaagattggtaaatacccagagaatgttcaagtgctacctttgcaggcttcttgctgaaagggagctgcctctgaaggggactgggtctgtctcccaggaacattcttaggagatgaatttagcttgcaaattggaggggaacagtgcagctgccgtgtccatttgagcagtctgtagacaaaacgccctacccaaatctattcaggttgcagctgcaaagttatataaaccaaagcgaatcccattcccagcgtgggaacagagtgggggcaattcctacggcactcttatctccagataagatgtggtttaggactcagggactgagggatcctgtgcaatagaaagtttttacaggttcagaaaccgagattgagtgagcctggactagacagacgctagaccacttaaggagaatcagtttgagttaacagagctcctggcccgtgggagattacacacaagagtctgtgtgctctacctttgctttttctttctttttttttttttaacttttttttaaaaagatttatttatttattcatcagagacagagaggcagagacatatgcagagggagaagcaggctccctgcagggaacccagtgtgggactcgatcctgaatcctgggatcatgctccgcatccagaatcctgggatcatgctccgcacggaaggcagacgcccaacctcagagccacccaggcatccctacctttgctttttcaaaacagaggttttacttgtttacagacaaggatataggctaaggcagcttaagagtaagagaagtccagtgtactctaaaatgggaggaggggccaacggagaaaaacatcagtgggggtgggagggtggagataagtttgaagacagagggtgggaggaggcttcaggaaagatcccagagacatggaatttgatgtggatttaaaaaaccaagtgcttcaggtttccctgaagcaggttgcaactagttgaaatgaagaaagagttctggtggagagaatagtgtaagcaaaggcatcaagctgggaaagcttgggtcattgggtttccatagagagtagaggtcgcataggggagcataaggaacaggggcatcacctggctggctcagtcagtggaacagtgactcttgatcccagggttttaaattcgagccccatgatatagagatcacttaagaattaaaatctaaaagaaaaagaaataagggtagagggtgagattgggaccacctagtgggagtagtctgaacgtgaggctcagagtgtgtatttggtttgagatcaaggcagtatctcagaatctttcaaatgggctggaagacagctttaccaatcgaatgaattacctcttctttttggctctatctcctgagcatgtaccttccacccaagaggtcaataatgctgggtgatttgccacaggatttccatgctctgttaacatgcagctttgccaggcaggcttatagcctcactatttcctcctggagaagaaacatgaaatcactgaagcacagcccagcttaattgaagttggctgttcaggctaacatgctagttgtcccttggcaccttagcgacaggaggttcatatgtttacatttctgttcttggtagagcttgcaggtggctatagtgaaccctgggactgtttgaggtctggatgtcctggaccagtttgtaatgtgactgaaccaccagaagcactgttacgctttaaatttgaaaacctaaggcaactgagatcttactggaaaaaattcggaagattgagatttgctcatgagatttgcttgtgtagagtatattagcagggccctccatgtgtaatccttcattgctgtttttgagtcacattatacttggttttggtggatacctctgtctaaagagaaacttcagaagtgttctccgcaggggttggccctagaccggagaagcccttggcagactttcctaaaacaggtcattagttaatggctgctccctgccctacccctgaccaatgcctgaaggctgctctgccttatcttgtacttgagatcttttctttatcttccctagatccctgggaggttggggaaagctgccctgaaggagcttgggtccccgctcagctcctcactgtggagcccaggcagctgtgatccctgcacagatggagttgcaggccagtctgccaggttactcctagaaggcagtgcagggagatacacaggactcaggctccagagtcagcagatggagctttgagccccggctccaccattagctccaccttgtcgcatgagtggcctcaggaaaccgtcacgttgttaccagttcctgtgagacaggcagtcagctctgtgtttcagagggattttgaccagttagacatgtgtttaagtgcctaacacagtttctactgtgcataaagtattgagtaaatggtagctcttcctctgattgttatgcctggagcttgggagaatggcacctgaggctcagagtgtctccagaaataaaggcagaatgttgggaggcttgtctggtgctggcagaatgctggggaagcagtggagttcaagcccctcacgtggtgacctattgcgtgactcaggcccgccctggagatagaagggcctgcccagcctgggaaagtagggcagcagccccccattgttctttgagaaattaatgagccttcctgccaactcccaggagaagagagaagtaggagagaaatctgtggcctactctgtggtttatttttcagatgtagtcttctgtataagggctggcagtggctgcttgatcggttgcttgttggagctgatgttatgtagctggagaacctgcacagctggtaggttaggagtcactttttccaaatacagactgctccttgcaggtgcttcagccagcccttgttgataacccagaatgagaggactttgaaaagttagcctggttaagatgaacctctgagatggtatccattatgacactagcattctccctattttccattagattcttagtaacaaaaaataatagagtttgctttgaaaagagttcagcctaggaggaaatctaaatccaagcttcagtagatacttttctctgttcaccagtcaaaagtcaaagcactccttgttatcttaatgatgggcaatagaataggggcatgatagaaggcaaattggaaagctatccaccaaatataactttaaaaatacatagattaggaacgggagaatcacctacatctctctacaggttgttaacctctgttaacattttatgtatatccaaatttgagctcttagtgtatttaccaaactgtagtttgtgtttcttacctaattactacattttgtgggtatctaaccgtggcagcatccataagatctggattcaaatctgaattctgaaaggcacagtatcctgttatgtggctgtgtcagaaggctagtttgttgttgttgaagctatcctccagttgggtgtcaaggcaccttgcagggcatcttctgtctgcccctgggatgtttcttacctttctctgcctgcccatgcaccccagaaggttcatctgtgtggcctgcatcacaaagccaaggaatcttgggttgaccgtgtccccctacttaagacctgctctcctatggggacctttcctgaaagctgctatctctgggttctggtaaccagtccctccccttgatacttccagcctggggcttttggctatgactccctctcctcgcttgtcactctcctcccttgttgctctctctttttctctctttcctctatccaaatctgtgtaaattatccctttattaagctcctttggttgcccagtttgtgtcatctttttcctgaggggacactgagtggtacagccatttgtagcactatttctgtcaagggtaagcaagcatagatggctgtgtgctggagctgtaaacatggctcctgcatgtaaattgtgaatgaatcttcatttgcagatgagccagaggtgtggatattcagcgtacttaggatgcaggagaagttcatcatctaacttgaaatgtttccacctctgactgtagggaagaagcctgttctcctttccagagttgttggtgtgcccagaaccaccatcccctgatggatttccatcctatctctgctgcgctgctgtgtggtatgcccccgagtgcacacagcagcagcagcaattagtgtctgaaatacatagctcctaaatagaacaaaaattaccttctggttggattgtggcttggatgtatatagtcttgggggtcaggtaggtctctcatatatcagcctttgaacgggattgaagtttatgggagacaaaacctcagaaggctgcatgtttacttagcataaacatttgagtaattgaaaacttggctgaacgcttaagtgataaatttgtgttttgttgtttttttttttttaatttgtgttttgtaatcagctttcacaagtgggaaatgggtgaagagcaaggtcatgtgttttgtgtgcattttgtacgagctgagaaaaatttctggccagggatttgaggaatgccctggtttcacctgaaatagtagccgagggaacccttggccctcagatccctcattgagcagtgaagtggcagcagcagggagggcacccttcccttcgggtcccagccgccccacccttccgggcacaccagttggaagcatgatgtcatcaagggaagaactgattggttgaactccacagaggcttcggttgcttttaacccttgagggttgagtatgctaaaagaagaatggcctagatgtgaaataaagagatcggagctggagtttctgctgacaatgactaaaatttccatcccatagcctgcagtttgtattgttctttattatgtaaacaaggatgctgtgtggtctttctggctgagcattgcctgcccactctagctagacaagaatgtgactcctacctctagagacaaatcggagcctggaatgtctgtttagttgtttcctggtatacacaggagtcataacttttgtcctagaacctcaaaatttcccttggttttaagtggcttggtaaaattgagggggttttcccccccatattttatttttattgtatatttatttatttgtgagagatacaaagaggcagagacataggcagaggaagaagcaggctccctgtggggagcccgatgtgggactcgatcccaggaccccaggatcacatcctgaaccaaaggcagaccctcaatcactgagccacccaggcgtcccttcccccgtattttaaaaagaaactcacttagttttaggcactcctgaataaacagttttgcctttctagctgctaaatccaggtgattttggttggctctgatttaaaaaggacatctccatggccttgatgctaacagaacaccatacatagtgttataaataagccagcattagtcctggctgtacagttagtgaggggaggactggtgtgcttgacccccgccacaacccacaggaccacccttgatcacatcatgcctctgagtggacaccatgccgtgctggaagggcgggcctggcacccagtctagacgggtaccctcccagctgctgccacttcatttagcctggggttctggagggcctggcttttatcctccctgttctcatttcccagcattcctgtcctctccagctttcttcctgactgctttactacctttttaccccatctgcttctttcttttcatttccttttttcccctttactctttcctctctgttcctctatgctctttcctgtcttttttactttcttcctccatactttcctcattgacttttcttttcattcttatccttcctgctggcatcaaagagaggcttttctgatagccattcctcagccttcaccacctgaagggcttttcttttctctttttaaccctttcaccagcatccattcatttctatattctacagagcattttagtgctcagagttttagtgttcagtgtccagtgtgtatttcacatctaggccactcttttagcatattcaaccctcaagggttaaaagcaactctgtggagttaaaccaatcagctcttccttgcccacaggagactcatccacactgtctgtccccctgtcctttcagaaacaacctggttccatttagcctcatcagcacagcaccatcaaggactgggtagggggacgcctgggtggctcagcggttgagcgtctgccttcggctcagggtgtgatcccagagtctggggatcgagtcccacatcaggctccctgcatagagcacagagcctgcttctccctctgtctgtgtctcttctccctctctctctgtgtctctcatgaataaataaataaaatatttaaaaaaaaaaaaaaggactgggtagggattttgtggtatttgtgaaattgccagaatatgagaactttccttctttgctcctttttgtttccttacattttgttttttttgaacaccagaccaaaagtatgggtgacagtgaatgttagtgaatctgagaagaatttgatctttaatgccagtgcatacagatgccaagaatcacaggaacattttctgaaacattctttttatatactttgcttctggttttatatctctcttccttctttttttctagtaatgacatccagttggatacagactgattttatgtaatttaaggaatagtagttggtcttacatgctaagcaattgtgtttgaaaatcatgtagaggtattttcacaagattgacaatataaaattggagtatacttttattagaatttttcattcattcaattaatttgttgaatacctgctaaattccaggtattctattattcaagcactggagatgagcagtgaacaaaacatacaaaaatcccctgcctcaagtaactgacacactagaaagctagaggggaaagagagaagacaggaagtaaaatcctagtatgctagttggtgataagagtgctaatgagaaaaataaagctaagaggagggatagtgtggtatgggggtagggttgcgggggagggggctcctaaaaggagggacagggcgggctgtgctgagccaccaagctgctttctctgttagtgattaattttcctgtcagacaaatttgaaattctattctacacttatgttgtcttacaagtgtaacttattacttgacttttacttttaactttctttctttttaaccactactaccacctgcttcttttctcttgtttacccccctccctcactgatttttttttctggtaatttgtgttgggggatgttttatacatacatgtgtatgtacatatgtgcatatttatgtatgtacatgcatacatatatttattaagctactaaagtaaaatgaaatatgaatttacaagaatttctcaaacttgggggcacctggctggctcagtcagaagagcatatgactcttgatctgagatcatgagtttgagccctacatgtggtgtagagattgcttaaacaaataaaatttagggacgcctgggggctcagtagtttagtgcctgccttcagcccagccatgatcctggggtcctgggatcgagtcctgcatcgggctccccattgggagcctgcttctccccgtgcctgtctctgcctctctctgtgtgtctctcatgaataaataaattaacgtaagactggaagaatgcaattaatctggacctcacctgtaacgcagagctctttcctggaccgtggtgttatcccaccaccctcgagatgtgctctctgctttcagttctgtgttttcgtggatggctctctgcctttacttcctttacttttttgtcctgctttcttcccatggatgttcccttttgatgcttccaggtgagtagccagtgggtaagaagaatgcctgtggcctggacagggccaagatgctaagcagtctttctcaggcatcctgttctgtcttgctcacatgctctaatgaccgagtccgtggcgccacagggcccacctgtccataactcaaggcagcatgtttatttgtctggacaggtggaaaactgcccaagctcaccaggggcctacaaatgacaatttgtctggcagtctgttcttgcctgtcctgatttagatggccaggaagccatcgtaaactcagatgaaatggtgtggtttgtgtaaatgttctggtgcttttccaccttggagctaattattttcagcagagccaccccaaaaacccacgggaggagtgccttgtgtctgttatgcagtcattgtgcagtcctggaagagcttccctcactgactcctggaaggtgaatgaccctggagaagtttatctccagggcctcactgttccctctttgctgacccagaggataggagggaaaaccatgcaacttggggtgtagtggcagaggagagtacttcaagggtaggaattgccaaaacccaaggcgttgacctgtgctgtgggagggaatagttatcttaaacagccttcatatctaactgcgtatagatgttcaggcaaagccaaccctggtaatggaatttttgtacactggggattttttttaagccataatactcagtattatatggctgaaatttaaaaggtaccaaagaacatataattgttttaatgcttccctctctctcagtcctccagacacccaggtcctttcctgagttttaagtatccttctagaaatatttgtgcatttataagcatattggacatatcaaatatttttctttttaggataagtggtgccatattctacttccttttctcattgaatagtatatttttgggatccctgggtgacgcagcggtttggcgcctgcctttggcccagggcgcgatcctggagacccgggatcgaatcccacatcaggctcccggtgcatggagcctgcttctccctctgcctatgtctctgcctctctctctctgtgactatcataaataaataaaaaactaaaaaaaatagtatatttttgaaaatcattctaattaagtacataaagtatttccttttcttttttatatttcataggattctacagtatagatatacttaatcatttattttaaaagttttctctagatggatattttagatgttactcagtttttactaattataagtagaactacaatgcttatcctcatataaagtcatttttaagataaatttctcgacacctcaccgacctggaggtggtcagctttttaatctctttttggttaacagattggtaatgttatcttggtatagttttggggtttttttaagattttatttgtttattcatgagagacgcagagacataggaagagggagaagcaggcttcctgtggggagcccggtgcaggacttgatcccaggacccaggatcacgccctgagcccaaggctcaaccactgagccacccaggagccccatcttcgtatagttttaaagtgggtgtcttttttattatgagtgaggccagcatcttttcacatgtttaaaaaacactttttcttttctgggctctgcttgttcctttgctttctgtttcctccctcctcctccttttctttttcttttctcattattccctttcttttctttcttaattgctgttgttgatttgatctctttctttgaattttttttttttttttttatttatgatagtcacagagagagagaggcgcagagacacaggcagagggagaagcaggctccatgcaccgggagcccgatgtgggattcgatcccgggtctccaggatcgcgccctgggccaaaggcaggcgccaaaccgctgcgccacccagggatccctctttctttgaatttatagaagctctttatgtttgaagaaattagccctttatctagaatatgagttgtcttttggctttgtttatggcattcaatggattttttaaaattattattgagttattattgacatataacactggatttttttaacacagaaatttaaaattttgtacagttgaatcaatcttttctttaatgacttctggattttgtgtcctagttaaaaggatctttcctactcacatttttaaaaaaataattttcttattttcttctagtactttcatggttttatgtttcaggtttaagtttttgtttttttctggaatttatttttatacaagagaggataagcatcctgttgacttttttctagctttatttctaactttacttattgttttaaagattttatttattcatgagaaacgaaagagagagagagagagaaagagacacaggcagagggagaagcaggctccatgcagggagcctgacgagggactcaatcccggggctccaggatcacaccgtgggctgaaggtagtgctaaactgctgagccacccaggctgccccaagttgatgatttgatacacgtatacactatgaaagaattctcctcattgagttaattaacatgtccatcatctcacatattttcctcctcctcctcctcctcctcctcctcctcctcctcctgttttgtgagaacatttaaattctactctatcagcaaatttcaattatataatacattgttatcaactatagtcattgtgtatgactgtacacacagtttttactaatgtaaaatgtatagatcttcagaccttataactgaaaacttgtacccttttaacagcctctccctgtttcccccccaccctacagccccttcttctataagttggagttttgttgttttaatttttttatgattccacgtataagtgataccatacagttcttatccttctctgatttatttcaccttgcagagtatcctccagtttttttttttaataccctccaggtttattcatgttgcagcaaatgacaggatttccttcttttttttttttttttaatttttatttatttatgatagtcacacagagagagagaggcagagacacaggcagagggagaagcaggctccatgcactgggagcccgatgtgggattcgatcccgggtctccaggatcgcgccctgggccaaaggcaggcgccaaaccgctgcgccacccagggatcccgatttccttctttttttaaggctgaataatactccactgtatatatacatactatatgcataattatgtataaattgtataagttatgcatacataaatgtacattactatatttccttattctatccatcaatgaacacttgggttgtttccatactttggctatcgtgaataatgctgttgtaaacatgggggtgcatatatctcttcaaaatactgattatttcctttggatatatacccaaaagtgaaattgctgtatcatatggtagttctatttttaatttcttaaggaacttccatactgttctccatagtggctataccagtttgcattcccaccaacaggttgcagggctcccttttctccacttccttggcaacgttggttatttcttgtcttttgattataaccattctaacatatgtgaggtgatcactcactgaggttttgatttgcatttccttgatgttgagtgaagtggagcatcttttcatgcacctgttagccattggtatattttctttggaaaaatacttcgttacatcttttgcccatcttattttaagttaagttattaacttatttattttagaaatagcaagtaagaagggggaaggggcagaggaagagggagaaggaggatctcaagtagactccacactgaatgtggagcccagtgtggggctcaaccccatgtccctgagatcacaacccaagctgaaatcaagagttagacactcaactgactgagccatccaggcgctcctctttagcccatgctcgttttaaattgaattggtgttttttagtttgttcggtttaggttaggttttttggtgggggagggggtttgtttttttgctattgagtttaagcgctccttgtatattttgagtatcaaatatgtagtttgcaaatatcttctcccattccataggttgccttttcgttttcttgatagtttccttcactgtgcagaagctttttagtttgatgtactcccatttctttattattgcttttggtgtcaaatccaaaaaattgccaagaccaaacttcctgctcatttttagcaactattcgatctagcccaccatttgattccattttccaagtaaggaaactaaatttctaagagttgaaagaacttgtttaaggtgttagagttgataaatgagggaggccagttggagctatcgcttctaagtcttaataagagtgaatttaaagtagaggtgagttaaagtattgttttcacattaatttacagttacttttcaattcctcttttttcaacccaacttattacagcgctatcctactgcccccctccgctccctgctcaccccgaactccagacaaaaatgttgtcagtatataaaggaaagtgacttgggagagggaactcctgagagaaaacatgagttttccatttcactgtttaaagctcgaatcatttcttccccttcctgctgtccaagatggaggactcttacttaggtttgggatcttttctgcttttgtttttattttgtgtaggacttgcagagtggtgtggtgatttcaaacaaactctcaaattaagagattgaaggaaacctgagttactctgtcacccacctgccttaaacacagtcacctgtgtgttgtctaaaagcaaacttctccatagaaactccaagtgactacctctgtggtccaccattacttgtgtgaaatctcagaaaatcctttctcatttctgactaagatctgtgctttccaccccatcagtcttagttctaccttgagggtcatgcacgctgttgtgcttaatggctgttttgatatttgaagctgcagttatgtcctgctgctctcaaacctttttgtttccttgccaggcaccccagttccttctccttttcctcagatgacttgacttgttctcaaactgcatctgtcctggctgttgatgcatccaggtcatcaggtcctcttgaagttgtatgacgtcattgcagatttaattatacagtatgatgattttacttgtcacatggcccctgataaagcctcatcaaggagtgtgattgcctcctgccctcctgaaaaattaaaggggataaatgtgtctgtgagcccaaatcaaggactgtacgcaggtactctccagagcccctacaccctcctcaggatgccttacacagagctgctctgtgaagtgactgagctgcatgtggccttgggaagcttctgcctgtgagacacagctgagcctctcccctgttgtgcagactcaatgtaggtcctcctggcactccattatggaacaatgcttgtgactgttctccacctgccggcagaatatcttgctctcggtccccgaacctttctcaggcattgttgaactccccatacccttaatttgcagggaaagctgctttggtaccaatttttcacttgaagtcaataggagagatgggaactaggaaagcctatgttgtataaatgaccccctagcaggccctgtaaagagtgtctaaaaccctcactttccctggactcgaaactcttcctcttcttccctcttgtatcagtgaccaggtttctccccgccatctctcccattcccacccaccgtcctggtaccccctcaacagctgcctccttgggattctcctgctcacctttgggcttctgctctagtccttctttcttgtggctgcttttcacaatcctgaatagtttgtattacctagaaaccacctttggtccctgatttctgcagtacagagtccacattcttcgcctagagttcatcgtactccagggatccctgggtggcacagcggtttggcgcctgcctttggcccagggcatgatcctggagacccgggatcgaatcccacatcgggctcccggtgcatggagcctgcttctccctctgcctgtgtctctgcctctctctctcgctctctctgtgactatcataaataaataaaaattaaaaaaaaaaaaatagagttcatcgtactccagagaaaatgaccccagggtccagcttctatacctggctttctctctcatcttcactctattttttcctggctccaggcaattcctttacccacaattttcctctacattttggtttacacctttttttttcctgctggaatggctgtcaacgttttattgaaattctacccttccttaaaggcccgctcattcatttattcaacacattatcaagagcctgttgcacagcagagattggtttaggagctgggtgtacagaagtgaaatagcaaacaaacactcagcttttgagggacttacagtccaaggggaagatagatgttaaaccagcacaaacaaaaatatttcacaaatgaagacaaatgctcttaaagaagaacacagtgctgtgagggatgagaggtggggtaggctgcgtttagatcgaaggagttagcctgatgatgaacagtggtagggaccagagagcccagttgatggagagaaggaggtccagtctctactacaaacccacccgtgggcacctcaagatcgcagaggcatcccctttggctgttgactcctcaaggcaccgatttgcacttatgggcattgctgatcttatttttttgtgcatggcctatctccctaatgggatcagagacatttcaaggatagtaatcacagttcatttttacaagcccttaggttccccttcccagaatgggcacttagaaatgtgagccagtggttaaggacctcagatgttggaggtcctgagtccataaaatgtcatgttcactccaaagagctcaaggtttggattgctaaagaccttgccgtgtttgggcatagatctctttttttttcttctcaagggaaatataataattaagtccttctccatctcccccttaaattttgaattttttttttcattctctagtaataaatcataggccttttgtactaccactgagggattctagaaaatatgtgatataatttgcttcacagatgagagcatagaaatttatgggtttcagaaaaggtttattgctaatgttttgtggatttctcagtttgatagattagctccccccccttaatttaagttgaaaatgttttactaaaacattttgatttttgaaagggagggttgaatttgacatttaaatgccagtataagttttaagctaactccatttactgcctgccctctcatacataaactagttaacatttataaagaatgttgagaacagaagcccccttggaaatgtcacagtggatgttacaaccctttctactttcaaatcgcatatatttaagtcaagaacaaaaataggtttggactgttcttggcccttcatcttttaaattagattgagaacagaaaagaaccaaaccagatatgggatatttcagttaaaataccagcttctgcccaggtagctccatctgtccctgtaagtctccagaagggctcgctgcggtggagtgaatgcataactaaacaaatccttagctgggtccgtgtgtttaaagccatttacagactttataggcacttagtcgatagagcagaagagttaagttagcatttctgacatatatgaatgctggtggaattgatttggctaaagagaaaatttcccgacgcccattttttaaaaatcagaaatattgctgctaatttagaaataaggtctttgatgagtctcccccattggggtattaacccagagatctggccatgctccagttcagataatgctgtttctctgtgctaaattcctcctgaaggttcaattagatttggcctttattcatcctgggcaacgactggaaaactgccaatttctaaggccggagcttagtgatggatgcatttgtctcactgctgacaaagatttcaatgtataatgtcccaggcccttgagggtggaaacagagactgatctcagtgaggaacaagtctattggccctcacgctgagatgcgttaacgtctctctgtgctctggaaagggttcgcttgctagggtgggcccaagcaggctggattttgctgcctattcagaccctgtaactgggaaagaggtccactaattcggtgttttattcaaagccatcagtggtgttaacatccccagttcctttggtctgtcagtacacaaagcaacatctactgggtcttgacacagcttgcggaaaatgccacctgcatttggggagcattgtgtgcctctaccaagtttggggctgcgcactttactgaatttagtttagacagtgcttcctacttggattaatgaaaatatatttccaagtctttgtaggcttgacatttcttgggtcattgcatcatttgctaaattttattcactatggtaattgtgtctatatttcttcagtgttgagctgggaaaggatgcagcatcataaatcaggggagcttagtgagaagcaatcaaatctacaaaggtgagggctccacattcaaagaaaggaagcctgagctgagagtgtgattgacacctgtaaaatcacaggactacagaggccagtcacagccccgttcccaaatcctagcataatgaggtaaaacacagatgtggaaacttgaaggtggtgtgttagaacagctcaacgaaaccactcacgttccctgggtggtagtaatcctgtgggactcattaccctcatgaatacgtttgcttaggaactgtcttgccatgagtaacagatgaaaaggcatagtctgggctggcctccctggagccctgttcctagccacactgcctgtggccatccaggctggctgagagggtacactttatcagcagtttgctataagatgccaactacatgtcaggcattgtgctaggtgttgggtacaggaggtatagataaggacacagctctttctcttagggcactttcttgaaggatatcaggggtggcttctgaattttgtataaggaaggtttggaggcagcagtctgattggaagcagaggcttgtcttaatgatatacttcactgttttcacttaagttttatgtgttagatcaacaaaaatcgtttctagatatgcttttatttatgtcgtatgtaagactaagaaaatgttagttgtttatacattaaagaatcttttctttgggttggcttgtcaagggactgttgaaatcacaggtggataaatgtgccccagctccaaggtgcccctccttgaggcagccattgccaggccccatttctacatgtttaatcttaatgccacattgacatatgagtcttaaggtagttgtttgttttgctgagttcctttctacctcaagcctggctacctaccggcctagaggttgccatcctgggtctgtcagagatcagacaacttcacctctcttcccagtctcacagttgatctgttggtgattttgagcaaattatggccaactctgagtaacagtttctccttctataaaataaaataaaatgagaattttccggcaggctctccccatggaatctgaaaggtcagtgctttgcctaggacacatcaggagatttgttcaaaagcccagcctctcagaaatatagtggtgtcatcagtggctgcccttcacaggtggctgccccacctctctccactcgcatcctgctttgcattcagagcaggaaagctgttcacactaggctcatttaaaaccacagttgaggaggttatcataggatccttaatttagtgagaggctccagttttcccctcagcagttggagtgattaaatgtcacactatatcaggggagtaccatttaagaacatggatttcatgctgggtgcttctacgttccctggttggtttggggcataggactgacctaccttggcagcaccttgaattggggcattcgttgaattgaattggactgaccagccagaaggatctcaggaccaggactgctgtgagggcttcacctgccctgtcacagtcagccccctggagcagctaagatgttatccatatttctcatcatgctgcccagacagccgggcagaacatttttgctttgagctccagtgcttgctttcattcattgtaaaatgtttgagccagatagttccccaaatagtagttcctctccttacagattagtaaactgaggcccacaaaggatgcgacctatccagagtcttgcaagacctttgacggtgcccagacctctgttgcctagcaacatctttgggacagagtagggactgttacttgttgaataaatgaacacacccagatctcctgggattttgagtaacagttcatttttccttttttggtttaaactgtcagcctaccaaatctgttggttcaatgactgatctagaatgatagaagattacacctattttcatgaaacagatgatcacccttcctgttgcaaatgccaaatggaaagtttaactcctcattgttctttccctcatttatggcactttcaagtagtggtcctcagggtgtgagtacagaccgcacatagggacgtagtagaaatgagaatcttggactactgaattgacccctctgggggtgaagcccagcaaccaaaaacagcctctctaggcaattcccttggtgccgaagtttgacaaccactgcttcaagagctgtcttggcagagtttcctctaatgtagggttgtataacattagtaatcaaataaaatttagtgcaagttttatctgacacatttaatatatccgtggtagttagtgtgctagcagtaattaggcaaatgaaaagcagttcttttaaatggctattaggagtattacccaggcaaatcaagtttttatagtttttttccccccctctgttagctttctccagtatctgatagcggccatgctgttggcaatttccctcattacacagatctacatccttcagacacccacagaaataacactcattcatatttgaagctagctctaatttctcaattgttgcagttccctgtgaccatctatcttaggttgagttcccctcaaaagcaggatttagatgcaaatagtttatttgggaggtgatctccagaagcactggtaggggttggggtcgtgagaaagaaaagaaagcaagaaaaggtttgtgatctcggggttacctctctgaaccctgcagctcagccccactgggaaactctgacagatggcttcagttatcccagtggagggtcgagggggcagggtgttcactacctccagtcagtctgggtgagagctgcccccatagttggaagagaggcaagacattactgccctggcacttccagtctactcaggatttgggcctggagggctctggtggccagagaaaacccacagagggttgcaggtgcttgtggttgcacactctctgatgaagcaggctcagaaatgatgagtgctgagagaatataggccagtactgatggtacctgtgacaccacccatcagtggtcccaggtttttttgcatgcacccctccccacccccaggaggtctttgtggagcaccaccattatccctcttggcacttcttgggacagacctgctcctggggtcccggtcctggaggggacctaaaagcagctaccaaggatggtgtcaggaggaagggagactgtgctgtgagaatactctggatcttagagtctgagccagggagagggcaagatagagtaaatgaaaaaagtctggcactgtgcaaagacgaaaaggcaaagcagaggattctaggtaagaggagtagaaggcagaagagaaacttaaatttcttgtcagcaaagcctaacatgccctttcccccaaccctgaacagcactctcgacttgcccactcttgggttctagtctctcctggctacaaagaatgatcagaagccagccaggctgagaagaaagggagctgtgtgccaggcctccctttgggtggatctgttggcacattgtggttgcttgccagactgcagaggatagaggaaccagaattttgcactcttactgaggtagtcctaacctagttttgaccggtcaatgataaaaggaaaaaactaaggacaatgaggaatgtcatggtagcactgatagggtttggttaccagctgtctttattcagattatgtctattctttttttgtgcttcattgtcctttcttctataaaacgaaggagataattttcatgttaacttaatttttttcccatattcaagttttttattttgaaataattatagattcacagggagttgtggaaataataacagagagatccttcacccagtgcccttcacccagcctctgcaatggtagtatattacataaccctcatacaatatcagaaccagaaaaattacattggtataatccacacaccttacccacattccaccagtttaacatgttcatgtgtgcacacacacatgcatgtatggttcttaatggttttattaggtagtaggttcatgtaataaccaccaccacaatcaagataagaactgctctgtcataaagctctcccttgtacttccatcatgttcatttctaaagtccttgtttaccatgagaaataaaatggcaaccatataactttcccttgatcccagttaggagggaaaatggcctacaaacttgctaagtttagggaccactgccctgtgtcccttgttggagtgagacagcgcaacactctgcccagaagccattttccttccagaggcaagtgtccagggatgcagagacttaaggataagaacactcatctctacctgaggcctttgccttcagggttcagcctctaggggcttcagtatcttccccaaaggttgctccatgttctgacacttccccaacttgcaaaatcagtgggtatctcagcagagaggcaggaagcaaggttgtaggccctgtcttgcccatctccttgccttggtcaggttacttagcctctccaagcccttgtttccttacttgccaaactgagagccatgtcttcctgtccttttgtcaccactggcatggtgatgagtccagacggctaaattcattgatccttgtaccagctgtactcacttattcccacttctgggagcaaagcatttttgaaaaaggggtagaagttttgtacttcacagttttgactagaaccatcctgtttattttcaactgtgtaggagcatatttgagattctgatgcatgtgcacacacacagaaacacacactcacacatagacagcctgagctcaaagacgtttgagaaaaacaaatctcttgttgatcatggctacagtggatactacacttccttcagtctaaacttacactttctctacaccagttcatgtgttgcccaatcctttaattggataagaggtagaatcttagatgacaaagtatcctgtacatcagttgatggtagcaccaggaagcccctcctggaacccctgcctgatcttttgccagggactcttgggggcctcaacaagcttctccttgtcccattcattctctcctctaggcctaagggattggcacgcctgttcaggctagatggcctgccctctgtctcttccctctctcgtcttattccagcactctatgaggaaatgacaaagttttccagggtctccccagttttgctataactgaaatagccacacagtcctctttttactgctggtaacaaaaatggaaaactcagaggccagaagaaatagccaataagtggccaacaatggagatgttataaagttattggaaatatttaaggcaataattatcctgggtattaactcaaacattaataaaccagttctttccttggctcctctgactgacttcttcctcatgaggttgttgtcttgaggctatgcatagctccctacctcctgggcctgcatgcaaagcccctagagaacagttcttggcagtgataaatgcttgcaaaagagttgagcctggttggttgtggttgctcgggaatctcggtgcaggctgaggctagagatggtctttggtgggtggcctggggatctcccagaccaaaggttttgcaatgtggagagtacagcatgtccatcttttctgcctttcttctccctgtatgccacttttattgatgatcttcctgagaatattcgtgcactctgtaattgcaaagctcccttggtaacaggcccaagggtgcaagtccacagggcttcttctggtgcaggcagtcttcagtgagactgttttgaaaaggctgtgttttttctggttatatgatgtggttgtatatttgaacatgtaagtttagcccacacagtttcatgctgctgcccatatagggaatagcttctctcaggagtcccagaagactgtgaccttgccctgccagcccactgagaagcaagggcttatggctctccctttaccagtgttctttcttcagctgctggatcctttccaaggcctcccactccccctgcagtcaaagagagcatctgaccttgagccagcgtctcagaatttattgggctaattcaaggatatcaagtgagatggcaactgacatgctttaggaatactgacatggatggcaaactccaaagaaaagccaagggggtgatagcatttaatccaagaggcccatggcccagaggagcatggaagggaggcagtggcttaggaaaggcatgctgtttagtgaccgtgttctatttcctacagtgggtggtgggcttatggatgagttatttcttcctgatgtctgaaatcataatattataaaatagaccctttggaatttaagaaatacttcattttttcaagaggaaagaacacagttacttgtggaggccagcctaggactgataatagaggttgttgactgaggagtttagcagtgagacagtgagggtgcagatggaggcatgttaggtggaaagactccacatatctgggaaagctaccactttcctcctctcattttctctttggggaaaaaaaaatctcagatccaagagagatggattgttctaaacccatccctccctaagaatcggttagatgtaaccactttaaaggctcttcatctgtttttccactgggtattgactacacccgttcagtgctgggtactggctaggaacccccatgggaaatacagaaggagctgaaggggcatggcgtgcacatgttgaaggaccagggatcatcctcagactatatgtgagatgtttgcattagtatagtatagctgggctgcctctgcccagagatcctaaaacaatgaccttagatgcaattagtccagaaagggtgctggcagggaaccgtgcttttcaaacaccagctgtgtgccagccacttacccatgttaccacatttaatcccataccttagtgtgaagcaggtgtcatcatccaaatttatagacgaggttcaggtaggttctgcattttgccagagggacaatccaaggagagagccttgctctgacccccaaaacttgtttatgttagactgcacacaatgtggataagcatggatgacttgagctagtcctggacagaatcatagggtgaggatttggggaccacagagaaattgagagagaagaggcctgcccagctcgggcttgggatctctcaagcagcagggatgtaggttggtaggtagggtggggtaagaggtagacaccaccattaggcctccgaccagggtcagatatcccaggtgcaccattgtccctggtctcaaattctgccttcctacccagaaagtaatcatcctccatgtccttattctcatggataagagagttattggaaatatttaaggcaataattatcctgggtattactcaaacattaataaaccagttctttccttggctcctctgactgacttcttcctcatgaggttgttccacatatcttacccccatgagtatacttgggggatataaggatgccattcccatagttttttggactccctgatgggtagggcagggcacagactagttcctagctcaggtttttactttagggtgaccttagatgcccttgagcttcagaaaacatgtaaaagacttggaagactcagggtaggtaaagggtaccatgtggaggggaaggatcttagttagcctggtgactctctgtctcagagctccagtttgagatctgggctgccaggaattcctgctaccaagtgctgtgtgcaagtgaatggtggctggaaatttgacttgcctaagatagcctctgagtggatagaatgtaagaggccatgacttgctattgcctttgatctgtaactcacacggccctagctggttggccctggcccctggcagtgattagtgaaggcataaggcattgtgcaaacaggaactgcagtgaggaagaaggaagggctgagagtactctgggattcacctaggtttgtttaccagccctcagtggagaggcttttcagaaagaagaagccagagaggggttctgggtctctggtgtttagacttatttgataatgaaagcagtttgtgaattacggtgtgtccgggctcccagtatccatgatgcgctagtgtttatcgggcactgctgctggctccccacagaggctttctatgtggagacttgggacgggagtaattacaaaactctgttaaaggaggaaatcacttttaaagagaatacaaacattttaatttaacccaaaacggataggtgggagtccccattttttgatgtggagctggagacttttcttcccctattgacctgctaatttggagttctctgtccactctgttccatgaatcacagtcctaaaacatcactggttaatacctccagctcaaatttcttaaaagtaaagcaagaatttagccatttatgaaacaattggagtatagaatccttttaggatgttttgtagtttatttctccaacgatgcctaatccaagagcgtatttttaaaaatgattctattgttgggtctcttcaaagcttccacttgattgtcacagaaactgctatttctctgctcattccatcatttatgtaacgtttaattaaattttctgttctcatcaacaaatatacaaccgtcctaaacagtttaggaaaagatcccaactgatccttggtaagtggtacacccagtgggtagaagcagaagacctgcaggtgcgctcaggagaatcctgcgggctgggaatgtgggcatgagtttactgaggggaatagccagtgtgcatttcagtcagcaaggtagaggtcattaacggacctgggaggtagatgtcattagttctgttgcagatggccctgctgattccacaatctgcctgtctttactgcctgctgaccctgccctgcgggagccagcttcctcagagacacagggcatgccggcagcaccatggcctctaggcctcacctctacctctgccaggctgaattgagaccctgcttcctctccctccctctcctctttccagtgttgtcttgggtcctccgtgttcttgccaaagagctcccttatagaaaagcggcacctccctcacatgaaacgttttgtcctgaatggagaagcagcctccagctgagtgtccaggaagtgagctattgttcacacagcacgttctaaacattttctgccagaaggaagccctttccctctggtttgtcccttcttttttttttttttttttttttttttaacaaaacaaacagaggaacctgggttttgattaacttgtttttaaggtagacttctgcttattttggaaccagatgaatgtgaatcatgagtgcagaccccttctaatctctataaactgaaatgagcaacagagtaggactgtctgggctgtttgcctggcatctgtgcttttataagatccacagacatttctcaatgtaagcaatccttacatctggccaagtgggttccagagtggaatctaaatgactcttaggctcaaccctattttttccaaggacttaactttacaatgctccttggtagtttctgctatggccccaggacaaggacaccaaagcttcccagtaacaggggcagacagacattgccttgggagaaggagcaatctcattttctgtgcttacagtagcaagaagcttgtcttcacctacaggatgggaaagaatgaatcacacaaggaccccatttcttttagacagtgcagagcttgctcaagtatcataataaatgaactcctcatcacagcttcccctgggaaccagacttcttgtacaatgtcccgcaactgtgaagcggccctgtgctgatatcttcatgttgttgtctttgaagaaaccgaggcttgaagaggggtcaagtagtttgctcgtggcggtgatcccatatatgaggaatttttccacacttaatggaagaggaaattgaagttaaatgacttaaggttctgcaactgattttaagaggatcttcagaattttttttattccaaagtcttggttcttttctccactgtgcaaaccccatttagtgtttcccagtcccgtgtatttgaaattgtgccctgagctttaatagagcagaagctaagccttaagtaagctggacagcatgagctagaaaaataatgagttgggcactggttctgtatttctagaactctgaccatgggtgttatttaacttctctaaatatttggtttcctcttctgtaaagtgggcagaatgagagctctaccctgggctgactgtcaggacgaagcaaaccactggcagtgtacttagtcaatgctcagagcagagtgcccccactgacagaacctggccctgggacctaacaaccctagaaggcccgagtggtaatgttgatcaaaagtattttccagggacgcctggatggttcagtggttaggcatctacctttgcggctcagggagtgatcctgggtccagggatcaagtcccacattgggctccctgcaaggagcctgcttctccctctatgtctctgcctctttctgtgtgtatctcatgaataaataaataaaatcttaaaaaaaaaaaaaaaaaaaaaacactttccaaaggataccttactgtgagcacccaaattcgattttcaggaaagacgacctcccgaagtaggaaagggatcatctagtaagtaagctctctacacaatccacccccgtttcccttgtcctgtcagtgttctgagggcggatttgatctcattttattgattcaggccatagaggatacaagtgcattctcttagctgagtattctaatgtactacttatcatgccgatgtaagtcaacgatggagggatcagggtctttttgagtcagattaatatgaaccagtttcccagggtttgctctcatccttgggaacactgataattgagctttcagactgtcaagactgaggttagcctgggttccagaatagagaaagccacaccacaacagagaagctatgctgagagcccttcaccctgaaagcctggtgacacggaataatggtaaagtcagctttcccacattcctttctgtttgtttcctttgcctgctgggcaatgtctctgcttattagcatgttgagtggagttcattacaaatgatgaaactcacatcagtgttgatcttaaaatttattgttttctaaaagatgtgatcctgaaagaaatatttttcccagtcttttattctgaaaatttttgaacttgcataaacttgaaagagactcaaatagtgaatacctgtatatccaccacccggagcctagattctacaattgcaatttactatacttgttttatctcacatcaacccatcccccagtccacttagaaattgcctattttttgatgcactttagagtaacttacagacgtcatacatttcacccctaaacagtttaaccatgtgtaccactaactagagtttgagagatacttgttcatagggtttggggggagaggcaactctaccattccctgagttttgatagatacctatctttgtgtggcccaaattcctaccaagatgcagaatattgccataaacccagaaagtccctcatgccccttcccaggtactccttaccactcccttacacccaacaactactcttctgaaatttttccatctccatagattagttctccctgttctagaactttataaatggaatcaatgcatgtgtgtgcttttgtgtaaggcttgttaaaaacaaaaccacaggcaggcccaaaatggcatccactgggccaggtcaccagactggggcttttttttttttttttttaattatttattcatgagagacagagacagagagagaggcagagacacacaggcagagggagaagcaggctccatgcagggagcctgacataggactcgatcccaggtctccaggatcacaccctgggctgagggcaggcgctaaaccgctgtgccacccaggctgcccatagactggggcttcattaacctaacctaattgcactttgaacctcctctagaaatgtactcttaatggatcagtctggaatttttctggtcagcaccaataagctaacctatgacattccccaaagaaagacaaggtaatctacctgtcaagaccctttggtcccccaaagaaggtgaccttacctgaaataatccttttttctgttttttgacttcctcgtcctgtctttaaaatcctttcccttcctgtagctctttggagctctcatctacttgctagatgggatgctgctcgattcatgaatcatttagtaaagccaattagacctttaaatttactcagttgaattttgttttttaacaggcttatctgaaggattttaactagtgctttaaaatgaattttgagaattctgtcaacttaatttatctaacttcttcctattttgtagcatcagagacagaaaaatctgcagatttgccgaaaatctagggcagctgatgggtattaaatatatatgaattaaatgtattaaatataatgtattaaatatatatgaattttttataaaatataaaaatataatatctagggcagctgatgggtattaaatatatatgaattaaatgtattaaatatagtgtattaaatatatatgaatttttttttttaacatcttaagtgtatgtcatttggtgcttccaagttttacatctgactcccctcatattatgagccagatgttcccctgcagaatctgaggagccggtggttgtaggatcctttcccgggccacactagggaggagaaatccattctgaatggaaatttagagtgttttccttgggctggtttaatcgatagccaggctgacagtacagcctgcatgcaatcatgaaattcgattatggaagaatgggagcaagggaaggttagttacttggtgatagtgaaagaaaaaccaaggaaggtcctcaaagctggttgcctggtatgtgagagaactgcagcgtctctgaggtgtgtgtacttcctcctcattcctccccactccctgaatataagcctcctcttgaatagaaagaagattagaatagaactcagatacataatcctcattaatctttcagattctcatcccacttattaaagccagtatttggcacataacccagagttatgtggtaagcaataataaagttaattggaatctaggtctcccaactttattcttctttcagcagcttcttggggccttttgagttaaagaatgcctgggtagcaggctgctctagaatgagaaggtcgttggcaaggcttgttggcccataaggtcttcctccctgtcaaagatgccaggtctggagtgtgctggaagaagtggagtgggagctactttggagggcaaggcccagtcagtatcccaagagatgtgtgaaaggtaggaatgaggaaggaagagagggtttggggactgaagtgcagtggggaagcaggagtgtctctggctttcccatctctaccagcctagcctggggcaagtgcacaccagctttaatgtgagatggtcagcaacacaagtataaaacacttctgaaacagaaccactctgtggtctcccagcctggtcaaaagtgagggattgagaaggaaggtaacaatgtaaaggggattcaagtggaagtgtgggtaggggtacaaccgtaaatacagcagcaatctgtgtgcccccctgagatgagacaattaaagcctccactaacaatgtgctctgcggaaaagaagtctcattgctagcggagctgccaccacaacctctgcctcctccctgcctcaaaaggcagccctgtctgttggcagacttttattcattccctgccctcttctctcctcccccatcctctcctgcctccctctcctaaaagcagttggcaaggttagaaaatcaggacaaataatttacttcaatccatctctgtctttcccgaggccgtgtgtaatttgctcaggggtggggcgagagggaaaagagtaacctcagaccctggtcagtgaccctttttcaaatgtggaatcaaagcccactctaggctgcaagtctgtctgctgctgagaggcaataagacagagatggtgatgaattcttatgtggtttctgggcccaggagtgcagctgtcagcaatctttagggctccttgcccagctggacgagtgagccagccgacttgcacgtcagcagtcacctgatggcatggacacagcagccagagagatggagatggttaaggctcagttccttagccctgtgctcctgggaatggggagcgctgtccaagcaaagccatctggccggaggagaaggcctgccccctaggtaccccagctcagggaactcgagctcaccgggggagcaggctcagccactgatggcacttagcagaagtgagagctgtggcatccatgaggagtttgggagtctgcccgcagagtaaagctccaattccctcacctgaaaaatgggataatacgtttgcttggcagtgagttgaggctctgcaggacttttgagggaaagggccagctggtagttggagggtgtgagattgctgtgccagcaacctggggaagttggagaaagagaaacatgaaggcagggaagttggagaatcgaggctggggtccagaagtgtcggctgcctctcccttcctactctaatagtgaggtgactagcctgacgtgggcatttaacagtgtagctgttctttgtcaccggccacctccagtgggccagctctctctgtgcatggccccatgtggaatctaaaagagacaatatacgggtccttaccattagtgattctatagtctatgtgtctctgggacacatcatagaacagttaatcagggaagtaacagtgcaaacaagagtgtattcctgagccaataatatattaaacattggggcacagaaggagaggtagaaggagtctccagctctggtggtacaggcccaaggggactagtacatattttccaactggtaggagagtcatagggagctgagaactacccaggcagcagaaagagggttgggagggaatgtctgacatcaggagccaaatgtggctggtgaatctcagaaacccctccctttgtgttcccatttgccccaaaggaagataggagaaaggtgattcctttccctttctcctctacattagccccaaacttatgggcatgttgaccagactaattgctctgtcctgatatttgactatggcacaaatgggagccccattgcttctaacttgtaccaccttccggaagggaggtttcacataggccttggcaccaagttgcaccaaggcttgtggtcctcctgtggacttcctgtgcctggagaagtatttctgtccccaacagctgtcttctccctcccctcactccaataaaaagagtagtataatctgacttgttcctggaagccagggcatagtgatagggtatggaggcctctttatctgtatatagaatatcacctcccattgccagcttttgagcacccaggatcctgtgttctaaacaagcacatgtcagcagacctgaacagcagtatctctagtgtttgttcttatttttcagccacatggggaatatgattatacatccctagtgggggtgggagggaagagtctgatcctgaatgcattctgaaatggaatatttccaagcatttttaaaatacatgtatccatcatggtgataaatttcaggcattaccttaccaaacacaaacaagttccctatagagcttatgtgaagtgcaatattaaagtgtggccattgtctatctctccgccaacataccagtaaagagaacattgaactgtgcctttccatgacattccacctgtctctttcttccttgagatgcagaacatttctgggaaaacagcctaatcagattggttttaaactcaagcctaaatggtgaaactacacaaagcatatagatcagaatggaatctcttttctgtgacagctcctctttgtctagactgaagtgaccatattctgtctctactggttctaggccatggagggtatggcagagacagaaaatgaggtgcagcttcttcctgtgtccccagcccagattgaggggctggataggatcacagccccagacagctcagtgcttctagtgtccgggtgggcatctgccagtctctgcccaaataggaccccttcactaccaatattcctcctaggcctgtgtctccaccaagacaggaaggggtgcttggttataaactgtcaataagttgctgagtactcctagttcctctataaactagaatcttctcagtttgacttagctactacagttcacaggacaacaaagcatagtgtacagtttcaatgaaacagttgtgagtgtccttgcatacccccaccagagggtaggctgtggaaacatgggctgtccctagccctttgtagttggtgtgagagtgactcctggggcaggcaggcaggaaggaacagagcaaagaagcagcagggtgttctgttcattgtgatttcaaaaggccctttggcaaaatctcatgaattgggccaggaggcattgattggttaggtctgcaggtgctttggatgtcaggtgattatgaggacaatgaaatatgtactgtaggtgacttgactttatatgaaaagctacttgggatcatcctctatttcaactctttctcccttgacactctgcatggccttgggaaaacagctttttcactactggctctaagtaagtggaaactccccccatcctacttgtttcattcattcagtaggttgcctatttaagaagagccaagccaagggagtaaaagggcaagtaaaacatgctttcttctaaccctcatggttcttgcagtggtgatcttcccacctataccctctttagcctgaaagagggatccatagcctggtggagccattccagggaaaaggacccatcatcccctctccactaccatgtaggaaaaagttttctcacctggaccaccatactttttttttttttttttaagatttatttatttatttgagagagagcacaagcaggcggggaggggcaaaggaaagagggaggggaagcaggctccctgtggagccagatttggagctcaatctctccagaccctgagatcatgacctgaaccgaaatctagagatctagagacggatacccaactgactgagccacccaagtgccctccgaggaccctaattttctcctataaatatagaaaagggcaaggaaggcacatcagcagatatctacagagtacctgctctttgcccagtgtggagggttctgtgatctgagtaacccaggcttttcagtgcagcctctgtgtgggggagcatcttggtctgtaaaactaaaagctgtctaccaatatccctaagccttccctgtgaaagaggaggtgctctaggggaataaccagaccagtgggttgaagttggataaaaaaaagtttgaatctgtaaaaagacagatgttacaaatttggcactttctgcaaataggacaaactgatgagagataacaagtgtcccatctctagaaggcccttagcaaaattagacatggagttggagttgagattatatgacttgtggggtccctgctgcaaattccagattttgtgcctggaagaactgtcaagagagaaattaggatttatcctacagatacccttacatgtgtttgttctacaaatgtgtatagaatagtcatggcactgttgagaatcgaaaagattggaaactacacatgtgcccaccaagggactggttaaataaatagccacacactggaagacataccttatccattaaaaaaaaaaaaaaaaaaaagatgttcttatgaaccgtggaaagaattccaatgtattattagagaacaagatgcagaacagcatatatagacatcctcttagtatgggagtagaatatctttatatgtttacttacatgtgactgcaacagtcatctggaagcatacttaagaaactagttataccagtttctgcagagaggagagctagacagctgggagataaagatagggaggtttttctctgaataacctttgtaccttttgaactttgaacatatagatgtaggacttgtcaaaacatacaagtaaaaacattttaaaaataacaaggtcttactagattagagttctgagaaaaacagaagggaagtggaaaacaaatgagccttttactgggtatctactaagccaggtctttggccagatgctacttttaatccatacaacaaccacttaccggaggcaagacccatgcctgtttttgtagatttaactgaggctgggaaagggtgaacatgctagcctgtccacatgggtggacattgcaccatgctgtccgttgaaggaagcagctcttgaaatgggggcaggggaggccaaagaaagtgatacagtaggaagggaaggaggagggcattatcttccagggacagggcagacctgctgtggtaccgcccatttctctgccagcctctgcactgtggggccagtaagcagaggcacacctccctgtgctccacaggtcagatgtgttgtgtttctcttggctcttgctgagctcagggatggagttcaccatgcctgtcaacaggccatcaggtgactgctgggtaggcagtcatttctgtggctggaggaaaacagcctcagctcccagctgcaaagggaacaacggtgcttgttctgtgctcttctgctaggtgtcaaatgtgccatctttatctgccagctggaggctggctggaaagttgttgggttttttgtttgtttgtttgtttgttgtgattgtcagacccaggctccttacttacacttgagggaaaaggcatccaagttctggtacaaaaggttctcgtttctttttttcttttttttttttttttttggaaaaaaagctacaaatgagctcattatcacagcaaacccaaaagagggggaggagaggaaaagaaggtggcctccttgttactgctgtgtcctgcccctggccagatttcctggagtggggggtcttggatctggctcagggtgaccaaagccagatggctggaacaggtggtccacacagggggcaatgccggagacattgtgtactttgagaccagctctctctgctgagatccagaggaaggatacgtgtctgtaccttcagggatcaaaaaatcatgcctacctccttttgacttctaagaggttcctgtgttcaggttctctgctggtcccagctctcaaaattgtcagacctcagagccagcagtcaggcaatatcagttatatgttgaatccttaggattttggcaggcactgctctaggcactgggggtgttgcacgagaccaagttggcgaagtctctactcatggaatttaagttctggtgtgaccagtgaaatgtgccaggtctggcctgctgttggccccagtgccctgtctctgctgggctgggggaactgctgcaaggaatgatacataaatgccttggaaggaagattctctggcatttccagcagctgagcacaggttgtttcccacttcctctctttggagcgtgtctttcacccccctgttaggctgtggtcacagaacagccttggtctgtgcggcagagttctgatcccttgcaggttggtgctggaccttggaattccctggaagagacctggagggcttccccaccctcccacccccgccccaggcgctgatggtgagctggcaatgtttaacctgaacctgacagcctctctttgttcctcttctgtttcagattgagaaaatcatgagctctattggagaaggaattgacttttctcaggaacagaagaagatctcaggtattgtaccaagcagccgttcttgccatgactcttttctggcttgggttttttcctctgactcagaagacagacatttggtgtgtgagagagaggtcagcctcagccccgaatcatgctcttgcagttcagaatctcatgtgtctatatggcctattgagctgttactttagggctatgacactttttacatactggaggggaaattgcatttttggcgggccttttaggaaagtttctctctctctctctctctctctttaaaggttgtcacttatccataattatttctgtaaatataggcttttttcaattggcccatattggagtgtacctcagcgttggtctctccagcttcccagacaggtctggcactagcccttcgtgagaaagtggctctcctttgcctgctccatggcagtggcagtgttgggttggatcagtgggctcagactgttagcctgtatcacccagagggagtggctttgccgctcctccttgtctttttcttcatttttacatttatttagtcattcatcatttttactccagatcactgctactctggacattgttttcttttcaaagccctatggggtgaggcctgcctcattttcctttgtttgaagcaggcagctagagaggccatatctgagctgttttctttgataatggaattgtggttgtgttattttctcgagtgaggtgacctttctaaaggtgcctcttagctagagcaaatctcacaccttatccttaagcatctgtagaccatcctgctgccagaacccctgctgagaacagcttcatggggcctggcctctccctatctttgaggaaatgcctctctaactgaagggatggtattccctgctcactcaggaggctgcatccaggattgacctgtgacccctctcattcctctggccgtgtcaggaagtctgaggggtggggacaagtatatcagtgcttgtggaaagagcatgggttacatacaggtcttgggcgagtcacttagtctccctaagcccccaattctctatcttcaacatttgaataagagtacctgcctcatggatttgttgggaatgagtactctatacaaatacttgagcagaagaggtaaacagtagatctgcttggtttttgtccatgaaataattacttaattgtactgaaaaacctaaaggagaggggcatctgctcccctggcttgtctccctctaccacttttccacctgggattcctggagcctcttccctccagcagccttctttccctggttcctagcaaagagggcccagctgggtttggtctgtctctgttggtcttggatcatgctggggtctgcagaggtggctctgctggctaagagtttgtggctctgtttccccatgctcaggcaaacaacctcacactctgttgtagcatgcgggctttatcaagagtcaagtgtttgttgggaatagatgttcagtactgagacaaacaccgttgcctgttttccaagctgtgctttgggggcagccaagaatggagtagatagcattcagttcagttgaagctgctttctgcttccctgtacccctgcatgtccaggactgcatgtgcttgcgagtttgggtcagagtaggccattacctctcaactttgataaatcaggagatggggcagcacctctgaaaaacacatttctggaagagcccctctcggagatggtgacactgagctctttccttgccccatgggtcccacccagcagttcttacccctgcaaacccatatgagtggtgagagctggtctggctacctgcctacatcattggatcccaaccagtggtcctgttttagcactgtggagttgagctatcctccatctagccccttaggagagtccagggcaagcacaaaagaacagctacctgaacagagggtgcgtccacccaagctgcagagtcctggcccactgtgtgtgtactgctaccaggccaggaagcatggagagagtagaactgtctgcccatgaactctgtcttctaccagatgagtcaggaagaggctttccccaggacctcagggagcattagccttcatctcagaccagagcagaattcttatttattttgaatggtcagtagcagggtccagattgtccttagatttctggatctagaagaggcctgggctctggggttgccagcctaggaagaagaggagcaggccttccagcaggaagccattaacaagcatagtattgctcagtgtgactggttttgcagaggacatgtcctgaaggatgagaccctaagaggaactggagtcttattcttgtcttgggccttgggaacctcagctgccagcaatggacctagttacccaaatccccaacagacaggtttcacaactcattctgctgtcaggagtcccaggaagggatgccttcctcctggcccaggccccctggctgctttcaacaaaagcttgtgtgtggagcagcagaagagatcacttgctttcttttgctaaagccagccttttagctgttgagtagccgttcaatgcaggctccttccggagcctgacctccctgcacacagagcccccttcttcgccagggccatctacagcctgttgagctgtaggtaccccccagcatgtttagaggtgacctatggtcccagggtctttgtttctacatgttcccttcgctgtcttcacagctgtacttgggctttggtcctttaccttggcacctcccctcccatgtcctcctctaggttgtgaggagcctgctctgggcctggtgcttctcccttgggctccgagaggccccaagagaagtctcttgccaagttgttgagtacgctcgctcacctgaggaatattaggtgtaacatctttatttcattgccgtttttgtgatgccccatggcttttcctcttggcagggaggcacactctttcttacatggtgagtggggtaggggggtcacttcacctgtgggctgtgccctcagggccgtgtcattcctctgtccccttctctggctgtcctagaagctaatggcccaaactgtaggaatgtgccttctgcccccgataagctgtttccagccccttgagctgcaggtagagtctcctccatctccgcctttcatacgcatgtgtgtcagccgacatgagatgctgaggaacctgtcattttgctctggtgcttgtgctgccgtgtccttctctcttggtggcggcagcagcagcttctgctccgatgtccgatccctgatgtattttcctgagcgtggaagggaggagggtgatggggaggggagagggggagggccagacattatgagagcgagcgagggctgtggggccggcagcaggcagcgtggagcccaggagcctccagacaaagcactctgctgccgttctgtgagggcacacatccaccggcagcaggaccacagctgcctggctgggggattacaagcaggaatgaatcagcagccggggacacttgacttcatagacacacaagagcctgccgcctaggttccctggagcagacagccccactcaagggcagggcacccagcgtctcggagggctgctgcagcgtgcatcgggaggccgccgggtcccagaccaccagctgttctgcagaggacagaggaaggggagcctaggacagtgggttgccaggggctcccagataaccaggccagttggccttggcccgcctcgaagggcagaaagtgccaggaacaacagaatgactttcaccgtgtcaagagttctctggaggtgatgttttcatagttggttcttctttttccttccttgctctttttcccttctttcatccgttcttacccaggagaactggagaagcaggtggggtttaggtgctcagcctaggtctgtagggagggctgaactcggttcctccccaccccaccacacgcccctgtccgccgtgagcagagcagatacatgtcgtcccttccccacttgccctcagaggagaacgtcaagatcaggagacccagggaggacagttgctgtctttatcactcagccgaacagaggacggcgccgaacgtgaatagacttaagctgccacagctcagctgacagaggactgcttccttttcccctttctttcatccgggctgggttttgtcatctttagccaaggactggattgcctgccggctttccacctgagcaggcaggcgagtcacaggagcagccactatcaggagaggaaaatgaatgcccagccccggcaaaagagcccggcccgggaaggcaacccttcagacagcgtcctggcgtgggagacgccccgctcgccagcagccagagtctagctggggactgggctcctggcctccgctggccacgcagcccaaaggagtgccatgtcaccgtcacagccgagccacacctgagcccaacccccgggcccctggcccatgcgccactcctggcccctctgccttgagcctctgagcacaaagggccggtggccatggtgtgcttattccgggactgctggggcaaaacaagtaaaagtctcttttctccccactgccgggttctgtgctgcttgcgttgcatgtgccgggtccctgtgaacgccgccgccaccgcttggccctcggagccctcgctgtgtgcctgtgcccctcagctgcatgaagatgtgtgtgctctcctgaccagtgtgtgctgccaggttgcaggacttgcccctcgcccacagccccacgggggctccagaagttgcatggatgagaggagcccctgagcccctctagtgcccgtgggaacagacttcctgaaatacctcagtgtgaacgctgacacggagtccccccgatctgtgggcagagaccgtgcatgtgccactgcggccctggagcagctcggacagagggggtgggtgtgtgtgcagcccaggctgtcctgcccttggcctgcacccggaagaggagctgcgggtcctctgctctctggtctcttatacatagtctggctgctttatggtaatgactatgatgtggcagtgccacctgtcttcctctgagtgccgctgctaccaccttaatggtttttcccttttcaagcgtctgccgattcctctctcgtcaggttcgcggacgctggagcagagcgttggggagtggctggaggcggtggggctgcagcagtatgagagcaagttgcttctgaatggctttgacgatgtccgcttcctggtaagtgcccagaggcctcctcaggggcggggtgcagccccgaggaaccctgcctctgatctccctgtgggcatgtgagaaacagtaggtagagttctctaaagtgactttcgacatctgggaagtcagcctgagtgtcttgtgccttctttctaaactctgttcccttcagctctgctccctgaaacagttctgtagtgagagctctttgccagtctgtgtctgaaggggtagggtccctgcctgcagactttttccctgcactggtccccttctcggctttcagacccagtgttgtgcggtgaggcctcaaggctgtcttgttctgggtcagaccctaggagtttgggagggcaagacagccaagtttcctgtgatgactccctgtcccatctttgttggataccagaagtttcctttatctggaagtttccttccagagtgctgttgtcaggcaggtagtcattgaagcaaggagccttgtccaacagaaaggcttcttccctgcctaccccacgccaagcatcagggctgggaaatgtggccatgaaacctcagggaatcataacctcagggatggcccagaggagaggctgaattagtggtttgaaggattggttgcttttccgaggtataattttgtactatctttttatacagcacaaggtgccaaagaaaaagaaaaatctaggtgcctttcctcaggttgcctgtgaagtacaggctggctgtgatcctgggcgtagaatccagtgctccttttttcggtccagaaagtagctcaggcagggtacccacgagcatccctctcctggaggccctccaggaaatggtaaagtaaaggagtcagggccagtcagcccagagctcctgtctccagtgtgggttcctgtgggcttcccactgatgggcttgcatttggtgcttcccaaatagcagcttgccccgagtgctagtctggggctgccgggagcaacgctgacaaggacagactcacctcacctgggccatctccatctccagggcagacagtaaagtttgcagcaaacaacccttccaaagccagctgacagccagttatttttcagcctttaaaattcttaggttcttaaatagcaattttttaaagttaaactggatatgtttatggttcttataacctaacccctgactcaccatgttcctgggggaaggctgacaaatccagcatagaggtggtggctcagccagtgagctgggcagttggttcctggtgctgagcactgaggaaccttccctctccgagcacgccctcttcaccagaccagctgtcagacaggcaagggaggggagctgtggacttcacagtgtcccttccttttgcttcaggattttagaggctgagctcttaacttctcaccccttctgctaattttggaaagggtaaggttcccaacccttgaacatcaagactccctttaaaaccgcttccctgcccctccccatgctcagacccagaaagtagctaggcgggcatcttggttaagtctggccctgaaccaaatgtccatgcaggatatagggcctctgttagaacggctctttcttttggggaaggatactcattgagggaggcaggtacctcagtctttccaggacccttctaggcccctcccattgccctgggtagagtctgttagtcctcactgctctctcatttcgggtggggtgctggcaggtggaatctgtgtaggaagaaatgctgattacacctcagttgaacatgttacttctgatacctagagtggcctaagtagccatgcaaagcatcctgggtaattgcatgtaaattgccagatgtactggaagactaattgttttagcaaccagaaaaagggtaaaaaatacacaagaaggggacatatttatttagaaacgttctcttggtacatatggtataatttccgtcgcattagctatggtatgtgcccatgtagttaggctttcggtagattgtaaatgtttttctcggttctgaaatgcccgggagactcttctacaagatacacaagtaactgccagggagccaggctctagatgttggtcatctggacatgaagagtgtttcacagacaaggtgttgctgtatcacttccctgtgacaagggtcccaatcagggtgggagggactttaccatcacatgttctaatcatctgtgcctttaacccttccagataatcttggctttggtgctttctagtgacacagaattcaccatcttacaaagtagtagcctctcattctttgcattgctcaggctgagccaagatctctttccttgtggtttctgtctcctggccccaggtttaccttttgggccaaatagaacacactgaagccctttagaaaattgaagactttctgtcctgtccccctgggtctggtcttgtctaggtccagcatcctcttactccaggctgttcctcctgtgatgtgaggactgagctgggcaaacattgtaccttgaactttattcacatcctcttgcctattggcagaaagcacctttgatttgcaggtgtcagggccagggcagcaggagctgccaagtgttcccgaggctgatccagctgatgcctaagagacagggccaggaatgtagctcccacctctgctggccagcccccaaccctgactcacacatcacagccagtccatttttcacaagtcctgcccataggaagggggctttcttaggagaagagtgaaagtgtattgtatcaacatggcaggaaggtaattggtggtggacgagtttgtggctcaatgcatgctgatgcaggaggtctccacatctggggactgaaactgacctccttcagagggtgatagttgaatcagggatggtgctccacgtgctggaatgtcatgtgggtgttaaaaacatgtttttgaagaacgtctgacgttcaccaaggggaaacgttcacctcggaatgttgagtgaagaaatcaagacacagaaatccatatgcgacacaatcttaatttccaaaaaagaaaacctctgcacgagaggtgcaagggtgtaagccaaaacattttcggtggttatctaaagaggattgtagttgacttcctctcttttttagaatgtaatagttgttctgcatttcctacaatgaatggatcagaagtcagaaaagcaaataatgcatgtgtctgaaggaacttgatggtctagctgggaaaacaagacacataaagcaattaaaaacaatagaccagctaggtgtcaagtgctgtggtgaggcatatagatgctgcaggagcacaggggaggagaacccaccttcccaagcatggaccgtgtgctgggtgctgagctggctcacaaccctgggcatactgttggtcgagtcttcagatggagctgtaaggtccagaggatgaaggcactgccagtaagtagcagggtcaagatgctagcccagatctgtccagctttgaacttctgggttgtgcttgctctgtgagagtttacagaggctgtgggacttggagggaccacacagaggaggggcgagtgtggggctgagcgacctgctgtgagtaaggagaccagtggagtgagtattgtgagggagggggccttggctaggcaggagaggtgggctgggctcgaccgtgagggactttgacagccacattacaggaggccctctggttacgccctcatcagatggagagcccccggagtccgggtgcaccttagatggcagggcacagtggagagcgggcactggtggatgcagcgctgggtggacaaatggaatgtggaaatgagtctgagccagctcaggatgggttagaaacagactgagccacaagcctgtcacctcgaacagcatcgtcagggaggcctctagctcctcctgtcaatttatttctccacaggtttctaccacgtgaagataggctcctactgttttcctgtctgtttctgagaccatggccagcttgttcctgtgcattggggagagatgactgacaaataggagtagtccccgaaagagctaaaaggcacaggctcagggaggaggtcattctttattgtttccagcctggtcctcagaccctggagcttctctttctgttctgtccctagattatctcctcactctttagccccggaagccagcattctgtgcatagtgaggccatgcccttgggttcctaccctggcttcctgtgctccttccctttgccttcttcctctcaggctccaaagggcctcttttggcctgggcagaagtgctatggcactgctgcctggacacctccctgccccgacttcctctccagctgcccagccctgtcttctccccacatagcactctaactgctggctgctgtgtcagaattttctgtgccccagtgtgaagcaggacccaagagggaaattttcctcaactagggacattggagggtccatagagctgggctttgaaagggatactgtcagtgtggctcctgcctcctggactaatttctgtgaccacttaactctggggtggcggaggcggtggtggtcaagggttgacacaccaccaaatgcttcctcatctctgctgggccctttaaccttgagacaaagcaggcttactctggggccctttccagaccaagcctcttgctcttcttcttcctttctctctgccagaccatgtggagttcttcggggttgaggtatcagctggcatccccagtaactccactctggctttgtcctgtcccctttacagtagaagaaattgagaactgttttcatggctgtgaaattaactaagtacactttaagatggattcggactgttccgtggcttctgattgctaacacctcaatgtgaacagcaacagggggttctgtgttggtgtctcagactgtccgagtgtttatgtattccagtctgtaccatgtgcatgtgcagaaagtgaagccagcgaggcagggcccagggacccatatgtctctatcggaggcacagacctcctcacacaccaagtgtcaggtaaaatccaggtgttcactggcatccctgaagcccgtcagcagactcttggggtccatagactcccactgaggactcttggattaagtcatttgcccaaggttactcctcaaacagatggctgagcgtaactagaagttctccgggacccagagccgtctcccactgaccactctagtctccacacctcctttcccaggaacatgctatgcctgggccttgtgctccagtgtatcgcctcaaagaaggggcctggtgtgtgagccagtgagctaggctagtgctactgccatcccttgcaggtgccaatctgagtcaggcagaccattccatctatctactgtgtgttgggggccactcccaagaaggctgggaaaaggagcccatgggaatcagatcccagtaagctcttggccttggctaggggccccacagaagccctttggctctgcagctcccaccagcacaggtcagtgatggtaggtgcccctgctttgcattctcagcgaaggtcagcagctggctgaggccacagttaaattgaactggggggagaaagcctcaaaggaaaagttgaggttctacttacttgtaagagaaccagactaggagtcaggaaatttgagttttcctctaggcacccccataagattttggacaggttgttcagctgccctgttaatcccatcccatggcatctcatttgactgcttattttaggggggcattagctcttgcaggggacatactgttccctgtggtgatgcagaatagccactgagaccaaccatgaccatactagcataaggcagtaaggtggcatgttctttgcaatggagggcagatagcagttgttctctgcaggatgcagattggctttgtcctcagatgcatggtgtaaagcttgctttgaggcggtcttggaacttgagccctttgactccagattgccttgggcctagctaacttccactgttgatttggggggcagggtgaatacagcaccttaacctctactaaggcttcaaaaaggcagatgttcggaggtaatgggtagcagatggatggcaggatgctgtgcctggtatgaagagaatggggatgccaagacctgaccaggaaagcaagggtcatgaaggggtgttgtttccacgaaattgggaggtgaggcccaacagaggtgctgttgttggcacccatcctcaggagccctttgaagattgacgggtggagagggcctctggcttcggaaacagaactggtaatgtttgtgcttcttcctcctcttctatgaaactgcacttgtcaccatcaagctctctctccaggtgaggacaggtctgtgctgcagcggggtaggggatcactaggagagcagggagtgtggggttgagataagctgctcttgctgctcagggcactgagctgagggaaggtgtcagttcgggaagttctgtgacacagcccccgggaggcacagattggctgggccagactgcagtgaacagagaaacacaagacgactccttgagcacctggctcctgccagcaggtccatgctcagggctatgggaaagaagcagctctgtgaactgaatatggcagggacggggctatgtgacctcaggcaagttagtcctttgctggacctcagctttcttgtgactaaacaggatagcttccctctgccctgagcaggaccagctaactccctggcatagcccccgagcccaggcccacatccccgcttccactgcccggaacttgtcactgccctcaacttgtcactgccctcaacttgtcactgccctcaagaatggtggcttctgtcacagctacctgtgcttgtgctgtgccctcagctggggaggctcatgacccacttctctgccctcttcccacctccatgtcaaactcccccctggacccggccaccaccctgcccccgaggcctgcacatccctgaggctccccttccccaccccagcacatccccacctctcccagtcctcatccttgtccctcacagaggtctccaaaaggtcacaattgtaaagtcagcagcacttattttgactattcagactcttctttttatatctgtggtgtcccctccaaccataagttcccttggtcactcaacatttttattgcatacggacaacataccaggcattgctctagatgtaggtgacaaagctatgagtgaaacaggcagaggtctctggcctctaacagccttggaaccctctcagcaagcctctcagcctcttttccctttggctgagaagggtccaccccaatgtgccacattcccaaatgttcgttcttaggcctttctgctattttttgaagacatgcccaacagttaaagaaatttccagcaaaatatcaacaagtgagatacctctcaagacacaaaagaatgtttccttctgctaaaattatatggtcaggaagactctgaagataaccagagccctggagggccagggaaacctagggagaaagggctgtgggtcctgcaacagcccttccctccacctctgccaggactctcctctggactcccagaggcatttcttgctgtccatgctccttccctggcccctggctgcaggtatctctgttcccctctccacatatccactgagctatatgcccaggctctgggccttggaatccccactcggcaccaacaagccccgtttgagataactttctgtgcccacactggtgaagcccaatgacggatactggcaggaaggagaaaccattcaaatggaaagtaaaattaattacagctgcgacagcaggcacaatttctcatttatacattctcaaggaaggacacccagatgctgtgtggtggtgtgagtcagtccactgagcaggttcaagctgtcctgcatgagctctgacgggtcagcctctccctgagtcagcctgctctaggcccctagatgctgaaggccctgggcccggtgcttgggctgcatataccaaggcctgggccatgtcctgaccctgcttctccctcactgtgaggccatggccagccctcccctcacccacctccagaggtccacgcagtgctaagagttgggattctgtatcggtaaagaagtaatcactgcccctgccccagaggtggagagcaggtgggtgagagggaggttctgcggtagggacattagtgctagagcccaagtgcgccccggccctaggatggattccctgctctggttctctggctgctgctccctgcaccttccacactctgctttgtctacaacagaccccacctaagcaagaagaaagagcctggaacacgactttagggtttgtcagatagaggtttaactgtccctttgtcactgaaaagctctgtgaccttggataagccacttctctttgagcctcagtttctttgtataattgggcagttcctatttcaaaggtttgttgacagagctttttttcaagtgatgaatgcacagtccttgcacagtgtcaggatgtagtcaggacccgtggtcacaggcactttgtgtgtcacctcccccacaaagaccagcagacggtgcccggggaactcttgtgaccctgaggactaatgcttgctgtgcttttccttagatgtctagagagcaggtgtggccaagatggcaggatcctggcaccaccactggccgtgaagcctggttcctggcctgtaaagggaggaacagggtaaacacctgccaggttgtgagcacggagtgacaggacagtgaatggctgaagcagagtctggaatgaggaggccctgacactctgtcccacctctgtcctccttccttggaactgaacccagccaggcagagtgtcaactagttatgggtttcagatttctcttagactaagaagccttttttttttttaatctaagaaataacctctattcactgaaatgcttaggtcaatgagctgttctactttcttagctccctaattaggaactcagcgcagtgcctggttcatagtagcccttggttataaacattcgtggtagaaggtgaaatagaaattctagtctctaccccatagccctcctcaggaagatgcttctgaaaggcaggggcccctttctccctttagtaaagaggtgtggaaacttctagaatgtttctggcctttgaagatttggagcaccttagagtccccccataaactaatccaggaggatgtcaatgtggcatgtgcaggaaatcaggagaccctgcctgcccccaggatgagcttggcaactgcccactttgattttctgtcacatcctttgtttttattttgtttccctctgtctgtgtctcctcaaagccacatgcagcccccgggcctcctgactgggtaatgaaggccctgtctccagctggatttgggcttcctggttgtcttcaattcagcattaatgttgcctgaaaagcttgtgaggggttgggagtaaatgttggagcttcagcaggacttcagaaacttcctgaactgcactgttctgtgcaggaactgaactcaccagtgtcctcatcatcaggcagagagtctgtgcgggtagctgcctctctctgcctttcccatcagcacacgctaaacctgggcccagagggactacaggaactctgggtgctgactcctgggcttggggtgactaaggagctgccctcacctggggtggtgccctttcacaggggcctttccgtaggcccaggcctccctgatgtccctgcaaaggagtgtgttctatctgcaggctgagcagagggagcttccagcctggcttcaaagctccctccacctgggctcccttgagcttaacgcttggaaggtatcctctgtggggcaaaggttttgtcaccatgcacaggctccggggaggctaccgcagtggcattcagtgtagctcaggtacaaaggtgaggccaccaggtgatggtctctgtgagctgccatgagtcactcaacctcttttatctgtaaagtgggcatagaaatactcacatcagtagaataggtagtccagaaagaatctcagaaacacaggaattgaggaaacatcagaggtcatctcagattggtagggaaaagatagctccttcaagaaatggacaacttgggatgcctgggtggctcagcagtttagcaccaccttcaacccaggaagtgatcctggagaccagggatcaagtcccacgtcgggctccctgcatggagcctgcttctccctctgcctatgtctctgcctctctctctctctctgtgtatctctcatgaataagtaaataaaaatctttttaaaaatccagatagattaaagatttagttttaaaaaaatgaaattaaaactacagcaagaaaatatgcaagaattgtttttataaatcttggagaggggaagagaagagttctttctaagtctgatagcactgagggaagctctacaaggtacaggtacagaccaataacatttctgcacaaataaagccaacatgaaagtcatgttgaaaaacaaatgtcttataaatgtttcttattcatagataaaaggcattaattttctttataaagaatttctccaaatccaatacagaaaagatcagcacctccagagataaacacacaaaggctatcagggggtcattcctggaaaaggagctacggatgctcccacacgtgtggtcctagagcatctggacaggagcccctggccgaatcctggctccatgcttacatatgtgacccccacaaggtcttcatgttctctgggcctcaacttcctgagcataaagtggaggtaaccacagtccactttattaagtgggttagcaagcatcaagaatgtggagtgggatagtaattgttatgtaaatgcttgattgataaaacctggagagatgccatggtgcccctatgagtaggacgctcttacgataagaaataagcagtgatgagccatttctccgccatgctgctgacagtgcaaggaatctagcacccatatcactgatgggagtatagatacgtgttagacttctaaatacgctgtgaccaagcagtctcttggataaccatccttgagatgacgcacatatggaagtattcctacaatactacttgtaaaagctaaaattggaaatagtcctccttcagtggggaactggttaaatactttataatatcaatatgcttctaatctcaatgattatgcagcttggaaaaaaggggcaagtttacctgtactgatagggagcaatctcctgtgtccaggcttaccttgttttattgcactttgctttattgtactttgaagataccgcatttttttgtttgtttgtttgtttgcaaattgaaggtttgtggtaactctgtgtcaatcaagtctgtgggcaccatttttccaacagcatttgttcatttagtgtctgtcatattttggtgattcttgcaatattctaaatttttttattattttttacgatgatctgtgattataactcactgaaagtttagatggtggttagcattttttagaagcattttacaattaaggtatgtttataatttttaaagacataattgctattgcatactcaatggactgcagtattgtatgagatagaaaccaaaaatttcatttgactcattttattgcaatattcacccaactcataatatctccaaggcatgcctgtgtattaagtagtaagaataaggtgtcaaacaacatgtacaagaattccattcgtgggaaagggaagctggctccgaagggacattcgagaaagcaatcagttgcttctgggggcatgctggggctgaaagcggaatggaacctgtgagttttcgtggatcataatctgataaaacctacaaggcaacactactgtgaggggtgtaacatcctcctagaggccggagacagggagcagccaggtcttagctccaccacgagatgcgtggcctcagtacgttcctgacctttgtgcctctttttcctcatccgcaaaataaggatgcagacaacccccaaggtcatgagtgtgaaatggggtaatccgagtcaaagcactggggccctgtgagcaccagccctcctcctccccatcacgttcagtggcccagccctagcattccccagttccctggccagccagacgcctttttctaagggctccgctttgaggctccctgcctccctgggataagtctggttcctaggctgcccatctgacttggctgctacagccttcccttcaagttaggaaagcatgtctgtgaggaagctctcagatgcttgtgaacctgaggcacatgcactcagggtgagccagggcacactgtgccccccaaggccccatcagcactggcacgcagcactgcagagctcacctgggggctgctcaggcaggagtgggctgtctgggcagacttgtctgctgcttgccgcaccccctacctgcacaagacttctcgttgcctggtctggcctctgtgggttgctggggtctgcattcctcttagtgcctttggggaaggaggagaatttggttaaggggccacaggaagctgccactaggcttgcatccgttcggcagggtgcttacgttaatctcttctgcttgcaggggtctaacgtgatggaggagcaagacctgcgggatattggcatcactgacccccagcaccggcgaaagcttctccaggcagcaaagtccctgcccaaggtgactggcagctctgtagcctcagcctgggttggagccgggtcccctccctgatgccccctggacccagaagagggaaagtgctcagctccagggcatacagattactgcaaggtgtctgccctgcatcctgggggacccagcaggcagcatagaggcctgtttgccttgttgcccagtcttaaggccccagaaaggcagcagagactagggacagttgactcagtccagggtccggagggaggctccaggcttctgcccagcacaggagctggtacccacaggcttgacctgtcacctggagcctctttgggttctttcctgactttgaagaccaggccagcctgcatctgacccccaacatcacactttcctcaggaaggcagagggatgctcagggcagcagacgaggcagtttttccctggagagccaggggccagtaggcccacaggtctctcccttgacctcactggtgctaataagtccagtgtacccttgttcgttccactcaccccaagcttgggaagtacaaacaagtcccaccagtgagcccagtacccacttcacaggtgccaccaagtctgtgaccttgccagagctcagtgagagcccttctgcaaacccttcctccccgctagccataccctctagggctgtctgccccaggctggtgtgctctcagagccctgcctctcagataggggagccgaaaccagagcagcagaagaaggggctgtgtgaagggaggggcccctgggcttttgtcccatgagggctgtgatgtcagtccttccaccccttctcggcacataggtgaaagctctgggctatgatggcaacagccccccatcagtgccctcctggctggactccctggggctgcaggactatgtgcactccttcctgtcgagtggctacagctctattgatactgtgaagaacctctgggaactggagcttgtcaacgtgagtgtagcctgtgcttgggcctggcctggccccccaagggtgcagactgggggtgggagaggagctgtgggtgcaggcacaacatgacccttcctcccacccccgtccaggtcctgaaggtgcacctccttggccatcgcaagcgcatcatcgcctcgctcgcagacaggccctatgaggaaccaccccagaagcccccacggttttcccagctgagggtgagtcggagagggatggaaagggagagatgtgtgttcttcgtattgctaggaattaaaaataattcttgaggaattctttggagacagtgtgacctccatagaagaggtgcgaacaatctgatacctcttgtcactggggccagtctgtccccggtgcacatcttgagaggagcatggggcaggagttgttaagacttgattatttatcaattacgtgcctcctatctccatcggagaagtctggcggggcctatgataaagcgtcaagttgaaatataagtagaaactaaaatgttagaaaaagtaggaaaacaaatatccaaatcccagctgttaggcatgagtggcagttcaggtgaggggcaggaggacccccttccagatagtctgacatgaacccgagaccaagctggaaatctatgacaggacttgtatcctccccaggtcctctgaagtaaaatccctgcagtggggtggactagagaagcagcgactttaaaaacctcacagatgctttgttgctcaagccagataatccctgactgcaggttagagtcagggccccacggaggtctgggactatatctgttcttgagccagagtgcccgacaggtgctgcacctccacccattcccggcagcctcacccagtgggtgtcatcttatcccccttgtacacaggagcccggtctgaggagcaaatgcagggctggtattcagttataaaagctgaggagacaggacctcagggtgctgacagcgctgtgtgttttctcaaggaaatgctttgcatttggtcgtgtgccccaggaagctgcagtgaattatgacagatgattctatctttgatgaatataaaagcagcttcccctacggctccaggccgaggagtgtgctggtaaagtgagggtgccatggtgactgtgtgcccgcaggactgggacgccagggcctcctggcaggtcagagctggttgctttgactgtacctgggctgggcccaggggccaggctccccacaggtctgtgggccagcgtgccatctatttggtgcccactggtgtcggtccttagcttcaccccaattctcactgatacacctgcccctcttgggccctaagtagccccagcactggctgacatctacaatttagagactggctgaacgggttccaagttttacctggatttctccccaccacagtgccaagatttgctctcccagacatcgtccccactgagccaaaatgactcctgcactggccgttctgctgacctgctgctgcctcctggggacacaggcaagaggaggcatgacagtcttcatgaccctgcagcaccttcccgagcagagcgcttcagagtccaggtggggcaggcggggagctgtgaacgggggtccccagaccaggccagagcccccagaacccttcactgtccttgtgtcccctgaggcagaccctgagtgggagaaggggggataggaggccactatgatccaggtgccaggatcagcagcaggaggaagccaccgcctcctctcctcagccccacccagcctgtgtctggcatccagccccaagactcccagggctataacaacatgactgtcatcagctgtcactgcatgtggccacagaagttcagatccactgtctgttctttgactacagcctctaccttccagcccctcaggccaccagtcccatttctgccccactctcagctgcttcttggtccccagttgcttgccctcctattccccagagcagctttctcccctccacagctccacaccctgtaccccacctgcccagcaaaatcacagcccaggttagactccgttcttcctgctgcgtttctgcaggaagggtcaggtgcaacagggaggcacatctagctgtgccatctcccctcacagaagcccctcaacccctattgtgccctgcagcccttgccctaggccggccccggcccacagtcctggttcacccgcacggggccttgcattcgggctcctggttgtatttccctgcccttcctcctgccctacacatggatcccgggctttgtctcttgtcccccatcttgccagctggacacaggattggcacctgtccctcacacccaccccattcactgctttttcctcttgactcatactcctcctctccagtacctggggatgtccttcacctttgtacagtcacagctgtgaatttgacaagatttgaaaaagcatgttttccaggagtttcagttgttccatatcagacttctgcacagtgccaggaacagaaatcataaatatttcctcttttcccgcctccccattctttgtatcctagttagggcacccgtcagctggcacctgcatttcggtggcttcctgccccttcctctgcaccaggttccacctcaggagacaatataaaatgcctccctagcactggacacttgcccatcccagaatcagatccagaggccctgacttggaggtggggcttccagggatctggaatccttcctgctttgtacttattttcccctctttggttttagtcatttcctatctctacctcagagccttccccacagagcctgccttcaggtggcttaggtccctgcctctccacctttcccctccgccacagtgcatctgcttggcttgtctcccgccctcccccactacccttgaacccccgtggctggctcctgtgccctcaagtgtgctggagcccgcagagcacccaggagttcctctggagggggtaggcagatctgtgaccccacccgttgtacaggaagagcagcgcgaagccaaactgacccttcggccccccagcctggctgcgccttacgccccagtgcagagttggcaacaccagccagagaaactcatcttcgagtcctgcggttacgaagccaatgtgagttgcccgtgccctcccggcctggccagactccctgctgcctgcccctggggccaggtccagggctccagtgctgttctctgctccccagacaccccagcacctgggggacgggggcctcccagccaggctaggggaaggaggttgggagagggaaccgtctgactgtggtcccagcctggctactgccctgctccctcagtatctgggctccatgctgatcaaagatctccgagggacagaatccacacaggatgcctgtgccaagatgcgggtaggttgtctgtgtgtgtggtggatgggggctggcagggctgggaggcttcgctaggggcacctgctgcagcctcttggcccttacacattatgtgaggtttggggggaggctggggcctaggggccccgaggggcgtggccttgagaagggacattcacaggcccactcctcgtttcctgtagaaatccaccgagcacatgaagaagatccccactatcatcctgtccatcacatacaaaggtgtcaagttcatcgatgcctccaacaaggtgcgcttctcacagcactgtcggtgggaggggatccctctccctaccctcagtgcccagcccccggcagctgggcatcctgcctagtgtgttcccagccctttgtcttcctctgtattcctactgccttgcccaggtgcctgcctctcagctgccacacgtcctgatcctggggccctgcccaagtgacaggtgcccctggtcttcctcagcgtgggttcctcttacctgttcacacctagcgatgtgattctcttaaggagcaaaggactccctccatgctccacacctggtaccccacccacctgatgccctccccaccttgccccaaccctggagagctggtggtcacatgtgaacgttttacccctcggttgctgtggtccagggtggagacccctaaacctaaattgggcaaggttagacaccacccccaccaccaccagacagactgataagagaagtcgtggcattgggctaacagcctgggctggaacaaagaaaaggtggtggtgcagaaggctcgaggtgtgcctcgggccgaggattccagaccccactttccctggcagaatgttattgcggagcacgagatccggaacatttcctgtgcggcccaggacccagaggacctctgtacctttgcctacatcaccaaggacctgcagaccagccaccactattgccatgttttcagcacagtggacgtggtgggtggcgacccgcagccagggggggcctcagggccgtgctgtctcagcacgcgggtggcactgggccagcatctggttcagggtgaggtcccagcggccatctgggctaggcccctgtagacagtgatggaactgaagcacagaggtggagggtggctcacctggggttctagggacaggttttccccgcttccagccaggggtctcctccctgcagctgcatgtccactcgccaccccatcccccaaccctgcaggggccggttccctgaagtgccctggagcttcctctggggggcagcagtgccctcctgacagccggcttccttttcacagtggtgctgagaggggggcctccccccaggcccctctccagagctctgccatccttcgggagaatagctagttcccaaatctctggcttctggaacacagctggccaggcattctcagccccaggaagtccatgcttgctccagcctggcatcagacacctggctctgccacttgctagctgtgtggtcttagaattgggctctgcgtctgaaaaggggctataatgtgagcaatttcatggggtttgttctgaaggtaaagggggtcctctacccatacttgtagttcctgccacttttacccagagctcacatttcccagtcatttctgctgtaacacagtacacacgctcctgaagatcaaaggctacagctcacctagtaaaaagcagggtttgtggggagacagggctgggggcacaacactcagaaacttcgtcagtggcacattagaacaggaacctaataaaaacaccggccctgctctgttcacatctgctggttgagaagtccatagctgctccggtcagcaaccccccgcgcccctgaccaccaccaccagcctgtgctcagggccgtgaggctgggctgggggtctgggcaaaggggtccgtctggtggctcctcgaccttggtgctgaagctgggctctgtctcctcccagaacctgacctacgagatcatcctgacgctggggcaggcgtttgaggtggcctaccagctggccctgcaggcccaaaagtcccggccgctaggggcctccgctgccgagacgattgaaacaaaatcttccaagccggtgcctaagcctcgggttggcacgaggaagtcagcagtacgtggacccagacccctaccccccaccccagcgggctctgggggcttggggtggagcgggcaccaggaggggcttctcacgcagcagccagcacctcccccatgagcccccactgtcccccacgggcttccatcccctccctcgccgggcacccctggtaacaccaccccgtgtctgtgtctgctttgctctgcaccccaggtgccgctgccccccgatagtcgctgttgtcactgtcacacctgcaccacccatcgtccttcctacctaccgctgccgtctgttagtcccggagtcaaggtctttacacctcctgctgtctgtgtgtcagtctccccgaagtgactgtgagcttcctgagatgctagtgcctctcttccctgagctgccctcctgctgtccctgcatctgcttcagctgtctgtctgtgtgtcctcactgcacaggcctacccggggtgcgccctcagcctggcccaggaaaccggaggcttggtgttttcctgcctccatgaataggtctggggctcagagcatgaggctctttacctgagcagctctgagaagttgcccctgagaggcctagaggtagccctcctgtgaagctccgggagggtgccactcctgccaccccagccctagggagcttgctcttcaaggagaacggaggctgcccctcatgtgccctgtgctggcatgacatcagcatggccccggcaggaggaagggacagctgggccctggcccaccctggcccggcccggcccagcccggcgctccctctctgaccccttgccctccttcttggcagctggaaccgcccgacctggacccggacacccagtcccatgccagcgtctcctgggttgtggaccctaagccagactctaagcggagcctcagcaccaagtatgagaccactatcttctaactgctcgctccctgtctccactagtctcactgtgccttgccatccgacctctactcttctcagctctccttccggctgctgacaccaaggccgcagtcctggggggacctgctctcctcccgggcggcagctctagacactctccactcacagcttgtacccaacaccaccggacactgtgaagtcccccctgggcaagaacagcttggcggggaggggggtgagttgccccagaagtgggcgccccgagggctgagggtgccctggtgtgcccaggaggcctcagcgggaaggtgctgtgagtcctgaggggtgggcagtcttcaagcagcatccagacagcgccagtgaccactccctctgagcaggcgggcctgtgtgctcccctctcccgtcttctgtgccgagccgtggctggctgccgctgcccagagaaaactgtctttttgcacctttcctgacacaaccaaccactgtgaccactggtgccagaaccccttgcactctgctcacgctggcctgcggccctgtccctctgtcctctgctgtatggtgctggcctccccacaggagagcccgagctcagcggtgtggcctgactggggtccgactgcgttctgtgaggggcccaagggcctcgggcacatgcctgactccacagcctggagctctgcgcatctggaccccgcgggctggcttccctcagcagggctcctgtcccgctgggccttccgctccgaggaatgggacggcaggtgtgcggtcggcccctcaggtcttcgccagcgagtcacgaggaggctggctccggggcccagctcgccaaggggcaggcccttccgtaggccccggccagagggaggcctgtcccagcacacacggtctgccttcttccctcccagaacggagccgctcgaggacagggagcccattgccctctgggggctgacacctgtccacggtgtggggtcagagctaggcagccaccacccactccttccccggttggccaccctcggccccctgcgtcccctgagaggggaggccgtacgggctgcccagctgggatggtggagctgaggcttttgaagaagccacagtcgcccctaagggcagatcagctcagaggcaggaaccgggagcaacggttccgggaggaagcgtagaccagtagagaagccgggcagctccagcagcgagttcagagcagaagccccaggtgatgaagcagagagggtgtcctgtctgcccgcctgtcctggggcctcccgcgcagaggccgcagtgggcgctgggcgctcgggggaggctgtgcgggacggtcaggctgcttccacgtttcccttcagtttcctccaccctgtgcaggcccccacggttaaccctttcctccccccattgtgtttgcttctgccaagctgagccactgaggagccaaccgtgctgcggagacacagacgtggggagcacaggctcccgccgctgccaccgccgccaccactactgtgtcacctgcagctttgaagacccaggcccagcctctacctgtcgcagccccttggggctgcttggcctggacctgccaccaccaggtcttacagagcaagccgcactccaggcctcgagcagacgagactgaactccagagagtcaagaagtgacttgtccagaagacattttttaatagaaaacaacttttctataaaatgaatttttaagacttggctcaaacctccaggttaaactgccaacctttagacaggcggccatcggatcagagggcaggggacccaagcatggctataaggccagtctgagaagccttctgtcctaggacaggatgttggcgtgttccaggaaggcgccggcctctgggtgcactgaaagcaggcacgagtgggcaaaatcgagcgggtttgttcgagtctacctttcaaacccaaccacgtctgtcgctgttccttacgagctgcgcaacttcccgtgcccgtccggagctggataccgcctctgcggtaagaacacagccgcagagacacgtggcaaagcaaaggctcccggcccatttcaggggttccaaatgtgcaggccccgaggccagagctgagggagcagttcctggtgccacaaagtctgagccggcaccagagccctgggccacccctgggtgcctgccctgctggcggccaggcacttgcccatgctgcccggcagcctcgggtcgcccgagttcagtcagaaagtagaaaagcagctttgtttcgggcattaacaggtaggtcgctaagactgctacctgccaatctgtgatttgtctgatcaggtctgtgtgattaggactcactttgattctctgaattattggtttgactgttgtatttcagctgctggattcatccctggctccaagtgtagagaaggctaaataaggtgacagttgattcgagtctcccccagtgtggccttcggggtgggctggggtcctggtgcaccactgccaccacccttctgctgccttgcttggttttttaactgggaatcttgctctgtactcctgaagttggtagaggcaaccggggtcattcccgtgaggccaaggggcagaggcggctcagctgcttgtctggtaccttccagagtagggaacagaggggagcccttcctcctgtgggtaattgagcagtcctcttgctttactggcatggggcacgctgctccctgggcccacatcctcagcttcgtgggacttctttcccagcaaaggctgtgaattgaccttccctgtgggttctgtgcagggagagtgctcttaggcgcactcacaacccctgcgattggccagacatggaaagcctggcccccgccaacttgaggctggaccccaggggtggcacccccctctctgggcaagggtaggggaccctccactctccggtactaaacaaggacctcaatgcctgcgcatcacttcgcttcctgcttctctcaaggcccgtgagcctgccatcagctgccaccatgcggtgctggcacagttccctcccccctgcaagaggcctggccccggctacatgcacctctctggaggcggcaggtccaaacagcaaactgtagacactacgatgagctgctcgagctgtctttttgtttttaaatcatatgtaggtgtttcctccccttgaagctgctatatatttattcagggtgtttttgtattggaaagccttggctagtggctctggctctgggtttgcttttgagattggtttatttctgaatagtcaagcagggtaggaactggatctttctttcctctttacttctcctctggggcaggtactccctattccctagacagcagtggtgtgactccaaggacaggcttcaggtagaaaagcctcggcttctgcacctgtcggagttccgagcgggctccgagctgtgcaaggccccttctaggcggacttcaggggacccagtgtcttcaccagccacaggttctccgcttgcccctctcctgctttcgtaggacccttcccgctgctccacattcacagtgccccacatccccctggtctctagcaccacgttctagcaggagttccccgagaagcctcgggctgcataggcagcaaacacggctgcaatcggtcccacacgagagagttagcctgatccgggcccactcctgagatgcctgggcctgcgggaggctggtcaggtgcggttcacaacagtgttgttgcttgctaatggggtggcaatgggactgaattgtaataaaactgttatttaatctttgtctctgtattttgatacttgaatgaattccccttttattttactgtacatataattgttagtctgattttgtccgatttacgaacatcttgtggtaccaaacatacccactctgtgcaacgacatagactgacctcactacacaggagagagtgtaaatattcctgggcttccggctttggttttgttattttcataactgtacaacttagaacgattaataataaatgagaagcaacacgaaatcagccttcctttttgggagttcttgaattagcttcttggcagttttctggcagaagcacaggcacaggctgtacgctggctccagctcactgatgagcatccgcactgtctggggtaagtgtggggacctgctctgtccagcacgcttccaggggggaagctgccaaggctcgtccgttcccgttcactcttttagctgtaaggcccctgtgggtccccttctcctccttagaacatctcatgtgaatcccaagcaggggccatatgctggttatggctgtggctcctctgcgtcctggtctgggctcctggacccacaaatatgtatcaaatgtctgcttccaaggccagggtggaggattgacagctgtggaagaagagtgtccccctcaaggaacttcatccaattgtggagattcagtttgacacacgtacaactagctactggcccaaagccacaccgtgaggccacgatgtatggtcctgtgagcacccacaagggcaggagtgctcccggagctgggggcggggtgggagggggcaggggaggaggggcaggcacctgagctggtatttaaaggcaagggtttagaaaggcacagatgatatgactaaccccccccacggtgccccaaaccccaaagatgggagctttgcaggcacccatcttgttctgacaactttctgggtgtgatctctatagagtaagcaacagaggctcggaaagtcccgcaccttcccagggccagctggcttcacgcgtcctcagagcccctcgccccatgctggcttccacccaagctgcccagcactgaacacttaggaggacggactgactagagtgagagactcgggggaagggcagagggagagggagagactctcgagtagaccctgcactgagcacagtgccagacatggggcttggggtttgatctcaggaccctgagaccatgaccagagccaaaaccaagagttggatgcttaacagactgagccacccaggcactgagcgcttataagtttctgtgaaatactgtcaagggctttaaaagcaaaaatcactgatttaatctaatatcccgttgtatatttatgaagaaaacaaggcccagagcagggaaatctccttcccagccagccagctaatggagaggcgaccagtcctagccgctgaggccaggtcgcactgccatcaggcagacggaagcctggccgtggacggccccacctggctttccagcccaggcagttcaccgcccccgcacccccacacacacccgtgctctcgggccttggcgctcttccctacgcaaaagaaaccctacagctaggagagaaaggtctggtcataatcggggtccctgttgctctgggggacagggctgcaggatgtgttccatccccttggcaccattcagaagcctcacagctgtgactcgggccgcccaggccgagcactgcggggctcatcgtgcctcgggagcctgccgggtgcgtagacggactgattcctgccgtcgggccacaggtagagctggcaggaggagtgggttgaggcagctccaagaaaggaacggatgcggcccccgagctgcccgccctgctcgccgcgcctccgtctagaaagggctctacacacacgtctctggcaggccccccacgccccctctgtcatctcagcgaggagtgaggtagagcctcccaggcctcccctctccgccatcacacccccaggtcctcagtggttcccctcagacaccctgtggcccaggaagccgggcggcagggtggcccttcgagcagtggccaggccaccgaggaagcagaactgcatggaccggagcacgtcccagggcagctccaaacgccctcagccctggccacccctggcctcctacactgacaggctgccgggtcacaccggctcctggcacgcggccactttcagaatggacgtggtccaagctgtgtggctcccacagcaccagctgccatcacctaacacccaaggagtacaggggtgcaaactggccattgctcagggccgtgtctacacctctgccattccgtccttccggactctgctattaggaacattattttaagcaagtctttttttttataattttttttaataattttttaaaaatttatttatgatagtcacacagagagagaggggggcagagacacaggcagagggagaagcaggctccatgcatcgggagcccgacgtgggactcgatccctggtctctaggatcatgccctgggccaaaggcaggcgctaaaccactgcgccacccagggatcccagcaactctttatcaggtaaaagaatttccctaacaccacaaaatagttgttatccagtacatgggcctgggacgactgcatggccatgaggctggtggggacagtacagggagattcctaggcctacttacaacaaaataaattccaggtggctcacatacttaaaatgtagaaaaaaaaaaaaatcccaacaaagctagaagaaaatggagacttttttcataatcttagtacaacaaagctctttccaagcatgctacagaactctgaatccattttttaaaagattcatatattcaactatataaaaatcaaacatttctgcaaagcccagtgcacatttaaaaaatttgaaaataatattttatcacatgtaacaaaggacaaaacttgacaatagctattaaaaagtaactgggttaatgggatccctgggtggcgcagcggtttggcgcctgcatttggcccagggcgtgatcccggagtcccgggatcgaatcccacgtcaggctcccggtgcatggagcctgcttctccctctgcctgtgtctctgcgcctctctctctctatcataaataaataaaaatttaaaaaaaataaaataaaaagtaaactggaacgtttagttccaggaagatcaagtagacatacttttccctattcttcttgcgaaggacaaataaaagccccagccaagacaatggcacagacaaagcccaaacaacagtcttctctctctagccaaaggaccagaagagaggcagcctggcaggacagaaagatgtgaagacactgggtacctaggtgcctcagtggttgagcaactgcctctggctcagggcgtggtcacgggatcgagtcctgtgttgggctccccacagaagctccctgcttctccctctgtgtgtctcataaataaatataaaataaataaaatctttttaaaaaatatgaagacactaactgctgtactccatccaaacaagacagaaaaacagctgtgcccaccagaggccagcagagacctcactttctaccctcaccaggttaccataggggcccacttgcccaccaggatggtaccagaggaggcctggtagaaacccactgttgcccagcagtaccagggctattcctgaaaaatacaataaccaaaactgaaatcccagtggacggacaggaaagagaatccacccactagaagaacaatggagacgacccaatctggacagaaagagaacatagactgggaggaatgaatatagagtctcagggacccagaactcttaacataagatcgaacatttgtgtcatcagagtcccaaaaggtggggtgggggcgggagggttaaaaaagcacccaaaaaataatggctgaaaacttctcaaatttggtgggagaagtcaacctgcagattcaagaagctgagtacaccctaagccagacaaactggaaaaaaatccatcacacatcatatccaagatacatcaaccttaactttctgaaaatgaaaaacaaaacatttctgagtgcacgttacgttgcctacaagggacaagtaatgtgaataacggtggatttctcagcagagctgtggagccagaaggaagtagtgtatttctcgggtgctgaaaaaaacgagccaggtcctacagcctccagagatatccttcaggaatgaagaagaatcaagacatcctcagatgaaggacaagaaaggacttagctgccagcagacctaccctaaaagaatgatgaaaaagctttccaaacagaaaaaggaaatgatgtaggaaggagctttggaacatctttggaagctttggagctttggaaagatgaccaaacgttaaacaaagatacgagtaaacccaaaagattttccctctcctcttcagctttctaaagtgtttgatagttgaagcaaaaatcgaaatacagtctattgtgtttctaaatatacgtagaagaaatattttaaatgattatcttttaaatggggaaggtaaagggaccagtagactgtggagactgtggtgagctatgcatacatgtaatacctagggaagacaccaaaaaaattacacaaagagataaactcaaaaacgctatgagtaaatcaaaaagtgtcactttttttcaagtaactcaaaggaagtcagaaaaaaatacaaatatgagaacagaatagccagaaaacaaaaaatggcacatgtaagcactaacatcataattacacctaattaaatggtctaaaaacaccaattaaaagagattggcagagtaaattaaaaaatatgaactatatgctctcaagaaacacaccgcaaataataatataaacaggccgagagcaaaaggatagaaaaagagacataacacaaacctcaatcaaaggagagcaggcgtggtggtgttagtatctcatagagttcagagcgggagaaaattacaagagagagggagcgtcacctaacaatacaggggcagagcgccaaacaccaggactgccaagtacacagagcaaaaccctgactgaactgaaaagggaagtggacagatccataaacactgcaggtggaaatgtgtccttccaaaattcctagggtgaagccctaacccgggggggggggggggggctgtacttgaagatagagcttttaggaggtaattaaggttaaaggagctcctcggggtgaggtcccagtccagttggactgctggccttgcaggcggggggagggcagggaagggagagggagatctccaggcacaggcacagtgggaagacccaggaggacatagtgggaagcgtcccatccacaagccaggaagtgagtccttgtcagaaactgaccctgccagtctgggacttcccagctttccaaacgtgaaaaacaaagttttgttttttaagccacccagtctatggttaatttgtatggcagcctgagaagacgaatacaataaatagagctggagacttcaactcaactagagactatcaacaactgatagaacaactagagagaagatcgtcaaggatatattagaacccaacaccatcgaccaacaggatctcactgatatttataaaacagtttggccacaaaagcacattgcacattgttttcaagtgcccatggaacacataccgagataaactgatcctgggccacagaacaaacctcaacaaatttaaaagaattagaaatcatacacaatgtgctcttgaacaacaacagaatcaaagtaaaaatcagtaacatgaagataacaggaagttctctaaacatttgtaataaatacgcttctacaaaacacatgagtcaaaaagaaagcctcaagggaaatcagaatatacattacactgaatgaaaatgtacacaaatgtacacaaatcaaaatttgtggaacaaggtaaagtagtaccaagagggaaattcacagcactaaataaatgcatacattgggaaagaagaaaagtcttaaatcaataggctaagcctctatcctcaagagccttgaaaaaaagagaataaagccaaagcaaggaaaaggaaagaaaaggaaagataaaaacaaatcaacggaaacgcttggggggcttagtggttgaatgtctccttcgactcaggttgtgatcctggtgtcccgggattgagtcccacactgggttccctgcctggagcctgcttctccctctgcctgtctctgcttctctctgtgtgtctctcatgaataagtaaataaaatctttaaaaaacccaaatcaatgaaaatgaaacacaaaaattgggaaagtatcaacgaagcagaggtttttaaatgaaatgaccaataaaactgacaaacctgtagccaaactgaccaaaaaaaaaaaaaaaaaaaaaagagagattaccaatattaagaatgaaacaaggactcactacagaccctataaacaccaaaaggatgtgagtactttgcacaaccctacacataaatttgggaatttagacaaaatagaccaattcctcaaaaattatatactaccataactcactcaatgtgaaatagataattcaaatagcattataaatattggatctataatttttaaaaatttccaaaaccagataaattcgctggagactcctaccaaatgtttaaagaataattaacacccaacactacacaatctgttccagaagacagaagaggaggaacacttcctaattcattcaatgagctagtattaccctgatactaaaccaaagtacaaaaaaaaaaaaaaaaaaaaaaaaaggccctatggattaatacaccccatgagtataggcacaaaaaaatcagtaacaaaatagtagcaaacaggggatccctgggtggctcagcggttgagcgtctgccttcagcccagggtgtgatcctggagacctgggatcgagtcccacatcgggctccctgcatggagcctgcttctgcctctgcccgtgtctctgccaccccctcccccgtgtctctcatgaataaacaaataaataaatattttttaaaaacccaaaataatagcaaacagaattcagatatataggggcactgggtggctcagtccattaagcatctgcctttggctcaggttatgataccagggtcctgggatggagccccatgcctctgctcatcagggagcctgcttctccctctccctctgcctgctgatccccctgtttgtgcatgcatgtgcactatcaaataaataaaatctttttttaagattttatttatttcttcatgatagacatagagagagagaagcagaaacacagagagagggagaagcaagctccccatagggagcctgatgcgggactcaatccccagaccccaagatcacaacctgagccaaaggcagatgctcaaccactgagccacccaggtgtcccaataaaatatttttctaaaaaagaattcaaatatataacaagaattatacactataactaaaggaagttaattctgaggatacaaggctggtcaatagttgaagatcagtcgatataatctgacatattaacaatctaaagaaaaaaattcccattaactattgatgcagagaaaaacactgacaaaattcagtaccaattcatgatgaaaaaaaaaaaaactctcaagaaaatggaaatagagggtgaataatagctccctaaagatgtccacatcctagtcaacagaacctatgattatgttaccttaaatggcaaaagataatttgcaaatctgattcaatcttgtaatggggagattaccctggattatgtggatgggccttaaatccagtcataagtatccttgtaagagagaggcagagggagtttagatacacacagaagatcatgtaactccatgtgaccatggcagcagacattagagtaatgcagccacaagccaaggaatgccagcagccactagaagctagaagaagcaagaagagattctcccctaaagtctccagtggtagcacagctttccccacagtttgatttttgaccttcagaactgtgaaagactatatttctggttttgttaagccactcagtttgtgtgaattggttgcagctaccataggaaactaattcctccctggagcctcatgcagcttaattttagcctgtaagattcactgtggacttctcacacccagaactgtagataataaatttgccttgtctcgagacattaaatttgtggtacttaacacagacagggatttcttcaacttaagaacatttacaaaaacctacaaccaatattatatttctttgtgaaaaactgaatgttttccccttaaaactaggaacaagaaagggattccactattatcagtcttaaaattctgggagttctgtcagtgcaataaggcaagaaaaggaaataataggcatcaatatcaaaaaagaaataaatctgtccctatctgcagatcacatgattatctatgtagaaaattccaaagaatctacaagaaaattattagaatgagttaagatcacagaatataaaataaacatgcagaagtccattctatttgtagaaatgaacatgtggacaccacaattaaaaataaaacaccatttgtaatcacacacacaaaaaagaaattcttagatgtaaatctaacatgttccagacttaaataataaaaactacacagtcctagggttcctggctggctcagtcagaagagcatgtgactcttgatctcaggattttaagttctgggtgttgagattactaaaaaaaaaataaaacttaaaaaaaaatctacacagtcctgatgaaagactttaagatctaaataacttgagagatataccatactcatggactggaactttcaacttagtaaaaatgtcaattctccccaaattgatacacaggtttaatataatatctatcaaaattccagcaaggttgtatttttttggtagatatagacaagattagtccatagaaaggcaaagaaactagaattgcttaaaaaaacaacaacaaaaaaaaaacactgaaaaagaataaaatgggaagaatcattctactcaatttcaagacttattatatagttacagtaatcaatactgtgttgcatggaagagagacaggcacatacatcagtggaatggaatagaaaacccagaaagagacccagacaaatacaccaaccttttttttttttttaatttatttacttgtttattcagagagagagagagaggcagagacacaggcagactccatgcccaacgtgggactcgatcccgggcctccaggatcacaccccgggctgcaggcagtgctaaaccgctgcaccacagggtctgcccacaccaaccttattaaatgcaaaaacaagagagaaaaggtagccttttcaataaatgatactggagcaattggacatccatagacaagtgggggaaaacaaagtaactcaaccaagtctcatgccttacagaaaactaactctaaatggatcataaacttaaatgtaaaacacaaaatgatacttttagcaaaaaaacataaaaggaaatctgagcagcaccagtggcgcagtggtttagcgccacctgcagcctggggtgtgatcctggagaccccagatcgagtcctacatcaggcttcctggatcctgcttctccctctgcctgtgtgtgtgtgtgtgtgtgtgtgtgtgtgtgtgtgtctatgaataaataaaaataataataataaggaaatatttaagatctagggccaagcacagagttcctaagcttgatggcaaaagcacaatccataaaaaggaaacttgataaattggacttcatcaaaattaaaacttttgtgcatcaaaggacactataaagaaagtaaagaaagtatccacagaacaggagaatatattttcaaatcatttacctaccaagcgtctactatccagaatatataaagaactcctacaacccaacaacaacaacaaaaaaccaattcaaaaatgggcagggatgcctgggtggctcaggggtttgagagtctgccttctgcctagggcatgatccctggagtcccaggatctagtcccacatcaggctccccacaggaggcctgcttctccctctgcctgtatctcttcctctctctcctgaataaataaaatcttaaaaaaaaaagggggggggaactaaaataaacatcttcccccagaagagatacaaacacccaagaaaacattaaaagatgcccaagatcattaactatcagggaaatggaaatcaaaccacagtgagatttcacttcacacccaccaaaatttctgtaatttaaagaaaaaaatcagtgttagtggaaatgtgaagacactggaacccctcacacactgctggtgggaatgtaaaaatgatgcagccactgtgtaaaacaggttagtagtttctcagtaaaccaagaaataccatacaacccaccaattccatttctgggtataagcactgaaaataagtattcaaacaaaaacttataccgtacacaaatattcacaggagcactattcacaaaaagccaaaaggtgagggttgcctgggtggttcagttggttgtcagactcttggtttcagctcaggtcatgatctcaggggcatgggatcaagccccgtgtcgggctctgcagtcaacagggagtctgcttgagattctcgctctccctctgcccctttcctgctggtgtgcacctgtgcacctgcatgtgctctctctctctcaaataaacctttaagaaaaaaaattcattgaaacaaaaagcagagtagtgggtgccagaggctcggaagagggaagaataaaaagtgagaggttaatgggtatttgatttccttttgaggtaatgaaaatgttctatggtaaattttatgtgtattttccccacaatgttaaaaatatatatccgtcaagccaggggcaagatgaaatggagctagctttcgttatttaggaaaatagctttccttattcaggatccctgtgtcctctgtgtggaagcacaagaaaatcaactcaaaatttgtaagaaatgggtcattccagatcttaacgatgaagcataaagcaaggttccactgtccgctcagtgtctgcagccaccgcccagcagtccttctcatagatgtccctgcagagcacctctggctctatgaagaggcttccaaactgtggatttttttaaaaaagattttattcatgagaaacagagagagagatgcaaagacacaggcagagggaaaagcaggctccctgtagggagcccgatgtgggactcgatcctgggaccccaggatcatgcctgagccaaaggcagacactcaaccactgagccacccagacatccctaagatctgggcttttaagaaattcaaacccatcattgcagattggagaacccatctgggcaagttttgctgttgatgaaacacgcccctttcctaggcttccccatcctgaggggggtctctccaggccctccagcctgtcacagccactctggtgacccggctgcatcccccttctgggttatccttctagaaaggaagtcagttaagaacaaacccggggctgatggaactcagatgcctcttctgcgtccttcctggattctgtgtcacacatggctccctccattctcaaaatggtaagaacattgttcccttcacattaccttgacagcccataagggaatgttcatttccccttgactgatatttaaagggggccaagcctaagggcaacatgttcctcaccttgccaccctagatgggactggtcggtttgcagtcagctggaggagggtaggctgcatctctccagtgccagcaggcaagggctggccctccccagaaccaaccgacagagtcccagcctggaagagggaaggaggacagaggctgaagcacctttaagtgcccacttggcctgtcagagcggggtgtctaagcttagagacgagggaacaggaaactggcacagtcgtaggataggaccaactgcagacatgatggaagtcaatcacagagcaaaccgttcaagcccaccccttgactgctggagaggagtcccaggaaccccaagacccgccctctatgaatcgcaggctcacagccaacacccattcctgtgcccttagtctgcgcccctgctcttgctccccacagatccacccacagaagcagcagctgagcctcttactatttcttgatttcttgctgcatcattggaaaccttcaggggaatctggtcctagaaatgaagtttccaaaaactttgttcacatgcccaatcctgagctgaactggacaaaatgaatttctggctttcagagaagcccttatactcacactttggatacctctacaggcttctcagagccctgagataaatgttttacccttaagaacactagggcctgggtgtctcagcttctcagctccacatgccagagggagtgcccagcccgtggaggaagactgggggtcttctggcttctcggctagtcgggggctcagggcacagggcccagacacagccacagcacaggaggagtggaggtttgcctggggttcagaagtttattagtaagggagtttgggccagcgggtatttacacgctgcttgctacagccctggtgtgccagctgcaggagggaggagggcttcctgctctgacggtcactggtcagccaccccagagaacgatgagcttctctcctgggatccaggggccagggctttgagctggtgcattcagatggactccacctctgtgtccagggcctgggctggagggacgagggtttttaggatctctgtgtagtaggggccaaacactttctgattgtgatgcgttaggctgacaaacttttggcctagttccgccagttctgcttcgatgacagtgaggcctccagggaggtctaagagagatctctgcacaccgaggaccaaacagcatttgagaaacaggtggatccgctgatctatgagcaggataagacagtgagcaaacaactttcaggaagcaacacagcctctacactccactcactcaagttctaagttaaccaagatattcactagcctacccactcacctggagataaggaaatttgtgttgctccagaagggggatgctatctagctcccaaggacaaagcaaaggtcacagactagtgggctagtaaattcctgactagtcaaaagatgacttaagcttccaccagtagatcttgagtgagtatctaacatgaaggatcttagactgatgctttggatggctgaggttaagagcaaggtcaggttcatgccgtccattccaacagggatgagtccttgctgcaggaacatgtcctctagctgattcagcatcagtttcttgttgctggtaggtgagggctatgtcatgtcttggactaatcagaaaatgacccagaaggccagggatgacttaaccaggttggttgaacaggatgtcatacccagaagtcatgaatcctgggtgcaaacattccttagaaccagaatcagtctttaaactgaaagaaacagggcagccccggtggctcagcggtttagcactgccttcagtccagggcatgatcctggagaccccggatcgagtcccacatcgggctccctgcataaagcctgcttctccctctacctgtgtctctgcctctctctctctctttctctctctctgtgtgtctcactaataaataaataaaatctttaaaaaaataaactgaaagaaatatattttcaacccagcattttgaaaaaactaaagcctaaacaagtgacttgtctagtaatcatgctttctatcattaaatggttcagtaactgacttccagggatgggatctacctctccccaaaacactctcaccacttccatggtcacgctcaccaatgacactgcggacacaattttccttcttggcaatgttctggagctgtcctatcagagatgctgtgttgtcactgctcagagcagcaaggcccatgttcttgaggctttgatggatttcctgagacacctgttcactcacagtctgcagagcctcctcaggcctagaccatgaaggagagtaagctgggacccagcagatggcaatgccacagacccagagccacagagccggggaagctccatgccaaaagctgggcccatttgagggagactctcagtcatctccctgccctcaccccagtccctgtaagtaggtaggttcaccctcctcactgctatgctccagatcctgactactctctatatatgataccatgttctacttcttagaaaacaagataaattataaaatcaactctgggtaagagtttggtgtccactcaattcttcagccctgtggaatttatttatatatgtgtatatatacatttttaagactttcttggacattttccatggtcattggtcctactgtcaccaaaaatccatgcagctcacctggacttaaactcctccatcaggtctttggttatatgtttcagcttatccacaaactgaggtgagccaaacaaaacactgcctgagaaactactggccactagcagaactgaggccaggatggtcaactggtgcaactgagactccagctcctgcagccgggtcctgtccatcagcagtgtctggggaagccaggaaggagaggccgtcaggaggggagagtcatgagggagtgccgagtacactgtcaggggatgccctccacaggcctacctcagggaactcttcattttccgggtcccagagaaggaggttcaggaaaccctgcgatagcaccattgtagggctaaggggctctgggctgctgactgcctcgttcggggaggaggaggccatactggtggagtccaaagtgtcggggcaagtcgggagtggcatggtgaggtctgctgctgcttgggtcagccacttggtggtgtgatctaggagacctagggtaggaagagggtgggcaggcatcttcagcatccatgttcctaaagcttcaagactaacgttcttttcaagatctgctcctggtcaataaataaatgctttggttggggggaagggggagtggtttgtcttagacaactcttccgtctcccctaccccaaccccacctgaggaagaaattttctgttcccaagagacagagtattctctaacatcacagaagccagatccaaacaagatcacatcttctcacttctgccctcaagttatttacatacttggctgtttattgaggagttcctggaacgtagcccgttcgtgctggatggaatgttcctgcaggtgaggctgaaggctctggatagtgtagttcaccatgtccattttcatcagccccagaacctggaagatccctctgacataaaagaaaataaaatataccatgaaaggaaatccagcgagagggaagtgtcattaaatcactgtattccagggttagaaggggcttgaaaattagtcccatctcctaaatttacaaaagatggctctgtggacccgaggccccagagtaagtgatggcagagcaaggaacagagaggtctctggaacttgaagcctccaggctagctctctttccacaggatgattctatcgtctttttaaaaggtagagtcagagaaaggaaacacacccgcgtgctaattaatctgtctggaaagagggattataggtgatgctgtatctgaagcaatttctaggccaatcgcttgtccccccacccttcttctaattttctgggtcttggttcctacagttattaagtagggatagcctcccatccctgtcccctcatgctgtataaactgcaatgagaaaatgtggggacagggtatttgaataccttggaaggatcacatactctaacgttttatgatatgatgttctacaggaggcctgaccaacctaaggccatctttgggacaaaaaaagaagctaacaggtcagtgaagagcaaagaacaatgctcaggtcttcaggagggaagagccagccaagacaggggttgtaattgagtgtctggccctgcttttcctggcccaggggctgaggcaggtttccaaggacagcagccaagtttcacacctcagcaaccgaacagggtccgtaatgttctctagattctgtactgcttcgtctcgaactggtgcgcacagcaaagtcatcatgttgagaatgtacttagagagatgagggacattcagggctccatgttctgctttctgattgaggagctctgtatccagtgcttcttcaatctcacttcttaggcggctctggcgtggtaacagcagtgagagcaagatctgcccaagaaagaaagtcagagggagttgcactctgtgtggagccccaaaccttctctaacgcacaacccctttagccaagggcatcagcctgtctcttaggaaccgagaagcagggtcactaaattttcccgagaatattatttatctttgttgagaggccaatgatagttcagggctttaggtcagtacaaccacagtgcatcattttctaggcagaatgagatgaagagataagtaaaatcaaggaatgtggaaaaaagaaatgcaaagtacaacaaatataaaatacacatatcacatggtgatgaggtgctcttaattttaaaaggtgggtttgctttattatttatttgtttgagagagcaagtgcttaggggaaggggggcagagagagagagtgagtgagaatctcaagcagactttgcagagtgtggggcttgacatggggcttgatcttatgacctgagatcataacttgagctgaaagcaagagtcacacgcctacctgactgagccacccacatgccccaaagcaggcatttttaaagattattttacttcaaatggcaaggatgaaataggccaaggaccagttaagaggcattggaaatagccttttaactccaaaacataagctccctgtgaagagagactctcttattcatttctgtgcctcagtaacaccatgccgggggatgcagtggtgtggtccagttaccagttgtttttaattgaatggactactgtgtggtcagagcaggattcccagctgtttcacttcatcttaaatacaagtttctctgcactatttaaaatggtgcagctcaccggttagcagtcgaaggccctctgtgccaactctaccctccttcagggcctacgcaatggtaacagagccaagcccttcatctgtttttcccttgctggctggcatgaggttaagttttgttaatagagggtgctaaagagaaactgcccaagggagaggtccccctgcctgggctctggtgagctcctctgtggcaccacctatgctgctgcagctttgcttcactcagaagcaaagtgtgggttccttctcctgatcggaccctgactgatacaaaatcgtatcgtaccacgggtgaggcctgactcaaaggccatatatccactggctctgatgagcatgagtagcacgagtagcaagtaccttagatgccttagggaaatgtgcaaattacaggatggcagataatccccacaaaatgtcagcagcctctcacctcagtgaaggtgccagagcttcagtggtctgcaccttgtcaagctatccccctccaagctgagtcaacttgctgtacctcagaccacctaccatgaaagaagaggcacaatacttgtaggcctttctgggtttttgaggcaacataggccacctttgagtttactcctgcagaactcatttagagtcactcaaaaggtttccagtttcaagtgggaaccagagcaaaagtaggctctgccatttgggctttataatccagcaggttcaatgatacttacagtgtctgcggcaagtaaggttgctgtaatacagcctctggcaggttccaaagagagcatcacaacaagacctttaggaatttagagcaaatctatgcctttttctgccaatcatggtttgccttttgagaaatagtttctggcttgctcctgggcttctgtagaagtaaacacctcacatacgacatgggtggccacgtggcctgagctttccatgaggaactatgtgttgtccagcctacctaaccataagattaggcccggcccacagcaatctattaccagatgaaatggcccaaaggtgaccaagcatatactggaataggacagatctacagaacagaagaacagaataggaagcccagaaataaaacctggagatatggtcaaatgtttttaaacaatgccaagaccattcaatggaaaaaggacagtatcttcaacaaatggtgaataaactgggtagttatccatgcaaaagaatgaagtcgggtgggtcagctgcgagttggcttcaactcaggttgtgatctctgggtcatgagatcaagcctagcattgggctctgtgctaagcatggagtctgcttaagacttttcccctcttcctccttctgccccttccctactctctaaaataagtaaattaatatttttttaaaagttgaagttgggggatccctgggtggttcagcggtttagacctgcctggaggtgccagggcgagatcctggagacccgggatcgagtcccacattgggctccctgcgtggagcctgcttctccctctctgtgtctctgcccctctctgtgtctttcatgaatgaattaataaataaaatcttaaaaaaaagttgaagttggacccttatctaacatcttattttaaaaaatagctcaaaatgggggatccctgggtggtgcagtggtttggcccctgcctttggcccagggcacgatcctggagacccgggatggaatcccacgtcaggctcccggtgcaaaagtctgcttctcctctgcctgtgtctctgcctctctctctctctctctctctgtgactatcataaataaataaaaatttaaaaaaaaaaaaagctcaaaatggatcaaagatctaaacagaggagctaaaattctaaaactcttcaaagaaaataaagggataaatcttcataatcctggatctggtaagacaggacaccaaaggcagaaggaacaggctggatcaactgggcttcatcagaaataaaacttttgtgcccaagaaactatcaagagagtgaaaagactacccacagaatgggagaatatatttgcaaatcacttacctaacaaggggctactttccttgaatagaatatataaagaactcttacaactcaacaaaagacaaacaacctcatttaaaaatggacaaggcggggggggggggggggggggggggggggaattcctgggtggctcagtggtttagcactgcctttggctcagggcataatcctggagacctggatcgagtcccacattgggctccctgtgtggagcctgcttctccctctctgtgtctctgcctctctctgtgtctctcatgaataaataaataaaatcttaaaaaaaaaaaaaaaaaaaaaaaaaaaggttgacaaagggcttgagtcaacctttctccaaagatggcagaccttgggcaataagcacagggaaagatgctcaacaccattaaccacccatcagggaagtgcagacctaaaccacagtgagattccacttcatagccactaagatggctataatgataagagaaaaaaagcattggggaaaacgtgggaaaaactggaacccttataccttgctggcaggaatgtaaagcggcgcagccactgtagtttctcaaattcagcaatggcaccccttggtatatacccaaaagagcagaaaacaggcgttcaaacaaaaacttgcacacaaatattcatagcagtattactcacaatagcaaaaatgtgaaaacgacacaaacatccatcaacagataaatgggtaaacaaaacacagaatatctccatacaatggaattttatggggtcataaagaggaatgaaattctgacccatgctgacaacagggatgaaccttgaaaacattatactaaagtgaaatctgccatatacaaaaggacaaatatcatacaattccccttataggaggtacctagggtagtcaagcacacagacacaaaagtataatggaggataccagactccggaggaagaagagaatgaagagttactgttaatgggtacagtttctgcttgggaagagaagaacgttctggaaatggatagtatgatggtcacaaaacattgtgaatgtacttaatgccactgaattttaacactgagaaataattaaaatggtggggtgtctggctagctcaattggtagagcctaaagctcttgatctcagggtcatgagttcaatccccacgttggtcacggagcctactttaaaaagaaaataataattaaaacggtaaaaattttatgtatgtttacaatttaaaaaatcctaaaaaacacaaatgactaagccattccccaggaaggatgagccagccacctagtggcagatgacttctttggaccttctaccactatggaggcagcagtcactctcactgtaacagatatatattttggatatggatttgtcttctctctctgcaatgcttctatcagcaccaacatctgtgtacttacagactgcctgatccaccgtctcggcatgccccataccattgcccctgatcacagagcactttataacacaggaaatacagcaatgggttcataccccttgaatcaacaggccttaactgaaaagtggaatggcttattgaagactctattacagcatgagttgagggacaatatcttgaaaagaagaggttctatcttataagatgcaatatattctttgaatcaaaggccattccatggtacagtttcccaaagccagaaaacagggtcctaggaatctaggggtggaaagaggactggttccttttactattatacttaataacctctctgcagaatttttgttgcccatcttgccaactttaggctttgctgatttgggaggaatgcttgcactggtcccagtgaattagaagatgagactgcatatgttcattctgtgctccttataccactgaaccaatatggtgaaaaagggattattctacaggtgagagtaaatgatcctgagtatggggacacctgggtggcttggcggttgggtttctgcctttggctcagggctcccgggatcaagtctcacattgggctccctgcatggagctctgcttctccctctgcctgtgtctctgcttctctctctgtgtctctcatgaataagtcaataaaatctttttaaaaaaacatgatcctgagtatgaaggagaaaccaggttgatgctacacaatgaaggcaagatgattctcttaggtttctttcagtgctttcacatccagtaacaaaagttaatggaaaaccacagcaaacaaacaacagcaaaatgcttaaggactcagactctttggcagtgaaggtttgggtcacttcaccatataaagacatccaacccagctaaggcttgggctgagggcaagggaaatatggaataaaaagtagaaggaagccatggatatccaccatagacttgtgaccaattacagaaatgatgactacaagttttctctttgcctgtcacaggcacaggtttatctgtacacgttaaccactttcttctctcctcctcttcccactattattttacagattggttgttgtaagctaactgtacaatttagactttaagtaacagaatatttggtggcactctgaatttgataacaaaagacacagcaactgttgggaccgtgagtctcctcattttctggaaagaatgaaaatgaggaaatgtctggaaagacaactgcatcttagcaggcagaaatagagatcttttcataaactgaaatgcgtgtggacaggtgcatacagaagctgagcagccagcagaggggaatgtgacagttatcaactgtctctcaattccaaattcatcattcatgtctctgctctgagaaaatgaagcccttgcaatatcttttctttaccaggtggcacaatggttaagtttaatctgtagagggcactagtagttttctgggctgtataacaaattactataaacggagaggttaaaaaataaataaaataataaaataataaaataaaattaaattaaattaaattaaattaaattaaaataaaataaaataaaataaaataaaataaaataaaataaaataataaacaggtttaccacagcacatacatttatctcacaatttctgtggggcaggagcccaggcatggtttaacttggccctctgtcccgcatcccgcaaggtgttgtcaaggtgttggctgaggtacattctcactgggaagcttgactgggtaggactctgctaccaagctcattcaaatggcacagttcgttacagcagacttgctggatggatgctgctgtcagatcctacaggccgtgcatttccctgccccatgaccctctccagaggcagttcactatacacccatccacttcttcaaggccagcaagagagtttctccagtcggctaagacagagtctcacctagcgaaatgtatttctaggagcagcatctcagcacccttgcatattggttagaggcaaattatagatctcatccacactcaaggagagcggactatatacaaaggtgtggatcactggggggtcaccctagggtgtgcccaccacatactacaaagacattggaagaggcaagagcttctcttcacggttctgcaatactcacttcgcgttctgcaaaatgggtgtgtggctttgcctgtggctggctcctgcagcctgagcaccttcaccagtgtgttcagctcctgcagggcaagtggctacttgtccagtgccaggctccgcctgcacaggcagctgtcccagcaccagatcctgcagcgcaggatgggcagaagcaacacacccacaccctcccaaacactgctgtgagtgttctatcgcagccctaggggtagggtgtatcttcctcctctctgatattttagcacactttagagttttctttgctttttattagctcaaagctcttgtttctttgattccatgttataatcatttttatgttgaaactactgtgtgatttctgtctactgatgagactctgactgagtcctggactgtgttcaggttggatctgttagccactgccacccaatgaccttggggatgtgtaggaaatttacatctacagatggaagatcggtcactcacctctttaatttctttcagaagttcaagagcacagctgaagtctgggggagtagctgacaattgctctttgagatggttccaaaaggcattgtgcatggtctccttgaccttatcttccaaactgtaaagagggttaaatgagcaaattactttctctaaaaactgttataaggtcattctctcccaagacccaaataaacatatttgatatgacaaagacaatcacactgacaggaaaaggccaggaactatgtttgggccgcagcaaagttgaacaagctggggtcagacctggatgccaagcacattagtgaaagctctcaagagggcttctcatgattccaagcagccctccctctgcagcaggaagaaccctcaagagaggtcaagccagctttagtaccgactttgcaactaggctagataatacatgacttagtttccatttatgcatacatacagcaagaaactaaaggatcttttattctcttatagtcctaaaatctggaaaaggattctccttccttgctaatactgaaatatccacaggtacttccaaatcagcaggtctaaaactcaattcagtatcttccccttccaaacctgtccctcctgtattcccaatcgtagtggcactaccaggtagccagtgatggaggccagaaagatgttatctcttctcctttaaaaaaaaaaatagtgatgcctgggtggctcaggcagttgagcatctgccttaagctcagggggtgatcccgggtcctgagatcgagtcctgcatcgggttccctgcagggagcttgcttctccctctgtgtctctgctctctctctgtgtctctcatgaacaaataaaatctttaaataaaataaaaaatagaagcaaaaggcaattcaatttagacaggataggctcttcagcatgtggtgctagaacaagtggatctccataaacaaacaaaaaaaatgtatcttatagcttccacagatagatcccagacctacatgtaaaatgtagatgacaacacaggagaaaagtaggtgaccttgggtttggcagtgacgttttaaatacaacaacaagggacgcctgggtggctcagcgattgagcgccgccttcagcccagggcctgatcctggagacctgggatggagtcccacatcaggctccctgcatggagcctgcttctccctctgcctgtgtctctgcctctctctctctgtctttcatgaataaataaataagatctttaaaaaaaaaaaaaaaaaagacccaatatccaaaatactgagtcttaagactcagcaagaagaaaacaactcaatttttaaaatggggaaagctctgaacagacacttcaccaaagtcatcatacagatggcaaataagcatatgaaagatgttcaacatcttgtcatcagggaactgcaagttaaaataacaatgacatacccatataagcctatgagactgccccgatcaaaatactgacaccaccaaaatgctggtgaggatatggagcaattctaggaactctaactcattgctgggggaaatgcaaaatggtacagccactctggaagacagtttggcagtttcgtttcttttctttttttaaaagatttattcattcattcattcattcattcattcatgagagacacagacaggcagagacacaggcagaggaagaagcaggctccatgcagggagcccaatgcaggactcaatcctagatcccgggatcacgacctgagcctaagacaggtgcccaaccgctgcgccacccaggcatcccagtttggcagtttcttagaaaattaaacatactcttgtcatatggtctagcaattgtcctttgtatttgagcaaatgaggtgaaaacttatatccacccaaaaacttgcacagggaggtttagaccagttttattcataatttccaaaacttggaagccaccaagatgtcatcctgtaggtgagtggtaaataaactgtggtatatctggataatgggatattattcagcattaaaaagaaatgaaccatcaagccccaaaaagacacagaagaatcttaaatgcatactgctaaatgaaagaagccaacctgaaaaggctacatactgtaagattctaattataggacattctgggaatcaatggaaacagtaaaaagatcagtggttgctgaggaatcatggggcaggaagaaaaaggtgtacaggagatttttaggacagtgaaatcactgctttggatacaaaaatgatgaatacataacattatacatttgtaaaaaaaacccacaaaatatacaaaaaacgaactctaatgtacactatggacttgagttaataataacatattaatactaggatcaccaactatgataaatgacttactgcaagacgtaaacaatgagggaatctgtgtgctgcagagggaggggtgtgtgggaactctgtactttctgatttttctgtaaaacaaaactacttttaaaaatgtgtctggtgggtgggggattggggtaattgggtgacaagcacttgaggaaatgagcattgggtattatatgctcaactgatgaatcactaaactctacctctgaaactaataatacactatatgttaactaaattgaaaatatgttaatagaaaatttaaaaactaaacatttaatgtgtttttttttaatttttatttatttatgatagtcacacagagagagagagagagagagaggcagagacataggcagagggagaagcaggctccatgcaccgggagcctgatgtgggattcgatctcgggtctccaggatcgcgccctgggccaaaggcaggcgccaaaccgctgcgccacccagggatccccatttaatgtgtattaatttaaaaaaagaaatgacaagaattttcctctcaaagtttattaaaatgtttcttgtctacaggtgagagttgtaagaagaaaaagaagcatttgaaaagtacaagtctgtacctagtcattgccaagtagctactggttttcttgaattaaacatcccccttaaaaaaaaatacagcagtaacacatgctccttgtgaaagaaacaaaaaacaagcaatatgaggatgaataaaacaaaaagtcaaagttcctctcccaatacaccactttcactcatcagaggtaaccaactataatctgcccaatgatctaaagtgtactagacttgttctcaactcttctcttcatcctgtctatccaatccatctccaagtttcataaatcgtgcttcttaagtgcctccggaatccatcccttccttccatgatctcttacctggactactgccatagtccattcactggtccccctgctttcagtcttgtcccttttcaatcggttctccaccaattcattctaaaaccaaggacttctaaagtgtgattctcatcaggatgccacgctcatttaaagtcctcaccatagcaaaaaccacttacaggacccttctggatactgctctgcctcccactctggtttatctcctcctatctcacatttcatgctcagccacaccaaggtacctgtaaaaaacataccatattcttgcctctgacatagcttcctctaccaggagcattctttctcatgttgaccatctggacagcatctattcctcctctaaaatcaactcaagtcttcataagcaactcaggtcttcctctctaggcagatcttctctgaccctccttaagcaattgagcactctcatgagactctatagacacaactatgagtgaactgatcatttttttttctgttattcaactgtccccctacaaaagcttcctgacagcggtgacagtcccttatctatctatagctatatctctatctatccccagcacccagcattttgcccgccacataagtgctcaatatatgcctgatgagtgaatgctcaaatgtgggatttccctttgtagtgtgcaattgtcactagcactgtcctttgcacaaaggagagccaattgccaaaaatgagtcaaactctatttcaacctctttcttgatctaaattctgtattaccttatgtgaaaacacagctctgactagtactatttactctgttcattcctccctctctcatcacctctacctgcccccccaactccctcattagcacccctttagcagaccttcactcccggttttagttttgctcttctctcctgccgtcaacaacatacctaagcagtgacagagacgttaggggatgtgggtttaggtgaaaacctggtcccacagaagctgtgcttggtatggacaacctgctggcagcaggcaagggcatggagaggaggggaatgaagtgtggtagagaacagcacttagtaactgctgccagataacaaaggcattcaaggaagccgaatgatcacgagctgccctcatgtagctactggtgggaaattagaactgtttttaaaacctgacactgaatttacccattcaaccaccaataaaccagcacagccattgaattcatacttcctaaatggttcttatttgtgacaccttccatataactaagaaccaaagcaaagcttgatggaggtgggagagcattatttatcaacagagttctgatcctgattcataaattaaactgacttatgaagtcggaaagaaaagaaatgaaaacactactattcgaacattcacattttatctgtgcctgcttcatctatggtcacttaaaagagtaactggagggaactatgaggcaggcagccaacaggataatcccaaagatctaggattcctggtattcacgctggtgtatagtctcatctctgggagttgtgggctgggtttagcatctaccttctggcaaacagaatgtagccaaggtgatgggatgtcacttctgagatgaggcaacaaaaatactgtgggttctgtcttgggcaccatctcctcacatccttattctctcactcactctgagtgtggcaaggagctgaggaggctctggccaacactcaacacgttgactgcagcctcgtggggaaccgagagccagaggcacaccgttaagccatgcccatatctctgacccacagaaaccgtgaaataatgaacaccatttcagccactaagttttgggataacttgatggccacaatagctagctactcaggctacttcctccacatctatcagagaagatctgaaatccatcagactgatgttttattattaatgggggctgcaaagtgaacattccaataataatcactttggcttattcactcattaaataacatttgcttcttgaccctctaatactaaaaactattattttttaagttgttgagatcttttaagttttatagtcaaacatcatatcccccccccccccccggttttcttgactattattaaataaaaatgcttcgagtctggtcaaaagccattattgctaaatagttatgccgggatgaataaaatgggaaaatcagaagagccggtacctgcttggaggcgaaaccttttcttccatgtgcaaaccacgattctttccaaccttgttgctcagcttagaaacatcatcaaccgtgtctatcagacctgggacagaaagaactttgggtgaacacctgaaactaatgttaacatcaattttacctccattaaaaaaaagaaaaagaacttacagtggacacaagtcattctgaatttctattttattcagagattccctctgagtaggccccaaatttagattcatcaaactgatcttatacaaactcattcaactgttctagtcatttatattttctgaactttgggcctagagtactccagcacatagtagccagcagtccttggcctggatgcatagtagtgctgtgtggtggtaagggaagacagagcatctcttttacaaataacaaaaactaattacaagcttttctcttgaaaagtaaaataataattaaggcatcaaagaaacaataatttgtgagttgcaaaaataagcatttctctagggttattctgattctactttcctcgtcctgcctctgatgaaagctaaattctccatacagatgggactgaacagcaccagtgtcacttggtctcagaaaacagttccaggtgttggaatttcacaggctactaacatttccaaaaagattctgagcaaccgacaacttgccaactttggacagtgagacaagacataagcaaataaaaaaatccactctaccatcatttcataaaagaagaacttaactgcccaaaaaaacaaaccccccccccacacacacacacaaacagaaagggactgttgtcagaataaagagtagtcctttacattgaatcaatttagctttaggaaaaactcattacagcatctttatttcctttcactaaatattgctaagaattttgtcacaaaccagcactagcatttgggaaccactgccttaagttcttagtaaagacccagctgagggcattctcatgtaataggcagaacatagttataaggaccacgtggtatgtggaacaaagctgcacagagtaaattgtattttctcattctctttcagtagcgcttcataatttgtccacagaagagtatctggttccgagatgtggaagggatatagatgaagtaagatgcaccatggagttgatcattgttgaagctgggtaatgagtaaacatggttcctcacgctagtctacttttgtaaatgtttaaattgtccataagtaagaagatttaaaaaaggaaaaagcgttattgttgaaaagaggttacatgagaatgcctttattcttaggagatacatgatcacatttttgaagccatgactccaactttcagtaagaaaggaaaattatacatatatgtagagagagagtgcaatgtcacagaatgttaacaatgtgggcattcactgattagtttacttttcaacaaagttgaatattttgaaattaaaataaaaatttatgggtaaaaagtgattgaaaatttaccaaaaagccactgagcccttgcttaggtaaaaataaagatgaactgagcctcaagtggacagttgaagttccctttgtttttgaagcctcttggaagcctttggtttcagctaaaatggcaaaacacagtcaaatatgtaaagagacaatccattacttcattaatcagaaataaaagaaaatcttccacgggaaactgagatatagcagcttattgaaggactgaaggaaaaattatccacagaaacagtttccaactataagtcaaactccagagcctcctttgacaagatggtttggccgctcacaagaacggtactattcaactctataaaaattcagggaaggggagggaccaaagagaaatgagaggtaaaatacaactaaagtagatttctaaaatccatatcccaagaacaaagaaattttcaacacgatatatagtaactgaaccaagtcaacctcacctacaaaatttcaaattcctttttatttaaagggggaatttcgttactcattttagggctgttttgcctatggattcatttaaacagccgcttaagaacttaagtcgtttacaccgtatttaccaaaaaattggctttcaccctacaataggttcattcacatctaaataaatcctcaggcacccgatgtgccactttggggccattttgttagccagcagcgaccccatgcggctacaggagaaaccggtgtccttcaacctcgtagccccgggaccttgaactactttctgccgtttcaatcttcaagaggtcaactctgcctgtggagagaggccttcggactgaggcctgtttacgttcgcgagaggcactgctgtaagagggatgccggagtcccggggagggcagacctacggaagcatggaagagacctgggacccgaaggaacgctgaaatactagagcccggggcagtcgtttgcgagtccatgaagcgcccagcgattcccatcagggatcaccgggggtctctaaaaaccctcaagttccacctgcaaactcaaacgacaaggatggctgcgaacgcactgggccccagaccccgtccgactcaagtaaggccgcctgggtcactgctccccgcgggccgagcgggaggccggagccgtgagcagacgcccggcgggggcagcggaggcgggcggggccgagggcgaaccccgggcccgaggcccctcccctccgcccggccgcacccctggcgccctggagcggcggcgggcgggcgcgcgggacctacaggcgggggcgtcctccacgccgctcgcgccgtcccgggtcggggcggaggtctcgggcctgcaggacctgcactcggcgtcgcccgggtccgtcaggggcattctgtcctcgacgtccggcatgttgcggatggaatctggactggggagaaaggacgcgccgtgggcgtcggggaagggggctctccacctgccgccgcgggtgcggagccccgcccggcgcgcccggcctggccacgcggcgggagcaggcgggcggctccggggccgctcgggggccagcgggacaggggagccgggcggcggggtgcgggggcccgaggggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggaacttcccactccttacgggaagacaggaatttgatgacccgaagggccccggtgggcccagcggttatggcgagagcccttggcagaggcagtgatctcagggccgccggaccgagccgccgggtggcacagtcggggcttggggaacaaagcgccgcccgtctcccgggcaaccggcggggtcacgtggccgccccgcgctccgccgcgcgcccgggggctgggacccgggcggccgggctcaggctgggtgtcgcgtagcccctgaggcccggggtgccgtgggctccgcggccgggccctgcctggtatctcggggccgccgcgagaaagatcacctgcaaccactcagggaggggagaggccgcggctcagctaacccgagaaacgagcgcacccgggagggtcgtttctttccagcaaggccccgctacctggcgctcggcaggcgcggaaacccagccccggccggtcccggttggtggcggcggggcggcagcgtgggctcgtccactggattcctgggctgggctcacctggacctgcaggctggccccccggactccaggctccgtcccgggcctgtctcggtcccgagtcggctgttgcccctggagtgacttaggacccctgtcccctccaacgatcactgtacttcggggggtgggggacgaaaagaagtgtccgctgtactctcctatccctttttattaacggacttgatttcttacaacaaaagcttgctttaaaaaaataaaatagggcagccccggtgccttagcggtttagccccgccttcagcctgggccatgatcctggagaccaaatcgagtcccacgtcgggctccctgcatggagcctgcttctccctctgcctgtgtctctgcctctctgtgtgtatgtgtctctaataaaaaaataaaatcttttaaaaaaatgaataaaatagagcgactgagtggctcagtgattaaacattctgccttcagcccagggcgtgatcccagagtcccaggatcgagtcccgagtcgggctccttgcatgaagcctgcttctccctctgcctgtgtctctgcctctctgtgtgtctctcatgaataaataagctaaaacataagatgaaatcattgcctgtatcaagttcttattataacctttgccttgttagtgtgcaatgtggatttttcttgcacaacatacgcgttttgagggagaggatcatgaagaggcccaagaacactttttttccttcctgcctgcctgcctgccttcctctctatgcctaacatgaggtctgaactcataaccccagagatcaagagttgcgtgctctactaactgaaccagccgcgggtccctgaacacacatttctgcataagaaagtccgctctaggatccctgggtggctcagcagtttagcgcctgccttcagctcaggttgtgatcctggagtcctgggatcgagtcctgcttctggctccctgcacggagcctgcttctccctctgcctgggtctctgcctctctctgtgtcttatgaataaataaataaaatattttttttttaaaagtccactctgaggtcaaagaagatatgaggggaacggcctagtaaattaccgttcagctgaagggttcttaatcctgtacatgttaaacctgccccttaccccctcctcaacctttcctggtatttcccgcagagatgttaactgtgaagcaagcaggcaggtcttcaccgcaaactcagaagggaggggaattgtctgagttcaccaaagaattcaatgaaaatatgatttttcattattacataggagttattttggctgggtctcctcaaaacaaaacaaaacaaaacaaaacaaaaaacagatctctgtttgggcgttttattctgggagaaagtttccagaataacaccagttcatttgcccacaaaaatggcattgccataaagcttttcttgctgatgtctgaaattacctccagcagttcattgatatacattacacagcctccttaagtgccctcttaatacccgaatgctctggaaggggcagtgggaagaaaagcagtgtgggagcatgtgggggtgggtgggggtagggactgaagccagaaagggagtaaaggatgggggtaggagagaaagccagagctagagttttcccagggtcaacctggggacagcagttcatggtctttatcactaatagttatcagaaccaactaggcaaagttaaaagttgaggggaatagaaagatgatgtgagagatatgccctccttctctttggggtcttagttaataataactgatttttgtttaatgatttacaaaacactcttacattgcaaatccatatgctctgcacacaatcctacccagttgggtgggcaaggtgggtgttactttgcaccttgtaatagatgagcaaactggcaaccagagagatttcaggaagtaaccaaaagtcacatggcaagcaaggtcttgactctcaattacatgttttttttcttaattcaccctacctccctgactctagctgagaagctgtataaacaagaaaatataactaacgtgaaatggtatgttcaggaccagagctgggggtacagacgtgaaataatcgcagaggtcagagaaagggtgagagatcttctagatgtttggagcagttcgaacccagcctgtagccaggatactaagcaagattatgtaaccaatttgggttttggaaatgggttctttgttcagcctggttccctctcaacctcaggactctctttgaactctcctaatggatgaaattggattttccacccatgaccactatttatcaggaatgcccttcctgagtgactttgcacctttacttcacactctgatagtgtgcacatctcaaaagacctataagacaattttctctcacattgcagtgtgccaaagctgtccaactccaggttcttcttttatattaaaatatcatatgacttttatcttccattcacaatatatccatattcatctcgatattttcgctcctcaaatctttgagtagaattcttgttccagaaggaagggtttccttctcgctggcacacctccatatacccgtatgggttcatacatcccaggttgagaagccatctaaagaaatctcaggcctgtagctagaatgtccctgcttctcagccacttcctcacatatgtgagctttattttttttttaagattttatttatttattcatgagaggcagagagagagagaggcagaaacataggctgagggagaagcaggctccatgcagggagcccgacgtgggactcgatcctgggactccaggagcacaccctggctgaaggcagacgctcaaccacccaggtgtacctcatatgtgagctttaacccatgctcaacagtatgctgtgttttcatttactaaatactatcctgggtgtgctaccacactaaagcaattatacagagagttggtcctaccctcaaagacactctgaaagaagggtggatcgagacaaaaatgtaagaaaaatagtactggatgactgtaagaggcacagaacctcagaatttcagaggaatcctgaatatggatccgctagcttcctaaaacagaacaaaataacggaaataaaaaaaaaaaaaacacctagttttacaaagtatcttaggcttggtgaggttaaatgacttgactaaggtcatccccagtttatggaaaagttcaggactagaacccatatcacaggctgtgtgctttctgacatatagggctcagcaagagtaaaaactaatactgtaaataaatattcacatttcctaacgaaaatgtaaatgacaggccacggaacggaaaaagtaagagacggaattacatagaggccaagcctgcaagttcagtagactacactggaagataaacagtcaactaaagcagggactcgtaaatacagggtgggacatttaaatgaaaccatttggagtcatgtaaaccgggactgacttcattatagcctcccttatggtacagaaccgcacgtcaaaactattgactttagtcttttgataaatgtgttttcttcatagaacccaagaggaatgtgagaaaggtttcggtaatctgagggcagtctggacatagccctttgaagctcaaagtgaagtgtgatggatggggaagccattacaaatgttttaaggaaagaggacaaagaaaattctggagccgcattaaacatcctacttcgttagccacatcatttcaccataccagcaagacccaagaggcccttgctccttcctgcctcagggtctttgcacacgctatcccttccctctgggatccttccccttcctctaccccctcatacctcactgactccctctcattcttcagctccagcttaccaggcctgacttcctcagagaaacttctatgaacctcatgagcttctctcaacaccccctacgttgcattcatagccttcactgcagtttgtaattatgtgtttgttggcatgattgcctttgttcagtgctgaactccgccacgagactgtaagctgtctgagagtagggaccctgtgcactccatttaccgctttgcctggaacaggggagatggccaatcccgaccggtagcaccaacaggcaggcgcaaacaggggcacggcagggtggcggggccacctagcatgagcccctgctcccccacacgctggagaagtcaggcaaactgtgtctctctggacccagtttcagttaccagcatgtctttctttttatgtcacagacacatttcctctctttccatctctctgcccttgaatctttgaaaccctcagacaacttctgagagaaaaggaagggtgtttagggtcctgtgacagggaggttcccccaacttggaccggaaggtggcagtagagggcagtggcaccctgggagtaacttccagaaggaggctcctggtttgagagagggactctctctctctctctctctagagcaagccagggtcagcagcagcccaaagccacaaaaactgactttaaaagtcctcctaagagctacgtctttcgactccccaaaacaatcctgccttgtgccccaggacacggcgcagagttacacacttaaagcagtttccacagaaccgcattcagttggttttaaactctggggaaagctggcagcctctttgtgggttttttaaaaaaactagttagagggacaattaaacctttatgggtcccagaatgtacctatgcagacgtaaataaggatcattcttcatcaccacagagaatccactttctggcaatagatatgttttcctaccttcacaggacagagttgagctcccacctgagagcctttatgatgagggcaggtgatggggggtcagcccgggcagaggtagaactttgttctcaaaatggacacatcacagaccttgggcttagctggtcttaaataaatcacaaactcccaaagccttcccagaaagctgcccagatttgaggccaagaaaactcgtcttgctacccaccccccccttgtgttactttgggccaaaatggtccatttgtcaaagagtcctgactcctttattcccacccttacaacacaatacaatgcattcacgtatttacagtgcagtgtccttgaatggtcggatggcttttttttttttaatccaataatatcattaaatgcaccagggagctaactttttaaaggaacctttgagtaaactcttttgttaagtgaatcagtcttttgtaaggcaaatcatcagccaccaatttgttttccaaatcagagatttcacataggagattttcttaaaccaggcccacttgagatggaggcctgtacgttttctttgatttttctgtctttggtaaagacgagctcttcctaaatagacagtcttgggtagggatgaaggaatctcaaacacttgagaagtaaatcagtttcaatcattcctgtctgtcatccataattctctagaaccaccagcctaaagcaaagtataatgatctcctgacaaagaatccggctgcttagattcgaaggccagtctatttgaagtcagtttcaaaagaaatgcaaagaatggggttttgaaaaaaaaaaaaaaaaaaaaaacttgtagatttttctactgaggccaaatacacagcatgatatttattgttttaacaattcgtaagtgtaccattcagttgcattaaataaactaaattcacaatgttgtgtaaccaacaccactattgatatccaaatttttcatcatcccccacaaaaaactctacccattaaacaacaactcttccgcccctcctcccaaccgtccttctcagcaccccataacctctattctactttttgggtctatgaatagggggatagttttagactctggctctgctttgggcctctttttcttcctgtgctgtggtgtggcgggagaagagagaaagtatggccaccctcttttcaccccataaactcttcccattgctgcctcgctgctcccctttcctccacctcccgggctaggagctgtggggcggcgggctgggcaggcgggcggcaggagttcacttggatggtggaacttgcagaggggctgcagcccccagtgggaacaaaaggaggtcactgggtctaagtctcccttactagctcaggaatggcaagaattttctgacttcaatagtctgaggaagtaggaacaggatgagtagatggctgctttggcctccgcaggcagcatgtggcctccactgagcacccatcaactcctgccttacacacatctgagatctgtcagggctaagagagatgggactgcaagggcaggcataagggctcccttgggtatcctcaaactccatgcttgggatttcttgcattgaaaaacactggctaaaccactcataaccccccctcccccagaatttacatttcttggatcctttggtggccaatagaggcacactctgaatgattcccatcctacagtttgaggtttactttgttggccatgcttagaaattctccaagttagcacttacccaccccctctcttccccccacatcccccaactctgcctccccccttccccaaatgcacaacccaggataagaggagacttggcttaggaaatctgatttgcaattggttcaagttctccttggggaccccagccttgcctccctaactccaggaaccgtgagtctgcctgccagggcctctagggcaactggagcaaagtggttcttggcagagaaacagctatggggtggagagaggggaatcacctcaaaagcaggaggcctgaattccttctactgcccacttgctggtgacctggggcaagtcaattttacagctctgtcctcatttccctcaagctgtgtgggagggccctccaactatgagaatttgtgataagagagagaaacaaggcttcctgatatctggaattctcaaaataggaatccaaatccattgtttctcattggcgctgacattcatggaagtatggctgcagggaggtagaggaggaaatttcggtaaagagaacagtggatgggtatattgtaggacaggttgagaataaagttttggttggatctttatgagaaaatgttcaacaggtaggcaggactaagcagctggaattagggagagagattgaaacaaatggataacaagaacagagtccagagagatggttaatagatgaaatagtcttaataataccagaaacaaatcaaatgcttagcatgtgccaggaccttggggagcccttcacatgcatgtgctattaccattctcacaacacccgtatgaggttgttaaaagatttatttttacacctgctttacagatgaggaaagctttagtatcctgctcaaggtcacacaaggaataagtggtagcaagacaaggacttgaacttggtgagtctaacctcagagccttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcatattgagagagagagagagagagagagagagagagaatcttaagcaggctccaggctgagaatggagcctgaagcagggctcaatcccaccaccccaagatcatgaccccaggccaaatcaagagttcaaggcttaaccaactgagccacccaggtaccatgatacttttttaaaagattgattgattggttgattgactgattgattgattaatttgagagagagagagagaatgtgtgtgggcgagagcaaggagacagccagaaggagagagagtctcaagcagactccctgttgagcgctgagccctggggctccatctcacgaccttgagatttatgggatttatgagaggactaaatgagataatataggtgatgcctctgagtacagtgcctggctcgccgcagtaagtgctcagtattaccgtggaacccatgaggaggtaatccaagaatcatgacccaagtagaaatcaagagtcggacgcccaaccgactgagccacctccttttttttatgtttctttatttaaaagaattgtttgggggtgcactgtgaggaagatatactttcaagggagaacacaggttctagaaggaatgactggggcagaaacacatgggagtgaggaggggggaggtccctgggggctgccataaaataccataaactgggaggctgacacaacagaactttattttctcactgttctagaggttggaagaccaagatcaaggtgttgacaggtgtggtttctcctgaggcctttctctttgccttgcagatgtctgccttctcgctatgtccttatatgcccttttctctgtatgggcacatcactggtgtctcttcctctttttttaaggacactggtcctattggattagggtcccacaatccttatgaccttattcaaccttaattacttccctaaagtccctgtctccaaatacagtcacattggttagagcttcaacatatgaatttggagacacaattcagtccataacactagtcttgtgtctaatgtctgtgactcagcataatgtctgtgtgattcatccattttgtggcactcattggtagttttttcctttttattgcagagtagtagtccactgtatgaatataccacagtttgtttatctatttatctatgatggatatttaggttatttctagttttttttttttgtttttttttttactattatgaataaagctcctataaatatcccagcgtgtctttttgtggatatatgtttttatttctcccttgggtaaatacctgagagtggaattggtggattacatggtaaataagtttaattttataagaaactgtcaaacatttctcagggtggttgtctcattttatacctccaccagcagtgtacagaagtttccattgttccacatccttaccaatacttgatattgttcatccctctcttttctaaaagctgttctagggtgtagtggtttctcattgtggttttatttgcatttccatgatgactaataatgttgagtaactttttttttttaatttttatttatttacaatagtcacagagagagagagagagagagagagagagagagaggcagaggcacaggcagagggagaagcaggctccatgcactgggagcctgatgtgggattcgatcccaggtctccaggatcgtgccctgggccaaaggcaggtgccaaaccgctgcgccacccagggatcccctgttgagtaacttttaatgtgcttatttatcacctacatgtctccttcggtgaaatgtccattcaaagcttttgcttggttttaaaattgcgttgttttcttattactaagttataagagctctttacatgctccaactacaacttctttatcggttaaatgctttgtaaatgtttttctctcagtgttttggctttttattctcctaatagcatctttcatagaggagaagtttttcatttgaagtctggcttatcaaattttctttaagaatcatgcttggcttaaataaagaccgttttactacttccttcccaatataaatgcctttttttttcttgcctcattgcactggttaaaaccagttcaaactatgttgaatagaagtgatatgagcagtatcctttatcttgctcctcatcttattttttttaagattttatttatttattcatgatagtcacacagagagagagggagagagagaggcagagacacaggcagagggagaagcaggctccatgcatggaacccgacatgggattcgatcccgggtctccaagatcacgccctgggccaaaggcaggcgccaaaccgctgcgccacccagggatctctttgctcctaatcttagagggaaagcgttcagtcttaccattaagtatgatgttagccataggtttttcatggatggtcctgatcaggttgaggaagttcttttctattactagtttgctgagtttttaattctgtttgtttttctatttcttttttcttttctctctctctctctctctgttttttttgttttgttttgttttttgtttttgtttttgttttttgagagagaggagagaggacaagctggggctggaggaacagaggaagagggagagagagaatcttaagcaggttccgtgcccagcatggagctcaacacagggctcagtctcatggccctaagatcatgacctgagctgaaatcaagaattggatgcttaaaaaaaaaaaaaaaaaaagaattggatgcttaaccaattgagccaccaggtgcccctggatgttgtattttcgtcaagtttttttttttcttcatctgttaagatgcttgtatgcttttttttcttattttgttaatattgtgaagtgtattgattttctaatgttaaatcaaccccactgaaataaaccccacttgatcatgatatattttatctttttacatattgttagatttgatttgataaaattttgtttggaatttttctatgttcatgagggctgttggtctatagttttcttataaatgtgtttgtctgatttcagtatcagagttaatactcgcctcaaaatgaggtgggaagtttctctccccttcagtcttttggatttgtatggaattggtatttttttccttctttaatatttgttgaatttaccagtgaagttgtctaagcctggagttttctttagggaaaagttttaaattagaaactcaatttagagagatacctgagtggctcagtcagttgggtacatgccttcagcttgggtcatgatcttgaggtcctgggatcaagccctatgttgggctctctgctcagtggggagtctgcttctccctctccctctgtgctttctcgttctcaaataaataaataaaatttttaaaaatatattttatttatttatttgtgagggacacacagagagaggcagagacataggcagagggagaagcaggctccatgcagggtgtccaatgcaggactcgatcctggtacaccgggatcacaacctgagccaaaggcagacactcaaccactgagccacctaggcgtccctaattaaataaaatcttaaaaaaaaaaaagaaattcaatttagatattattcagattattgattcttatgaaatgagtttcagtagtttatctttcaaggaatttgtccattgtcttatgtgttggtatttattgttcattgttgacaatgacaaagttgtccaaaatattctcttatcctttttttaacctataaagtctgtagggatgtcatctccctcattactgatattggtcatttgtgtctcctctccattttccttatccatgtggctgaaggtttatcaattattaccgatcttctcacctaactatcttttggttccattgatcttcattgctttgctgtagtcaatttcattaattaattaattaatttctgctctgatttttactatttcattacttctgcacatatcaggtttcatttgcttttctttttttagttctttaaggtagaagctgagattattgacttgagaactttcaagtaccaattttggtaggatgagttttattttattttcattccattcaatatacattctggtttcccttttgtattttaattcaaccatgggaatttagaagggtattgtctagtttcaaaatatttggagattttccaggaatctttttgtcactgacttctaacttaattccattatgatgagaggacatattttttatgacttgagtcttttaaaattattgtgatttgttttatggcccagaatatggcctattttggtaaatgttccatacgcatttcaaaagaatgtacatactgctcttgttggatggaatgttctataaatatcaattaggtcaagttgattgatgtttttttttttctgctatacccttgattatgttctacctgtcaatatcatttattaagagggactgttaaaatctctcactatagttgtgatttgcttatttgtctttgccattctgtcagtttttgtttcatgtattttgaaactctgttactaggtgcataaacttttagaattaagtaatcttgatgaactgacccctttatcatatgaaattatatatatatatatatttgatattctttatacctggcaacattctttgttctgaaatctactttttctctttcattttttaaaagattttatttgtttatttgagagacatagcacgagagagagagagcgagagagagagagagcaaacatgagttaggggcagaggggagggagaagcaggttctccgctgaccagggaacctgatgtggggctccatcccaggaccttgggatcacaacctgagctgaaggcagacgcttaaccaactgagccacccaggagcccatgaaacctactttttctgatgttaatcagccttcttcccttcctttcttccttctttcctttctttttctttttattttgttgcacaactatgttaaatttaatagatcatggacatatttccaagtcatagatctcttttttgagataaaattgacatatagcattatagtagtttcatgatataacatattgattcaattcaaaatggtcaccacattaagtctagttaacatccatcatcatacagttataaatttttttcttatgttgagaaatttttaaaaggatttatttatttattttaggggggttagtgaggggagaggaagaggcagagagggaatcccaagcagactccctggtgagcacagagcctgatgacccagagatcatggcctgaacaaaaatcaagagttggatgcctaaacagtgcctaacctgagtcacccaggtgcccctcatgctgagaacttttaagatctactctcttatgggcagcccgggtggctcagccgtttagcaccgacttcggccgggcctgatcctggggtgccgggatcgagtcccacgtcgggctccctgcatggagccttcttctccctctgcctgtgtctctgcctctctctctctctgtctctcatgaataaatacgtaaaatcttaaaaaaatatatctactctcttagcaacttccaagtatacagtacagtagtattaactatagtcaccatgctgtacattacattgccaggtccatctttctttttattaatgttagcatggtatatcttttcctacccttctatttttttttttaggattttatttatttattcaggagagagagagagagagagagagagagagagagagacaggcagagggagaagcaggctccatgcagggagcctgatgtgggactcgatcctgggtctccaggatcacaccctgggctgaaggcagtgctaaatcgctgagccacctgggctgccctacttttttttttttttttaagattttatttatttattcatgagagacagagagagagagagagagagagagatacccttctacttttgacatatctgtgtctttatatttaaagtgtatttcctttacccaagatcacatagtttatgccacacagtgatggagcgaggattatgagctcaatcaggccatccctgtagtccatgctcttgacctcaatgatatatgatctcctaaagattgtcttgaacctacttttctttatctccaacaccctatccgcactcaagaccatctctctcctgatatacctacatcagagcagaatgaaaacttttcctctacccttttagcttcagtagctagggactatgaattaaattgacaaaagacggactaacaaaaaagacagatttttattcaagtactaggcagttagaatttgagagcttattaccaacttaataagggaagcagagaaggtgaaggttcttacaaggaaaacaaatgacatttaggaaagatgaatggacccacaggagaactgatgagaggtattattgatggtttggtgacaatgtctgggtttatcaggtgataaaagccaatctttccctggttgctcctgagaaggggatttaggacaactgagttattttgggaggccttgcttttagttaagggagttcaggaaaaagcctattttcagctcaaaataattttcatgccacagtggcatatttggatccctccacctgtaacagcccctggcttatctccctgctccctcttactctctccagtcccttctccttgcctgctatagtgatcatttcaaaatgtagatatgactgtcttgatcccatggcaacccacagtcttcccttgcttaggatgttccccatacctccaaggttgaaaaacaaaatccctgacaagatgtgcatgatcctgctgctctgccctgcccctgtctgccccctgccctctctctcactgacctgtacccaggcctgcctgagggctcctccaccagaggcatttacctggccacttttgctgaggcatctcctccttctccccttggtcatactgctaacctcgttttcccaggaaggcccactgtctttggacaaggtaattccccccactgtaaactttctgagccccatgaccttaccctttcagcattgggtgtggtggccacaggcaggactccatcagggcagggactgaccaggtggatgtcagtgcacatgtgtctgtgtctctagggactcaagcatgactggcacacagtgggcactcagaacatctgttatgagtgagtatggaaatgagtcatctgaggaaagaagggccagctagggatgaggtgaggcatagggcagaacttccaaactcactgtgtagagagatactctcagcatctggaaaagacaatggatccctgcctggaaccttcctttgaactattttaaataatatattgcattacaaaaggagtactaatactgaaatgcaaataccaaaatataaaaatacagacacatttgtgattaaataaaataaagtgtgtttcttataagcaccatataatttggccttgttttttttatccaatctggcctctgccttttaattaaaacatttagacttgttttcacctcagagaaatacatggatttttttcttgtttgatttggtttggttttgtggtaaaatacacaaaagagaatttaacatcttaaccattttaaatatacagttcagtagcgttaacagtgtcacattgtttcgcaaacaatttctaggactttttcatcttgcaaaactgaaactctacccataagcaattaagtccttctttgcccctcccccaacccctggcaagcatcattctactttctatttctttctttctttctttctttctttctttctttctttctttctttctttctttcttctttctttctttctttctttctttctctttctttcttcctttcttcctttcttcctttctttctttctttctttctttcttctttctttcttctttctttctttctttctttctttctttctttctttctttctttcttctttctttcaagattttattcattgattcatgagagacatggagagagaggtagagacacaggcagagggagaagcaggctctctgtgggaagctgatgtgggactccatcccaggatcacgccctgagccaaaggcagatgcttaaccactgagccacccagatgcccctgtactttctatttctaagactttggctactctagtaacctcatataagtgaaattatacagtatagaccatttattttttatttgtatttatttttttattttaaagactttatttatttattaatgagagacacggagagaggcagaaacacaggcagagggagaagcaggctccctgccggggatcccgacatgggactcaatcccgggattccaggatcaccccctgagccgaaggtagacacccaatcgctgagccacccaggtgccccgcagaccatttatttttaagcgactattaatatgattcaactgaagtctatagtcctgctattttacatttgtttcatttctttttttgttcctttttttctctttttctaccttctttttgactgagtattttctatgattccattttatttcctctgttgggcctagtactataattctgttttattatctctgtggccactttagggttcaggatctatcttaatacagtcagccttggatattataccacttcacatataagaattccactataatatatctgcacttctcccctcctgggctgtatgcttttgttgtcatattttttaaagatttatttatttattaatgagagagagagagaggcagagacataggcagagggagaagcaggctccatgtagggaaccccacgtgggactcgatcccaggacctggatgacgccctgagccaaaggcagatgctcaactgctgagccatccaggtgcccctattgtcatactttttcctaatatgtgtgtattaaaccacaatctttttgtttaagcaattacctttaaaagatatatacacaattaaaatatgtgtgtgtgtgtgcatgtgtatgtgtatttcccttagcatatatcttttccagtgctcctcactccttaggggagactcatggttctatctgatatcatcttccttctgcctgaaggacttctttcacgtttcttagagtctagttctattggtgatgaattctgcccaaagatatctgtatggtaccttcatttttaaagatatttttgctgggtataggatttagactgaggggtttcctttttccttttggtatttaaactattttgctcccctggcttctcatttgcaccatttctagtgagaaatctgcagctatctttatatttgtctctctgtatgtaacatgtcttttctctctagccacttctaagatgttcttttaaccacaagtattgagcacttggatcatatgtgcattggtgtagttctcttcggatttcttgtacccgggcctcactgagcttcttggatctgtgtaccagtttttatcaaatttatttatttattatttattaaagattttatttatttattagagacacatagaggagagagagagagagggaggctgagagggagaggcaaagacacaggcagagggagaagcaggctccatgcagggagcctgacgtaggactcgatcccggggcctccaggatcaccccctaggctgaaggtggcactaaaccactaagccaccggggctgcccagttttcatcaaatttagaagaaatatggccattatttcttcaaataatttttctgtattcccacctttttttttaaacaagggcctccaattatgtatatattgggctgttcaaaattgcccaatagtgcactgatgctttctttgtgtttttaactttttttccctgtaaaattttgaatagtttctattgttatgtcttcctgttcactgaaatgttcttctgcaaattctgatctgctatgaatcttgggcaactcacttatagtttctatctctacaactttgatttgcatcttttaaaaatcatacatggttttgaacgaatggaaaacagttattatagctggtttcacatcctggacttccaattataacatccatgtcaattcaggtcaatttgtttttaaagatttattgatttgattgagagagagagtatgtgcatgcacgagttgggggtgtagctgaggaagaaaatctctaagccaactccaactgagcatggaacctaatggagagcttgatctcaccacccatgagatcatgacctgagccaaaaccaagagtggactgcttaacccaactgagccatccaggtgacccagttcaggtcaattttgatttctttttctcctcattatgagtcatatgtgtctctgcctctctctctgcatctctcatgaataaataaattaaatctttttaaaaagtgcaagaaaaaaatttttaaaaggtgcaagaatatttatagaaatatcaaaatattcagcacccaccaaggtaaaatttacagtgtctggaatgtaaacaaagattatcaggcatgcaaaatatgactcagtaactcccctgtggggagcctgatgtgggactcgatcccaggaccccaggatcacgacctgatgcttaaacactgagccactcaggctcagttccatattcttgcactttgttatgggagccagttggattgcttggaaacagtttgttccttttagtcttacttttcagagctgttagatgggacgagagcagtgtttagtgcagggcttatcatttcatttcctactattgaagctatacctatggagtattctacccaatgttccacgaatggctggggggaacagacgctgctcccagctctgtgtgaacacctagctttcggatgcttctttccccggcctggggtagtttcctcccacttatgggtctatcatgctgaacgcctgagggagaccctctgcagatgtccagatctctctgcagctttctcctcttcagtgctctgtcctacaaattctggccaccttaatctcctcagacttttagctctgtcccagacagagaattctcaatgcaaagaatgtgctgagctccatctagattctctgcccatgctgcagcctagaaaccctaagacagtaagcttgggcaatcatagggctttgctttactttcctctcagtaactgtcctatattgcctgatatggtttgaaaaccattgtttcatacattttgtctagttggttggttggctgtttcaggaaggagagtaaatgcagtccctgtgctccattttgttcgggaagcaaaaatccttctttcttatcctttgtcgcaactagaacagtgctgggcacgtggctggttcagtcatctatggcttcctgaattaattcattttaaaaatttttttaaatttattttgaattaattcatttttgtaagcagtggtatccaaggaaaagtttgtttagaaattcagttgttgagatgcctgggcagctcagtggttgagcatctgcctttggctcagggcctgatcctgaaatcctgggattgagtcccacatcgggctccctgcagggagcctgcttctccttctgcctatgtctctgtctctctcacctgtctctcatgaataaataaatacaatcttaaaaaaaaaaaaaaaaagaaattcagttgttggtgactgggttaattttttacatgttcagtaacaaactcttgtaattcttactcagatgaagaccaaattcatttacgaaattgcatgaaggcagatcaaaaaatttttggaaatatactatatagcaatgtccttgaaattcttgcttcatgtagacttgcttttatttcttttagactatttcctaacttttagaaagtgacaaatctgagctcaacacctttatggcaggatccatgtttactgtcactacgagagtctccctgggtgcctggcacacagtaaatactcaatacgtattcaaagaatgactgaaagaatagaacactttttgggtagaatactttttacttcaccaaacaatattatttcagtagcatctctatcaggtatacctatcctcctcttttataaattgcagctctacttatggtagatctatgcctcttctgctctcttcacaataagctctgttgcccttactttgtaacattgttttgtcaaatgaagttaacacaaatcaatatttctttctctataagagaggccaacattttgatttggaaatcttaactgaagaggtttggcttgtagtcttgaaatcgtcagaattgcataatcctttgacttctagcttaattcttgtggattcttggggctctagccacttgcctggagctctccccccatctgtcatgcctttctgtggtccggccaaatcttgcaaatctttcaaacccagcttaagccttccttcctctgtgaggcttcctcctgccatagcaatcttgccttcagtctgctccttggaacttaattctttcccaattcacttggtacctcatcaaccatactccttgtcatatcttttgtgtttacgtgggaatgtctgtctcaaccagcccatcaccacctttggaacagagccccacatgtgcttagcccaggaataatactagcaacaaccaacacatattgagtacttactgtgtgccagtggttgttctaagagctctttatgcatgacttcgattaattctcacctcactccaaggggatggcgctatcaccaacctgcttttcagataaggaagctgaggccccaacacttaatcatttccccagggtggccagcagagtgaggattaaaatcaagcattctagtttcagagcctgggccctcagccctgctctgtgccatagcactggggatggggatggtgggggggatgttactaggaactcaatacatctctgttgaatgaatgtaaacgtgcaggtctggcctacgcaggagggaaacttctggagaagctctgttctgttactctcactgccttactgtttcccatcatcactcctgtactgttgctgttgttttaggagcaagatcctgtgtggtccaggacgaaaaagagaggatgcaagtgaagtgcctacacccgtctcctgccttcctcccttgcaggttgggcaaaaagcaagttgggacaattcttcttcctgccaccccgcagctctcagagccagccagcaaacttgaatgaggaggagcagaaagggaggtgggggggggtgggtagtgccatcctcgggctcactggtttctgggacctgtgcctcccaaggctcaagtcaatcggatgtgcctttagtttgccggaatttggccggatttacagagataagatcactctgacccttaattccccaatgtaatttatgggcttgcctcttgtgtgctgcaacacgtctggctgtacaaaatctcgtaattatttatgtaaacacagcatctgcctttgtggattataattggacttgaacagcaagaagtagggacttacaccattgggacggtgctgaaacccttcttttgaaaactctcacctgagtctttgaaatcttccctgtggttcatggatagctttaaccagaccaaaaacaaaattttttttccttcctctttcagcaggcctggacaaatttatccccagacaccaccaggttctgtaggtcctcttggcaaatggggtaaagataccccagccatcctggctggacccacacagagaggacatgagccctggggtagaggcttccacagatctcctcactgtctgtcgggacatgaattttatacccccactaagaataaacaggattaggaatttaatgctgtttggaaaagaggagaggtggctggttgaaagagaaaggtctttgctttttattcatgctgtgagttcctcgggaaccttcactgtacatacacatacacatacacacacacaagagccaggaggattagaggaaagaaaatgagctgattgaaccagatggttcaggaagcactcccaggaggccactggggtggatgaatctgcatctttaaataacattaatttctgaaaggcccaaattgtttcctaaattactgcactgaactcttagctttcatctatttttatggtgcctctcctggttgaaggtgggagcgagctttggggaaattcctcatccttggtgcagctggtaagtgatcggtttcctaaaggaaaaagaaaatctttcagaaatcaaggtcctttggaaaacggatttcagcagagacaaccctcccctctccccaggagtgatgtgaacaaatcatccagtcctactgccaactgggacactcatttcctcaggagccaggggcaaaccaattaacctcagtatccccatctgtaaaatggggttaataatgcttacctgctgcaggagtgctgtgaggttttaattgggtaatggctgtggagccctttgatgtagtaaattttattaacttccaagggattccctgaggccagaaaaaagcagttaaagcccaagaaagaagaaaggcattgaaatgcagagctcggctaagctttcacctccagctctaatttcaagaagtgcagacaggagttgggctgctccagtgggagtggaaagctatgaccaggactgaggctgtctgaatggcatttgggaagggagagcctgcaaaccaaccatctctctgaaggagctgggctttcagatctaggaggctaaaggtaaacaaataaccttgcttgatcgaaccaaatggagatcattctttgtctccacgaaggtgcttttctgagagcaagtctccagtaagggagttattttggtgttaatccaaggtccttggaactgaatttagaaacccccagcttctggcttcctgcttcccaacaattaaagagagaactcaaggtctggcctctagccagggttcctgagcagagaaggcatgcggaagagcatcggccaggggtcagagaactggggcctctgcgagtcccatctattcactgagagctgctctgtgcctcaatttcccgctttgtaaaaattattttaatcagacatctttaccttaagggcccaaataattaagatctggaagtgaagtgcactaacattattataaagcatgcttagagtgttagctgttataattcaggacaaatccttctttctttcagtaactcctaaaaaccccagttattggatgattattctccaagccaactcattccactcaaggaatgccttcttcctctctgactctttgattgccctcaacatattcagtgcccgctcatcagtcaacccaatggagcatcggttatgaggacacagctcagtaaggtgacccactcgtcccagtctgcctgagactgtctcaggtttagcactaaaacttttgtgtgccaggaacccccacctcaatcctgggtcagcctactgggtgccaggactggtgagagactgttgttactagttcctgacaagcagaacccagcatcaggacacaagaggccccgtagtgtggcagaggagcactgagcagggagtcctgtgacccagctcctgctcctggctctactaccatctgctgatctcaaatcagccctgtggccccagctttcccagctgtaaaaagaggtgggggtgatgtgaccccttttcaccttttttgtcctccagggaaaaaagaccacaagaacttttccagaaacttgcccagcctccagggggatggtgggtggttttcaacaaaaggggccagtagtgggaacatgctggggacccaagtttctgcttgtggggctcagcccctagtggcccactgagtctttttgtgccctttctctgtgagcagcgaacatatggctggggaatggggctgttcggaacagcagagcgatgcacatagctctttaggccactatccttcctaaaatgagcacattctacccctgagactcaaaacttttcttttccaaggctgtgttagattcaagtatggcactatggagcgttcagtccaaaaattaaaacaatttaaaagacctgcactgtgcccctcaccacaatttactaagctaaccattttttaaaaaaggattttatttatttattcatgagagacacacagagagaggcgagacacaggcagagggagaagtaggctccccgctgaagcctgatgtgggactcggtcccaggaccccaggatcacgccctgagccaaaggcagactctcagtcactaagccacccaggcaccctacaccatttttaaaaacatattttatttatttatttgacagagagagaaagagcgcgggcacaagcagggggagcagcaggcagagggagagggagaagcaggctcccgtagaacagggagcccgatgcagggctcgatcccaggacccagggaccacgatccaagccgaaggcagacgctcaactgactgagccatccaaggcaccgcccaccccccccttttctggtgtggttttctgtaattgtgttttactgtacaatataaaggtaaagaaatttttctctgctgctaaaagaattaaaaccacattaattatacatatgttttgtctctgctgcacagattccccagccgaggcatggcatttcccttttgtttgagccaggtgggggcaggaggggggctagataatcaggactagattgttttggtggggcaatgtacttttggggggttgattctcttacagctgcccttgttgggagcttaagttaacaaaagcagccttctcatgacagatcagaacctggtcttcatagcattaaaaaaaaaaatcacattgagaagcaatgggaaagaatgattgaatcaaagccgccctctgctgcttcccccattccgcccccatttgaaaacagccctgtttcaatttcatcgctgagctcagcctgcctgctccagacgtccagacctcacactctataaatcgtctctgcccttgccccagagttgctgactatatgtatttggggcccggcattaattccctcatccttggctggtgacattaagatttgtaaccgatagaatgtgtttttaatgtgtttcctgcaggttactattaaagaaatctaattcttctgaacttgcaaaaggttctgcttccatttatataaaaaggggtggggggcggtgaggggtattacaggaagaatttccctgcagcctccagatggactgggcagccagaggggcctcggctcagaatctcagctgagctcttgccacttcctcttcctcctccccgccagtctgttctcctccctgcgccttacttttcctaggtatgaaatgaggataaatatttgtctacaaagatgagggtgttgtaaggattaattggttggtgcttcgggaagtgtttgaagatgaaagaggctctctgcagatgctaagtaaactcagaacgtgtctggttttaatgagccagatgaagccagtggggatggctgaagattaactgtgcctagtccagagcctgcctgcatgggctgcgtaaaaactgggtggcgctccccgctggctccctggctcctggcatgttggtctctataaatatacatgaaggaactgaattgggatctaacccagactctcacgtcacagagagcagggcgtcagacttcccgaagcatgctgactgcctatcattctagcacatggcttggacaagctcctgggcctttccaaatctcagctcctcgattccaatggggatagtcagagtcccaatctcctagggttgcgatgaagatttatcataaaaatggccaagagcattgagcgctcgctaaatgtcagacaggctctaagcactttacacctgcgaatgcactgagctctcacaccggtccaaggaagaactattgctgtcaaccccattctacaagtgacagaactgaggcagagaggggttacttgataacttatgcaaggctcagttcttttctttgtatctctccacctcctcctccagccccacaaccaggctagaccactgctcttgaagtgcaatactgtgtgttacactgagagcaatgcgcacatcccaagtgcacaatgaataggttgagggcttctcagactttgcctgattttcccagccggcagagagataccccagttgggggtgggtggtgcatgatacaggataggccctgggaatgaaggagctgggagggaagggaccaaagtaggtaactaacgggaggatgccaggtgtgtatgctcccagccaacctgcaggttttagtaaaggcctgttcagagtgatcacatctgggacccgtgatacttggtcaaaagtagctatgccggatcctggtacctcaaaggccatgggagctatgaggtttaagtggtgaagtatgcataggaactcctgggatcgtaccacagctgaagagaagaggatgttggagggtgtgggctgtaggctgctgtttcaggcagtcaacaaaccaagggaccagaaagaagcaaaataagactctggcccaagaagtcctttgacttctgccagagagtaaaccgtaatctgtggaagcatgatttcacaccccagcatgtgacatcacagtccgggcgctgacacaggaaaggaaccagctaaaatataaattggggaagcctctggctagaacagaaatatcttcagcaactgctgctggtgatggaaaggtggaaatggaattttgtttaaatactatgttattttgaaaagtctaatgtcaaagtccctttttaaaaaagagttgactctacattgaaattagttggtgtttccacacccacatgttgactaaaggccttggaaaacaaacatcctggtagatcctgattcaaatcacttgggagcaaatgctttaaggtacgatcccagagctgtgagcagaggggcctcgccaagaaaaaccctgcgtctgtgtttatgaaaaggtaaacagatcccaaacggaggcccaaatcctagctggctttgagcacaggccctccagggaagaacccatggatttgaagcaagtctgagcatggcttctctgggaccccggtttgccccacttctctgtgtttctgagaatggcaacttggagtcttctgcatgagcacccgctaactgccaggccagtcactgcatctgcagcacagcagtgtgaaacatgtgcattaatgcctcaatgtcccttttctccacgtagatatagggcaagcagtgcgacctatgtcccaacttgccccaaacagtctcagtgtatgctgtagtcccagcataattaatgatagcttcccccccctttctccaaaatgccccccatttggatgataagttatatatggacatctaggttaagggaactgcccaaatccacccagctggtgagtggcagaactgggattcgaacctgggttttctttggttcaaaaagcagacgctgggggagttcctcctcattcacaataacaaagcttgtcagaggtgttaactgcaaagctccagacaggacaagccctttgggagctgcatgcctgcttgcgccgcctcacacccaacctagagcctctggaagctgccttgtgtgtctctgtgcaggaagcagcacatcagtggtgtcaggctcagcagacaaaacacaccctcaccaacaacccaatttggtgttttttgtctgctgagtgtttctcccagctcccgcatgataaaaatgcaagaactggctaccccatttggaccaccagcccagtttctgaacccgagcctgcaatccggcaccacgttagcccacccccctaagaggacctccttccctaggaagactgccctggggcccaccctcagtcttctctccatttcttccgtttctccaacacttgcccccgagacatttaagggcttgcctgtcgttccaagctcctgtgaaccagctgtctgtttcaggaccacagaaatgattcaatccaaactcctttttaccagtaaaggaactgaagtcccaggactcctgggcggctcagtgactgaacatctgcctttggctcagatcgtgatcctggggtcccaggatcaagtcccacatcgggctccctgcatggagcctgcttctccctcttcctgtgtctctgcctctctctgtgtctctcataaataaataaataataaaatcttttaaaagaaagagagagacagagagacagagagacagagagaaactgagttcccaagaagtcacgtgactggcccaagggcatagagctgaaagctgaagccagaagaccaggtctcacaaccctgaggccggtgttcttccaagctgggttggtcctcaagttggcctgtggctgtccagtgtgcgacactcctagtccccccaggagaagttgttcatgtgatgaacttgttgggcgctggagaccaagatgtgtctgccctgcccatttccctcagaccttgaatctgccaaaatctcagggttagcagcagggtccttcactcgatccctgactgaatctacttgcctgccgccctgccaggtggttacacacagacacactcaaggtcaaagaaaccacccctcccaaaggggcctgtggtcttcagacacgggctactagaaatgtcttccttgtcctgggtggatgatgatgattcctttcactcttcagccttggttcccctcaaaagactggacgtagggcaaatgtgaccctgctactcctccacatccagaaaaccattgctctgtcaattattcttcacatgatgttgcttcggcgcagaacaggtgcagagacccaaacctgaagctggcccccaacttttctctgctgtgtggcctcagacaagttgcttcacctctctgaacttcacttggctcgtgggaaatatggggagagcatgagagtgtttcctttgttggatattatcaggatacgatgaagtaacccatgtaataaccaactcaggtctggtacaggaagcattcataaactgtgacattaatagtctcacttttcaacctcagacttgatttctctgaatgcaacaccaaagcttcagtttctcagaaagccaccaccacatggacaactttcatcatcagctacaacccatgtccctcgtcctcacacagagctgctaatacagttcacccacgacctatgacactcacagtcttgctttgttgtctccctccccacgcaggctggcagcttctcagattgtactctatcctatgagaggccgtctatctgtctttgtggctcatcaggaccatccttcaggacctgtgatgtgcagagtgggggagacaagaaccacgtggaaaccacaaaggctgcaggcccataaaagcccacctggctgcccaatgaggtgacccctttaagcccgactggctgtgtcgacgttccacccacaattgtctgcagaggagcccttgtgcccctctttggaagttcagtggagtgaagtgtaatctaagtgagctgggacaggttttgatatagcagcttccgagacccggagcctcccttcagcaaagccattaatgtggctacctgagctggggctgggccttccaagctggatctgctagcctttctgctggcctttgatcaccagacagtaggatgatagggctcaaagggttagctccatcccaccccctggtttcacagatgagaaaattgagacccagagaggggaagcgatctgcctgaggtcacacagccaatgaggggcaaaaccagtgctgggagctctcggccgcacaggccaggctatcctcaggctgtacagaatggtgcgtggtcagcgagaaaaagagggaggacacagaggacaccacaagtatggaaggatcggcatctttccctggaaagcgctggcaggccctggtgcccggcctgtgtgcagggccaggcctgctaaggaagggaggaacggggtaccagggtggctcagcgattgagcgtctgcctttggctcagggcatgagtctggagtccagggatcgagtcccacatcgggctccctgcatggagcctgcttctccctctgcctctgcctctgcctctctctgtgtgtctctcatagataaataaataaaatccttaaaaaaaaaaaaaaaaaaaaaggaggggagaggaatagcagcacagggttctcgagcccatgtgcatgttggccaggaggctagcagggctgctgtgttcccaactcccaccccaaggccttgcagagcgggcaggtgcttctgtgggagcgttttgcccaggaaaggggggctttgaggtgacttggataatgaatagggcaaggccagaatcaatctcccggtggttgtgaggatgaaatatgtgcttaggatagcacctgacaggtactccagggctggtcgctgtcctcactgatgccatcaccattcccaggacatgtgtcatcctccaccaccctcagggccgattcagccagccaggccacatccccaccttcccttgtctggggagaaaggaaggccattcttgccaagggtggacttgtagttgggctccttgcccagatgtccaaacccactgtcagagggccataggaacacccctcggaaactctgggctgataggcagccccccacattgggtgggggaggtctggctgcagtgcccagagatgtcaggctgtcccctggctctccacatgcccctctgagctcccagagcacctgagggagggaatcctctgtcctagacgtaacccccttcctggctccctggggaggcttctcaggagtagggggctgggaaagggtgccccgtaccccaaatgccagcaggttccccccagaactagctataagggtaattcctaccctctgagtgagttggggcagggaggcactggccacctggtccttcttttcagccttggaaccttggcgtatggccttccggcagaggactattgctccagcgaggtctcgctcaggctgctgtgagtatgaggtggcgttccctggggctgatgggatggagagggccagagcccaccgagggcctccggggaagccttctataaacgacctgcaggcacagtgtccagagtttactgttctgtatgttctagatctgacttcttagcttcctctgagagtcttctctctttgaaaaccaaacccaggacatttcctccccataaaactgctcacagcaaccagcaacggacttttactgaggtcacacaaaggggtgaatgaatcatgagctggttctcccccttggcagcgtcccagcatccctctctccctcccccgtcctagagtaagtactgtgttttaacatcacattgatcagtggagagacagggacaaagaagagctccctcctgtagacaacacctctcacacagcgtggaaggtgcccccacagagtggcacagatgtgtagagagcacagaggatagggacctgctcacactgaaaagggtatagtcagggaaggcttcccgtaggaggagatgtctgagcagtcctcagaagggctttgagccagaaggtgcaggggggtaaggatttgcaaggctattaaaggcagcccagcccaagggggctgcttgaataaaggttgcagaggcaggaaggcacaggtaagcctggggaccactgggagatgagcagggttggatgtgggccatgaggggagcaaagacagtgttggggtggagacaggagcagggctccatgtgacaggtgatcccaagggcagtggcatcctcatgaggcatggtttctcaatcataggagcagcatggtgtagtggagtctttcaggcctccgactcacacctggctctatccctccttggctggctgtgagacatggatgacctggacctcttggagctctgatcctctcttctggaaacacaaggatcatagtctctctccagtagagctactcaaataattaacgaaataaaagcagtatctacgcaaacccctagcacaatgcctggaatgtaaaggggctcctcggggcaggtttagtcatttctctcctttatttacattcacgtctcctcacttgtttcagactctgctgtcaggaaagcagtagtgattgggacgcctgggtggcttggtggtgatagggacacctgggtggctcagcggttgagcgcctgcctttggcccagggtgtgatcctggagtcccgggatcgagttccgcatctgcttctccctctgcctgtgtctctgcccctctttctctgtgtctctcaggcataaataaaatctttttttaaaaaaaggaaagcagtagtgataaactcattatggaaatgaggatatagtctggccactgtgacagagacaagttggaggttatttgtctctcacagagcagttgaagcataagggatagggtagatgtggtgcctccacaacattgggcacccaggctcctctgtagttattctgcccccttgacccacggctttcagccaccagctcctgacactgcgttcacattccctccggtgggaaggggagaaaggaagcagaaggcccactcctccctttaagggtaagtggcgggtgctcatgttgacacttctgagtattcaagtcacgtgcccctggccagccttccttctggggcctcacctagctgcaagggaggctgggagatatggtctctaacctgacagttaccaacctgatgagattctacacccaccctctccccccaggtgacacctggcaatgtccagagacatttttggtcacatctgggtgggtcatggagagtagagcccagggacgctgctgaatgtctgacactgcacagaaccgccccgaacagggaagaattctccagcacaatgtgcataagagcgccaaggtcaagaaaccctgctctaattgggcagccagagcttgggggttctgttactaaacgaatacatagggcaatagacacagggggccagcagcaatgtcgctacagttacagacacagagagtcacgtgtttgtggaggattaggtgatatcttttcccagcgtatctctcttcagcagggatcaaagctttaagtcaacgggctctgagaactatcaagaattagcccacaagacagggaggatttgtggctgggcagccccaaaatctcagcccctgggtggcccacccagagccgtgccaccagggaggctggaacccacaagccgcccaggaagacagggccccacaggtggggttcgctgccttgccctgaagcatgtcccccctcctgacggttttccttgacagaacttgagaccttgtaaagcctatttcggattggctctgtcttccagggagatgaaaattgagctgagccctaaggaggatgagagataaggggccttcatttccaggaaagacagcactgtagaaccttccggggcatttacctggcagcgccgaatcacctgccttcaatcgcggcaagagagaggagtacagatgtgggtatatcccaaggaatgatctcacttaccctaattgagtgtactttctctgattcattggttttagtttattaggcatctacaatattccagagactgtccttcacccttcacagatgctacctcctttaatctctctatcggctcccaaaagaactactgttatccccaggacagaggggtggagagatgaatttgcccgaggccacaagctggtaagatgcagggagccaagttttgaccttgggaatgtctggccctacagctcacgctttttccacaccacctccagccacaggatgaccaaatggggctctgacctattgtcaaatgactgcacttccaaggaggaggtccaccccatcctggtcatttgctccactatctcacccataaacaaacctcagtctgtggataaatgctgcaaagcatggcatcatccgttctgtcattccagcgttggggggggcgggggaggacaggacaggagcacagagtggtcaagcggcttcttcaaagccacacagcaagtcagaaagtgactcaaaagctctgccttgtgcggctttattgaataaacaaacagctatggtgccgcagccccagccaccctgcggctttgccagctgagctgttgatctgggaagaggtccaggagggaagagactccgggttttcatagctgtgggactcctgggggctgtgcagaggaaaccagcaggggaagaaaggttgtttttgccggctcgaaggaagcagcatgactcaaggacacacgtgctccagatccatcgagcagagaggcaccattattagatagatgctcttttgagccttaaccacacgcgatgccacaagccagccagcatttgtcaacaggaagcccatcccagtgatgcgtactctgctccctcactctggttgcccagggcggggggtactgcttgggggtcagtgggaaccaggaacaaggggctgggccaccagaacgagggagccaagcccagggatgaccttcaagcctctaaggaaggcagttgtgtccagcagccaggacctcagattttcccaggccaggtctaccacgaagggcctgaaatagctctgaggttccgtgtccgcagggcagggagggcagtggcagggactgtgggcagtgggaaggagcacagcactgctttgttggggccgcaaagagctctgtctccaccaggctgtgccacctgccagcaacatagctgggcagagatgttggctcgtggctgggcttagcagagagaaacccattcgttaggctatgaaagttgatgcagcgaacctgaaagttctcaccaggaaaacaatcagacaagccaaaaggaggaacagtctgcaaaataacagcccatacccaaaatcgttgatgtcatagtggcattattcctaatagccaagaagtggaaacaacaccagtgcctatcagcagatgaagagagaaacaaaatgtggcacatccatgtcatgagttattaagctatgaaaaggaacgaagaaccgacacatgctacaacctagatgaaccttaaaaaccttatgctaagtgaaagaagccagccacagaaagccacatattgtagggttcagtgcctgtaaaatgtccagaataggcaaagtctatggagacagaaaatagattagtaaccactgtaatggactggggagatggggtaatgaggagcaactgctaataggtacagggctccttttggggtgattgaaagttctggaattatatagtggtgatagtggcacaattttgtgcatatagtaaaaaaaatcactgaagtgtacacttaaaagggtgaattttatggtctgtgaattttacctcaataaaaaatatttttaacattgtaactaaatgcaacagtgtggtccttgattggactcaatattgggggtaaaacagttacaaaagacattgagacagggacaggtgaaaataagcattgtattggatgctagtattgtatcaatgtcaaattgagtttacactgggggtacctgggtggctcagtggttgagtatctgcctttggctcaaggcgtgatcccagggtcctgggatcgaatcccacattgggctcctgcggggagcctgcttctccctctgcctatgtttctgcctctctgtgtctctcatgaataaataagtaaaacctttttaaaaaattgagttgacactgtcctgagttgatgatggtgcttgggtcctatatctcttcctgttctcagtagacacatgcacaaatgtttagagtgaagtatcatgacgtccacaacaaattctcaaatggttcagcatttacaaaaatgacaaggttcaataacttgcccgaggttgcatgaccaagaagagaccaagttaagaaatcaggtatcatctagcacagtggttaagagcatgggctcttgggccaaactgcctaggcaaacattcattcctgccccttaccagctttgtgaccttgggcaagttgcttgacctctctgcacctcattctccttatttttaaaagcaggaataatgagacaaggataacaacgctagcatctacctcctgatgtgatgtgagttaaagcatgtgacggacaaggcctagcacactgaaagtgctctgaaccggggtggggggggggtgggatccgaaaccaagtctagtctgttgtagagaccagacacctttatgctgccccttctctagagagatggtgaaatctcagacaatgctgggatggagagcattttcaaaacggcagagtcaccagaaggcaggaactgaggggtgaaagccacaagggacaggacctcagaaattaagtccagatggcatggggaagggttggagtggggaaaacccccggcagagagaggtcacatgagttggggctgacaatggggaggggacagctgctggctgaaccctcccatgttccaactgaggaaatgggccaagacaggggaatcatgggatcagaggcttacagcaggtagtgcaaagctcagaaagcacgggcaggactcctggtcccatgctccaggccccgtaggaatcctcagaacatagctgaaaaatgaaaaagacctggatactaaaataatgggcatcattaaaaggttctttggggacctaacgttgttttcaatactttcaagacttggaatgcaaactggtgcaaccactgtggaaaccagtgtggaggttcctcaaaaaattaaaaatagaattgccctattgatttatttgagagagagtgtgtatttgcacccgggggggggggcgggggggaaagaaggagacagagagagagaaccccaaacagactccctgccagcacagagcccaaagctgggcttgatctcttgacctcaagacaatgacctgagctgaaatcaagaattcactggaggtaggaaatctgagcttgtatggtgggtctctggtcctcagagactcaggctccttctgtatttccactctactatcctagaacatggcttttcactcaaggtcacctcactgttgaactccaggcagtgagggaaggttaaaaaaaaatccatgccccccttccctccatccccttttaaggagtttccctgaagtttttgcttataaaccactggccgcaaagtgaggctaggaatcttccttttacctgggcacaatgctaaaatggaggttccgtcactgagctaggaagaagaatgggctgggggctgcagctagtggcctctgccccaggctccaaaggcaagagagcatcttgggtcagagaacagaagacaggactagaaaatcaaaagataagttctgatctttactgagtccctgacaccaggtaagtcctagcacctcctagagcctccgccccaaacagactggggggcagtaagggatcgggtgatgtgatgctgtgaaggggcttcatagaccataaaatacgagtctcagggaaggaatgaggtttctgctactgctgtcattagaaccgagagtggccggctattggctggagggagaaagtatggagaggcctggagggaaagggaagggagcactactggaaatagatgctgcagagactcgggtgctactggggggacaccctgcaagcaggagtctttctccccagggctgtgtggcccagggttgtggagtctggcaaaggcccatgctgcctttttcagtcctcagggcctcagacaggcagacaaacaaacaggacacgggggaagcccaaactcccaggacaggggggaaggcctccaggggttagaaaccaagtcctgagtccccacagggccaaaatagctcactgattgactcaataagaccaacacaccggtcaagccagtgggggagaaaccgaaaccccagccagatctattatttagcagtttgtcatcaagcaaaaatatatgtcgccccctccctctaaccccaactgcggagttgtttcgtgtcaggagtcaccttgggtcagtccgagccaagtcaaatgttttagatcagctctccccatggtgcccagtaggagagctgggaggtggtctcctgatgctgggacaaggggccacctccacctcttctctaggtcctcaagccctatgtccttgcaaacagatccccaaaaggctgcaaacaacccttccctaaatgggggtagtgggaaagtaggggtgcacttgaagaatgttgaggacacggtccacacacacaatagtttgcttgatgcctgttgtgcacccacaagcccagggcaatggtggattctgctccaggggctgtgagctcacagatcggggcctctccttggtgcgggggtgcaccccattcccctccaggcccccggctgggctagctatgggaagtcggctgttcagagttcaaaaactaattgggaacagctcctggaggccaggggacaaggcaggggggcgcgggataaatggcaagcagcgtagagaattataaatctagtttcatagtccctctggtttggcacagattaagcgtataaatcaagcttctgtagttctgctctctagctcaccatacccttcactcaagacgtaaaccagaacttaaaaagaaggtttgtcgaagtaaacataaatacagaagagaacacacacggcaagtgtaaagcggcttggagaattttcccaaagtgaacacacccagataacagcggcaggcaggaagctgcaaattgccagcccccaaaagccccctcatgcccccttctaacaatgactccccaagggtaaccctatcctgacctctcacaccacagattgttttgactgtttttgaactttgtctaaatgaagtatacgtttgtgcctggcctgtttcactccacatcacagctctgagattcacctggactgctgtgtgtggttgtcatttattctcacaattgtatagcatttcattgtgtgaacagacaacagcttgaccattctactgtagatggacttttgggccatttccagttgggagcaatccccaaagagctgctactaaaaacaaggctttcttttcacaatcaggctcactgcccccccccctttttaatgttttattgtagaaatatatgtataatataaaatttgccatcttaaccatttttaagtgtataattcagtggcattagctccagtcacactgctgtgcaagcatcaccactatctatttccaaaatgtttttcatcatcccagacagaaaatctgtatccattaagcagtatatccttcatttcctctgggccctggtaacctctattctactttctgagtctatgaatttgtcttttctaggtaactcacatatgtagaatcacatatttgtccctttctgactggctcctgtcacttagtgtaatgttttccagattcatccacgttgtagcatggaacttcactccttctgaatggccaaatcagattccattgtaaggatatagcgcattttgtttattcatccatctatccatggacacttgggtggcttccaccttttggctgtttcgaataatgctgcagtgaacattggcatgccttttactgaggaccagtgtgtagggacctgagataggtattcacaccgccattagtagacaatcaggtgaataaagtgagattagtatcctcagactacaggtgagaaaacagaggttcagggaagccaaggatctttcccagagtcaaggggctgatctaattggctgagaccaccactcaaatcctgaaatcatgggatgcctgggtggctcaggaggttgagtgtctgcctttggcttggagcgtgatcccagggtcctgggatggagtcccacatcagactccctgcaagaaggctgcttctttctctgcccgtgtctctgcttctctctctgtctctaatgaataaataaattaaattttttttttaatcctgaaatcagacttttgaccccaaacccagggtttttacacacaacacatacacctgcacatacattttctctcttgaaactcttctggtcatagaagaagttagatttggtttgcagacctgttcttcctttaattccaggtagaaaatctttcccctggagccactaaaaatgcctacttgggctttcttttttttcccttttcttttttttcctccctcttttctggcaaacagcccagggcaagagaacaagagaagtttctcagccaccttcactcaacccttcactcagccaccttcactcaaccaccttcactcaacagtactttgtactgttttgttattgttgttgactttttttttttttgacttttttttttaatgctacaacttttgtcacacctctgccctcctgccaccaggcctcctgagtggccctgaggctcaggctacatttctaagttcttctcttggtacaaacaacagactatctaagacctaattagatttttattcaagggacatggagagaactacttgactcaaagtgtcctctttttctgccctgctagagtaaattttggtaaaagatatctaccctatgttgggctgcctgtggttttgttctgggaagtgatcaaacgagtcgggtacagtctctgtcctcaaggcagccccgtctggctggaggggaggggaagggggggcaggatacaggtcgggagaaacaatgtaggagcccatcaagggggattctgatggtacaagaacaccgcccagggctcgggagggaggatggggccaccggaggggacgtccccagacatcccctgccaaaggccctcgtcattcaccacgcagacgctctttgacggagctaggcctccgggagagggagccaccaacaccgacaccccgaggccctgccgcagccgctccggggctgacccgagaccccctgggcgcgagcttccagcccccgcgcgtgcacgtcgcgctcgcctcggcgcccaacaggggccccggggctctggcccagctcctggagaatgggcgaggcggcgggcgggggcccgccccggggtcctcccctcccccgcccggggtcccccccgcccccaggtccccgccgtccccgcgccgccgcgccagcctgcccccgccgacaacgcgcctttcaggagcctcggcccccctggaaaatccccgcgcggtcccctcgaggggagggattccgcgccccgacggcgtgcagcggccactcgcccgcgccccccgagcccggagcccggagcccggagcccgggagcgcgcagccgccgtccgcccgccgcaggggaccccgcgccccgcggtgcctccccccggctccgtccgcttgtgagccgcggcgtgtagaattcaatttgataggatttgataggacacctgtgcgtctccgggtgctgcataagcgcgtacattcctgcgtgctttcttttgttttttcctttcctctttttttttttaaagattttatttatttattcatgagcgacacggagagggagagagaggcagagacatgggcagaggagaagcgggctccacgcagggagcgtgacgtgggactcgatgcagggtccccaggatcgcgccctggacggaaggcaggcgctcagctgctgagccacccagggatccccttttcctttcctcttgagtctaccttggtatcatccactctcaggaaacccattatcaagagcctagaacaaactcttgtatttttctccatgttatttatttttaagattttatttatttattcgtgagagacacagagagagacagagacacaggcagagggagaagcggcccgatgggggggggggtggggactcgggactcgggactcggtcagactcgatccctggaccccaggatcacgccctgagccgaaggcagaagttcaaccactgagcggcccaggtgtcccttgctgcatgttcttataagcatatacaaatattttcctctgcatttacatatacacaaattcatacacatggcatcttgctagacatattttttctgtatcacaggaactgttgtggttgaatagcggtattatttattatttacttacatacaataaaatgagcctttattaatttattaaaatacctccttgagacaggcacccctactttctgctacctcgagcaagagtgtgataaaactcttcttaggtatctttgtgtgcctagaagtaggaaggctggggtaaggtgtccctgagtttaattttagaagatactgcagattgcttttgcaaaaggtggaacacctcccctccccaccaacaaggagtgaggatgccccattcccctgcacccagcagcaagaggtggcacaagtgcttggtgacttaacaggtgggaccccctgaggcatctcctgttactttaattttgtacttccttgacccttaatgaacttcggcatattttcatctgctttgtggctacttggcttggctttgcaggggagctgcatcctcctgatacatcttaaagcatattgttaagcatagaaattccccttcacctgaaacagctggaggaggaggcgccagggtgaatggaatgatctagttagtagagtgttccctagtttgtcacacccaattatgagctttcaaaagatgagaccataagcagatatttgtagtaatagggctttaacaaataggagaggcatgtgggaaatgaaaagtgagtggactttggggccacatattagctgtgtgctagggggtagttgtctaacttctttgagtctcagttttctcatctgtgaaaaggggataatgatgatagtggtgcttacatctttatggttgttggaagcatggcagtaatttatgttaagaacctgggaatagtggatggtcaataagtgctggtcaattatgacaagcatggtttagactttcctctagtggttttgttgttgttgttgtttttgagaaggttccaagcccagcgtggagcccaatgctgggcttgaactcacaaccctgagatcaagacctgagctgagatcaataatcagaggcctacgggactgagccacccaggcaccttcctctggtcttcaaataggcctatcagaagcctagggttagcctgaactcaatcgacattgcatggctctgggtaaaatgaattatttaagtttcctgtgggtccagtgatcatactcaaataaaccaagattttgcaaccttggcactattcacattttgggcaggatacctctttgttgtgggaggctgccctgtgctttgtaggatgtttagcaacatctctggcctctacccactgaaagtcaattgcacaccctacttccctagtcataacaatcaaaagtgttcccagacctggccaaaagtccccagctgggcaaaattgcctgtggttgagaaccactgatctaaattctcccccctccccgggagaaattttttgaggctttacatagcaagaagagaaacccctcccttgcctctgctccctctccatggggcagtcccccactcttcagctcccagagtgtctaaatgttctaaatgtcagccaggtctgagcaaggcacatctgggtagggaggagcacagggggtattttttctatggatatccttataattctcagcctgggcacaggagagaaccgggcatactgtacttaacaggtgccctccaaagctgcccaggtaggagctacagtgtccagactgggaggctgagtgagcccccatgaagtcacagagtgatgacagatgaacaatggtctgtaagttttttcttttgcaagatgttcttgcctctcttcctcccatccctccacccccatgctgtagacttgacccaggcttagccttgggctttcacctgagccagttttaattcttatctctttgctgctgacctgagaatctagatattcagcccccagcttcatgtatgttccactcctgtttcaaataggacgtttctttctttttttcttttttctttctttcttttttctttttttttcttttttttttttttttaagattttatttattgggcggctcagcggtttagcaccgccttcagcccagggtgtgatcatgggacaagtcccatgtcccgctccctgcatagagcctgcttctctctctgcctgtgtctctgcctctctctctctctctctctcatgaataaataaatgaaatctttaaaaagaaaaagattatttatctatttgacagagagagagagccgcacgcacaagcagggggaggagcagttggagagggagaagcagacttcctgctgagcagggagcctgatgcagctctgtcccaggacccccgagatcatgacctcagtggaaggcagacacttaatagactgagccacccaggcgtccctcaaataggatatttcatcatcactgcaaactcttcatgctcccaaacataattccttatccttcctgctgattcaatgtctgtcaatcaacgggggcacctgggtggctcagtgattgagcatctaccttcagctcaggcgtgatcctggggtcctgagatcaagtcccgcgtcaggctcctcacagggagcttgcttctccctctgcttctgtctctgcctctctctgtgtgtctttcatgaataagaaaataaaatcttaaaaaataaataaataaataaataaatgccaatcagcacatgcttactgagtgccatagcaaaaagtgctagttgcttctcaatgtcagtccttcccttcttcagtagtaacagagacctgggtgactcccctagctgaaaaactacatctccaggcctccttggcagcttggtgtagccatgtgactaagttttggtcaaaaaggcacaaacagagggtgacagaggatttccaggtgtgtgccttaaaagaacaggagtgcacatgccctttttgtccttttgtctttcctctctctctctcttcctggaattctgaggaaaggagtggaactccagtagctgttttgggccatgaggagtatttgaggaggacactgcaggaagataggaggatcctagtcaccgtgaagcaacttcacctatcctcgagctgtggacttttatgtgagagaagaaagccctgggtgtttaagccactgtgattgaaccttgttatcagcaaactgaaacatggcctattgcccttcccaagtccatgtatctgtcttagctgttctccaactttctctgccagcgggccaaataccttggcgttgtcatagattcatcctctttctccagcaggtcagccaccatgacctgtcagttttctgcactaaacacctaccgtacccatctgtcttttcctcttcatcatactctgtttgatgagggtaggcaggattcagagatgtgtgggactcagagctgggacacccagctgggccaggagatgccactagaggcaggtctgggggtgattacaactgtttgatcagttaggaccatggtttaccctgtatgctcagggccagcacagtgcctggtacttagtaagcaataaaaataaaaaaaaaaatctaggggattaattgactagttaacttcatgcacacacacatacgtgcataggtatagtctctatttttgtcattcatgctcacacacattacctttctttttggagacaccaggttacaaagaaaaccctcaggagtttgccgtggacttgatccgtgtcacttgtaagagggacaaaatatgtatgcgggcagcttgaaacccaggcttgctactagaaataaactaaccccttgttgaaatacacagagaaattgaagggaggtggggacacgggtggcaggaaaaatgcctgagatcttacgcagcttgtgcaaacagtgctgggcagccccgggagtctaggaattaatagtcccactggggctctggggctccggagatggagctatttaaagccaagaaatgtcatttccacccacagaggctaccccagttgcattatctggaccctcttcagccccggtcttctggcagcctccatggcctgacctcccagttggtgggactgcgtggggcttacagccaacctgtcgtcactgctctgtgggagggagggctgaccttagtctctcccggatcctcctcctcctctctgctcaggccccaggacagctgagtggagactcagagcctggtccaccccctgcagggctagccaagagcacagcggctgctgctcacacagagaggccagccagcccagcagggtgggtctaggcccagagagggggtgagagggtctatagacagagaattctgcccatcagaatcatctccttgccttgctctgtgaccacaggccatttgcttaccctctctgggtccccatttcctcacctagactggcaaatggaagaatcttcttctccttgccctggttctggggaaggccccaggagatcagagtagggaaagtcttttgaagctttaagaaaagcagcttagaaatccaggtattaacctgcaggtccttctcttcttccttctagtcaaggtaatctgggaacacttcctctggaggtgagaaggcaggaagctagtgtttggagtgtcagtgggctccagattgcatgacagtcatccagccccaagctcctaagagcccaggttcacattcttgccgggcaaggaaggtgagaattttgcctcctgtctgctctggtcttgagtatctgctctggctgatgttcctgcagcttaggggggtaggagggaggactcagaagcctggagactattccaagtcaagtgtgacctgcaggtgtctgaggccctgaagggcatgatgttttcccccatttcattttttaatcgaaatattctagacacactaaaagatatgtcggtcagaatgttctcaatgatgctgcagtatcaaacaaccctgatatcttagtggtttaccacacttctacttctgctacatatccttgaaggatgagcaggggactctgttcaggaaatcactcagggacccaagctgataaaacaaccaccatctcaaacattgtcagaagcaaaagagaaatccagagggtctcaaaaggcaatttcatgctctagctcacaagtcgttggccagaaccagtcacagccttcccccaaccacagcgatctaggaagaacaatttttctgacacttagaaggggccgcatttgtctggggaacaacaatcataatgaccatggaatagagaatgacatcacaaataccacacacccatgccaccccacctaggaaatagcattttgccaatactggtaagaccctctatgtatggggatccctgggtggctcagtagtttagcgccgcctccagcctggggcgtgatcctggagtcctgggattgagtaccacatcgggctccctgcatggagcctgcttctccctctgccggtgtctctgcctctctctgtgtctctcatgaataaataaataaaatcttaaaaaaaaaaaaaaaaagaaaaagatcctctatgtacctgactcaagtatatctctctctgttccctgctctacggagatgacctgaatctgacgtttatcatactctatattttaccatatattgtttatatagtaccagtatgggtacacagtaaaatatacacataaacgtgtatgcatattacatataccctttgcagagggttgaactgggtcctgagtcaccactcagcctgttctggggccataatatattaggtctactataccatatgttttgcacttaaagatcacgtagatggtatcatactatatatacccatgggcaacattcttttttttgatctgctccatgttttggggaatcatccacattgatgagcaaagctgtgattgattgtgtgactatcacgatgtccattgtggatggacatcttggtcacttgcagcttcgcttcattacatatagcagagctatgaacattcctgcacacgtgcagagtgaagactagggagggcatcttccacttggtgagagattgccaaacagccctccccatggctggaccaagccatggtctgtcagctgtatataagcctctggtctttctccatcagcacctggtactgtctgatgaagcagagcatctcccccgtagctttcatgaaactgaactcatgaatcactctataaatgtttatcaaataccaactgtgtgctaggcgtactgccagcagttggaaataatgaagggggatggggggactcagcccctgccctcagtgagcttacagtctggtagggaagacaaagtcacttattcaggaatcattagaatagactagaaaccataaatagatgaattaaaattatcccgccttgctacctatagccaacctctatcttctttttttaatgacactcccctcagttcagggcaagtcaaggaagctaggcacttgggcggaaggacagggctcagcatccaaggggcccagacactgtaagccaaatctcaggcaagagggctagaactttgtcccaggggtggtagcccattaggcaagaagaccactgccacgtggcttcgggaacaggttggctaagaagctcagagcagtagccatggtctgataaatcaaccttgagtcatagtcttcctgcattcagggtttcagggaggagccttcaaccctccagatcggtgattggcaatatggggcaaggagctgggttatgagggaactataatcacagcagtactagagatggcaatggccatattaaagcagctttacaagaggcatctgggtggctcagaagtggagcatctgcctttggctcagggtgtgattccagggtcctgggatcaagtcccacatcgggctcctcttggggagcctgcttctccctcttcctgtgtctctgcctctctctgtgtgtctctcatgaataaataaataaaatatttaaataagcaaacaaacaaacaaataaataaagcggtcctacaatcctacaagataggctgggtgaggaatcaagtgtgtctgcttggtttgggcctgaatcactgggtaggaagagcaggttggagtcaaggccagacaatgcagagtcatttcagctatgggttttgttttgttttttttttaaggttttatttatttattcataagagacacacacagagaggcagagacataggcagagggagaagcaggttccatgcagggagcccaatgcgggactcgactcggggactccaggatcatgccctgggccaaaggtaggtgcttaagcactgagccacccagatgtcccagctatgtttgaagaggcttctcaagttaatggttgggtttagaagtaaagatggctcttggctatagctctaggtacagcttaactcagtaaatcaatccacaaatgtatgtgaatccgggtatgagcagggcatgactctagactctgtatgggatgtaaaaacattttttaaaaactatcttcatcagagtacaattcatattaaataaagtgcaaccatttgaggtatacagcctgatgagttttaaaaaatattttatttgtttgtttattttatggagagagagagcagaagcaagcagagggagagggagaagcaggcaccaggtgagcagagaacccgacacaaggctcaatcccaggaccctggaatcatgacctgaaccaaaggcagacactcaaccgattgaaccacccaggcacccctatttgatgagtttctttttaagatttcttttatttattcatgagagacagagagagagagaaagagaggcagagacacaggcagagggagaagcaggccccatgctgggagcccaacccggaactcgatcccgggaccccaagatcacgccctgggccaaaggcaggcactgaactgctgagccacccagggatcccctatttgatgagtttttataaatgcatacatttgtgtaagcactaccacagcaagatacagcacattgatacgaatcctttaagatccctgtcattttcctcagggagtcattcacttcctacaagatacagacacttaagaaacatagtgaactatacaaggcagtaaagcattcaggtaaaaattatgggggctgggcactggagggaagtctctggtcctaatgcaaatatccttggggctaggggctctccatcacccacagagggtcaggggagaggcaagccaggtaacacaagccttgcttttcccaaaatatctcaccagactgaaataccaccatgagtcacccctttggcttaaaatgtttggtattccctctttaatatctgtcttaaaatgcacagaaatggggcacctgggtggcttattcggttaagcatctgactcgtttcagctcaggtcatgatctcgcggtgggaggggtcctgagattgagccttgcattaggctccgcactcagcagagtctgtttgagattctctctcttcctcttcctctgcccgtctccccaaatatgctcactcgctctctctcaaataaataaatacattttttttaagtgcacagaaatgacctgacagcctttgggatgtatggaaagccagacctccactaacacgtagaatcagtttgtcagatttgtcagctacccttcaggagaggatagggctgctctggaacaaacagggaaatagacaaagcagctgctcaatgtcttctaatctctttcttttcttttctcctttttaacctggagagaaagtgggtccttcctttgagacacctaaaataaccacatggtggcaagccccatctgaaagctatggcattcattttgatccagaaagagggaaaatgatgtcaggagaatgagttcaacagggctctggggagatgttccatatggaggctgggggagaacacttgaagtccatggtcattgggtcacagggacactggaagttaagagaataataggtgtgtccctctggaaaagaaaagactgcagaggtaggagattgccacctttaaatatctgaagggtagttgtgaggcaagaagattggaacagatttatgtggtctagctgtaagtagagtggggaaagccaaaggtggctggtattagctcaatatgagaaagaactttcttaaggtcagagctattagaagagggaatggtttaccaccggaagtagtaagatctccatcaccctccggaggcatgtaagctgaagacagacacctttggacaggaattcaagttctgagtgggtcattgggttagatctcttctctcactgactgagcttctccaaattggtctatggccagcccttgagaagccccagtcaaacaaatattaatggagcaactgctttgtagaaggcatgatgggggaggaaccaaagagcaaaagctatagcctctgtcctacatgtcactgggcagctgtgacagaggcagggtgtgcttggaatcagcaaaggaatagagaacacacacttgtgaagttctgaaggaggagaccctggcaagggttagagttggtgggggggttggtggggggtggggcactgaggagttggtgagatggcaccaggccctgagagatacttcagaatccacactggcagtaggaaaggggaggaaaggtgtgggcaccagccaagaagtaggaaccgaaggagccgagcaggctggagcacgggaacgggaaggaaggaatgagagactggggagccagagcagaaggggctgagagaagatgcgggaaacaggcccaggaaggcccaggagccgtgggcggtccacagaggggaggtgtgtggcctgggtcccgggtgcccactgggggtgcccacagtgttgtggggggcagatttctccctctccccatccagtaatgctgcagaccaccaggcattgtgccccaggaatgcctcttaccccttcccgcagccccaccgtagcctctggccccctcagggcagtaagctcccgagaaagacgggaaaacccacaaaaatcttccaaataagacaaatatgtggtgcagacaaaagccatgctgggtgggatgaggtttcggttgctcctcaatggggcggacccgtcaaaagtagcctgtggccacagaaaaatgcgtcatctcccactctccgtggggcgcattgtctcagctaccccccaaaagagcccacgctgtaggctccacatgagggactaggaggtcagtcactggcctcaaggtcactcccatggccctctggtccccagcaggggctccagggggcgggggccgccctgagctgtctcatgctagccctgctggccttcccgccatgtggtgagtgcccagagcactgctggggtgtgtgggagggtggcctggccgccccctggagcctgtgagaccccgaagggtgggggtcaggtggggttccacatagaaaaggcagcggccaccgaaagtgcctcaggggggcgggggtgcaggggggtgatgggaggtggtagggagaggcttctcccacacctttgtcccctgattccctccccactcccacagccctccaggctccctggcccctgggattcgcgttccatttctgctccagttccatggctgttaacagccattgttccatggagaaagacaaaaatgttttcagtttagaggcattgtttcggactttctctccatgggtcgagggcctgggataggaggcctcccctgcctagggtggccccaggcaaggaggagtcgcacttaatgtgggaggggatgagtggactcttctgtccatctgtctatctgtctgtgctgggcgtctacagggaaagccctgagaaggatcaccgctggcaagagggcttcacccttaccacagttttggtttcatcctgtcttctgacccctcccagcccccagccccatcccagctccttcagctcttgcttccttcctacttaggctccctaattctgaatgagtgagaaactttctctctggacctcatttcctcatctgtaatgtatgagggttccaagactcttccgggttctaagccttggcaacgacaaggccttgccttcactccaagactccagaggtcacagctgacctagaatttggccagctgagttcatagccatctgggcagtgggctttgcaagaggaagtacctacccttgccacctttgcaagaggaagtacctacccttgccaccttcagtatttaaaaaaaaaaattatagcctgaaattccaccattagagattcactcctgtggagtcagcttcaaaagccatttgtgataaaatgagaggatgtaacaccttttaacactaagaataatcctttgcttatacatttctcttcacagtgttgaaatcattttcagagagaccatccatttgggactgcaacagctcagtaatcagttgaccattggtaggttaagaccttggaagttgtgacttaagaacctggacacaggtgatctcctctaggaattatctgcattttaacagaggaatgtcctgagggtaagaataatgacaaaggaatgcctgtctggtggtagaaatttcaagcccaggaatttcaggcaggagaagctgactagcctgcctgggaatgaggatgccaccccccagggactgttgggtgtgagctcactctgcctagagctgggctgggcctgcttctgctcagcagtatccctgcccactgttgttgaatcaagtgaccagccctcaaggattcgctggaccccctgtgagggcaggtctgcttggacaggtgtatagattcacagaaaaaaaaaacagagaatgataatgacttgcaaaacagagtcagggagtgtgttaagtgcagaggtgggtacaaaggaacagaaattggggagggctgggacaggacgagagctagagcagagcctggaaggctacagaaggcaaccgtaggaagaaggaggtgggggcagtggtggtcttctctatgaagggctacctgggcacaaaagcttgttgacagctggccagtagtgattagaaaccaaccttgaaacagattcagtgtccgcaatgaaaaggaatgatcatttgttggggtccctagatcctagatagtttctgcacattatcttgcttgagccttgaactagtctaggttttatcatccacatttttacagagaagcaagctgaagtccaaagagagcttggagggatccctgagtggctcagtggttaagcatctgcccagggaatgatcctccagtcctgggatcgggtcccacatcaggctccctgcatggagcctgcttctccctctgcctgtgtctctgcctctctctctctctctctctctctgtctgtctctcataaataaataaataaataaataaataaataaataaataaataaataaataaataaataaaattaaacaaaaacaaaaacaaagagagcctggaagctgcctgaagtcataacagctggtgaatggcagagctgggagtcaaacccaagtcagtctaagctccaaaacctgccttctaaccatttctgcaagagtgacatccatctgtaacactgcctcctcttcctctgtaagggcattcttgaggcacagagaatatccttgctatttcctgctcaggctgttctttttatttttttaattttaattttaatttatttttattttttattattttatttcattatttttgagaggggttgcagagggaaagggagagagagaattttgagcagacgccccgctcagcatagagcccaacatggggctcaatctcatgaccctgagatcagtacccaagccaaaatcaagagttggatgcttaactggctgagccacccaggtgccccctatacaggccattcttgagctgtgcagtagtgataggggcttcctcgccagccctggctttgtgataacagcaagaggaagaaagtgtctatactctagggttcagagaaatattctgtaaatattttaggctttgtgggccatatggcctccgttgttaactacttaactctggggaaagcagccataaacattatagaaatgaatgggtatggctaggttccagtaaaactttatttacatacgtatctaattcatacgtttatccattcattcatcatttcattgtttatccattcaaaatattttttgctgagcaccttccatgaatcagacactgttctagatgatgggaatgcagtcaacaagataacccccgaccccccgcccaccttcttggagctcacattctttatttataccctccttggtgactgatggaatatgtttaatttgagtataagttctactgatcacagaatggggagattagggatcctctgatgtgtttttaaactagaggaaaaagcagttcacatttgagggtgaaaggccccacagaacagtaggtaagtatagattgcagaagcaaatcacttctgccacatactgggaatatgtcctcacataagttgtatttcccctctgcctcagtttcctcacctctacaaggtagatgacaatagtggcatctgactctgaggactgtcttgagagtcaactgagttaaaatttataaaacacatacatacaagagtgctagactcatgggaaacacaatataagcttctgttgagtaaaggagatgttcaaaagaaagaaaaaaaagaattagaggggcacctggctggctcagtcagttaggtgtctgactcctgattttggcttgggtcatggtcttggggttgggggttgagacctacatcagctctgtgcgcagcatggagtctgctggagatttctctctctttttctccctctgccccattccccaatgcattctctctctctctctctttctctctctctaaaaataaataaaatcttttaaaaaaacatttggaattagatcacgaggtggtgcctactaattccaacttcaccagagcactatgttggacaaacactttcatcttcctttgctcctatttcaacattttaaggacaatatatataacaacataaactcactacttctttcactcaggtagagtgagtccaaatgacttcctgatcccagatgaaagagaaaaaaaaaaaagtttatttacaaaacagaggccaggccagatatggtccatgagccatcgtttgtttgctggtatgcatcatcagatagaggaggtgagatgtacacaggtggaacagttaagtaacaggatgagtgtcatggaccaaggagcacccattagatggtgagcatgccaagaatctgtggcacttgcatgttggagaagagcgcaaggtgagagaggacaggtaggctggggttcagttctggagggcttcaaatttagcctttacactcaggagcaatagttcacaataatattctccccacgttgggataccatgacaggtggcattcatgtgtgagactcacatccataagtatacactagaatagactgcaacagagatgagccaggcatcatgagttccaaagaactccctgtgaatgaatttatttttccaggtaccgcagatacagagccccaccccagccctctatttgaatgacaattgcttattctcacgtggacagagaaaacggttggtatagtatgctgtgtatgggggtttggagaatttgttaaggtttttttgtgtatgaatgctaaaaatgtgttctcagtttgtagggtataacatacatcagttaaacttctgaatcatgggcgcctgggtggttcagtagttgagcatctgccttgggctgtggttgtgatccccggggtcctgggatggagtcccatatcaggctccccacagggagcctcttctctctctgcctgtctctgcctctctctatgtgtctcatgaatgaatgaataaaaaaatttttaaaaactcttctgaatcatgtcactcaaattcttcattattctcattatgacttttgtctgcttgacctagagatttctgagccttatctttggccagagatttgttcattttttctgggtttctatcagcatttgctttatatattttggtttttgttttgttttttgggttttgttttgtttttaaatttatttatttatcaggctccctgcaaggagctgatgtggaactccatcccaggatcccaggatcatgaaccgagccaaaggcagacgctcatccactgagccacccaggcattcctgctttctatattttgcaactggattaaaaactatagaaattatatatatatatatattttttaattttatttatttattcatgagagacagacagagagagagagagagagagagaggcaaagacataggtagagggagaagcaggctccacacaaggagcctgatgtgggacttgatcccaggactccaggatcaggccctgggctgaaggcaggcactaacctgctgagccacccaggcgtcccaaaattatgtatttttttgaaagattataatttatatctgtatatctcctttgtttctgttagtgcttttgctttggatcccatactgtctgatgctaatatacctgcttaatttttgtcattgtatgcttggtacatttctctcatctgttcatattcaaaatgttcttgtcatttgatattaaatacatctgtgtgaacggcatagagcagtcttttgcctttagtagaggaatttttctcttttttcatatgttatctcaatgatttttttagacttaacctgtcattttattttatgcttcctctttcatttgctttcttcttatgttttttttttttttgactttttgttagtttttctcccccgcacccacttttaattcactctaaatatttggaagctgattttccaattctccatcttctgtttgttacacttaaacatgaatccatatattctttgatttatgcttttctatcaatgtctatagctaatcaggaactctgtttcctttagcacacttaagtgtcctctttctccatttgtcacctcccaacttgagatcatctgagtagattgtggtttcatattactgttattatttttatttatttattttttaaagtaagctctatgcccaacgtggggcttgaactcatggctccaggatggagagttgagtgctccgccaactgagccagccagccgcccccatattgttgcttttgaaatgtttgcattatgcctcaatagttagtcagagttcactagaagttttattagtttctttgttcatcatagtttcagcatcccacgtcttcctcttcttgaattcactattttttttttaattgaagcacctcctctaagaattctttcaagttatctgagggtggtaaactttcttcttacaaaccaaaaaatgtcttaatcatccccttcctacttgaatacttcatttccctttggaactttgtagatagtgttccattgtcttttaacgtgcagtctgatgccaatttaatactattttattagtgacctgctttttctctggaagttgctaggccttttttctttatcattgttgttctgaaatttcacaacaataagtctcagtgtgggtttttttttttcccctgggaacattccatctaacaatttcttcaacaactgggaaattttctttgattagttccttaattattttctctcttctattctctggagtcattttttttttcaaatattttatttatttattcacaaaagacacagagacagagaggcagagacacaggcagagggagaagcaggctccacacaggaagccccatgcaggactcgatcccgggtctccaggatcacgccctgggccgaaggcggcactaaaccgctgagccaccaggactgcccaagttctagccttctataaagtgtattagacagaggtgtcttacctttttccctcagactttccatctttttctccttttcactgtgtttaaggagacttcttcagctcagcttcccctaataactagatcattaaattcaactcagactatctactgagtttcaaaatctgattatcgatttttaagtttctaagaccactggttgtttctttgtttattaaggttttctttttaaagattttatttatttattcatgagaaacagagagacagagaggtagagacacaggtagagggagaagcaggctccatgcagggagcccgacgtgggactcaatcccaggtctccaggatcatgccctgggccgaaggcggcactaaaccgctgagctaccccggctgccctgttttttaagtttttattttcaaagatgcctgagtgggtcacccagttaagcaactgaatctcgatttcgctcaggtcctgacctcacggttatgagatcaagctctgcttgggactctcgctgcccctctcccctgctatctccctcccaaatatacaaatctttttttaaaaaaaaagatttcatttttaagtagtctctacactcagcagggggctcaaactcacaacctgagatcaagagtcacaggctcctccaactgagccaggcccatacccctgccggttgatttttaaaatgggttattacttggaatctcttgtggataataattattcttcaactaaactggtttttgttgttatttattcttatccttatttattcttagatgttaagcttagagctatgctacccaatacagcttgctatttaagtttaaattattgggtgcacctggctggctcagtcagtagaagatttgactcttgatctcgcagttgtgagtttgagccccacattgggcatcaagattacttaaaactaaaatcttttcaaacagattttaaattattaaaacacaatataattaaaaattcagttcctcagttgcaacagcctcatttcaagagctcaatagccacatatggtgtgtgactacatattggacagcttggctacagagcactcccatcattccagaaagttctattggacagtactggcttagagtttctctgtaccataattctatttttccttaactctttagtggttcttgatgttctgctcatcattgtgtttgaggacgtctacttgccagctttgtgttcactgtagcctgtcactggttattgagagtgggtgtgagatgagcagcctctgacagctcttctccctatttctctcttagaggggtcagaagctacggggagcattactctgcctctctagccctagcatctcggggcaaatccatgactaccaactggtcataaggcagcaaggaacattcctgggacctcctctggtcattttgagtctgtctcaggcttggagccctcaaaccattcttccttccacagtggtcttctccttcacatggtttggatgtggttccctctagtttgattgctttagggctttgatgctatttgttctttatctttctgggatctaacatttctttttcttctcttttttaaagatttatttatttatttgaaagagagagagagagagagagagagagagagagaaagaatcccaagcaggttccatgttgagtgcaaagccagatgtggggctcaatcccatgaccccgatatcacgacctgagctgaaaccaagagtcgggcacttaaccgactgtgccacccaggcacccttggaatccaacatttctgatatgctgacggttcactcttgtttcttcacactgtgatagttacttttttttttttctggaggttttctgccatttagtggattggggcagaagagaggcttttctgccagtttgacccaaccttcaacaatacctttgtgtaagcatcatcctgctccttgtagacacgtttcataactaacatttcactaaacctggtgattcccaaattcaaaaggttgcattagaatcatctgggaatccacggccctcctgggggctttgaatgcacagcctggtttgggaattatcagcctacttagtgggatgggtagaaaagagactctagtactccagacaggccacctactttgcaggctagtttgtggccagatgcctaaatgcggaactcttaacagccagatcaccacttccataagtgattgggacactgggtggtgtggagatggagagtctaggggacctctttctccttggactgcaggaggggtgagaagttgcaaaacccactggggataactccaggacaagagagatacaatgagtacaactgaatggaagtgaaatgaatgatcgctgcaggcctctctccctcccacagcgatatcaactctgcaagccccaaagatcaaaatggggccagagaattcccccatctagagattttttttttttaaactttaattgctatcctactgaggggcccaactccagctttgaggagatgtacttactggttagatttgcagtaatgattattattgttactgttaagaagaatacattcattgtttccattgagctcacaatgctgcacaaacatgacctcatttctcctctgaacggggcaggtattgttaactctgttttccaaaagaaggacatggaggtccattgcagcaaggccacacacatcaagagagggagggaaggtgaaaccaggccccgggactcttccgtgtgggtcctagggccctctacactggtctaggctcacttgtctggcctgggctttgacttctcttatggccacaaaatcagttccacgggcccaagggaatcagagcagtcagagtcagtcatcaacattagataccatgagagaaataatctttacttttcaggggctcagccaagtccagactccattttcagccatcaaaacctttctctcttatttggcccccatttcacaagactccaacctggctgagttctctccctacttcctcatcaaaggagtcgagtatttcacccctgaatcccctcagaccaaaaaccatattcacacaacatttttgtccttctgccccatgaggagtttctgttgctggcatgtgccttgggtcggttgcagtacatttgggccactgtgcttgctctgggcttttgctaagaatgcataaattattattattattattatcccctaagccctgacccagaacacattttgtccttcctgctttctacccgccctatccaagctttaagcctcagtgtgtcccagaaatcttcccttgaccttctagaagaatcctctctctctaaattcctgccaccctcataaattcattccacagataattactaaggactgactctgtgaggcaggcactatggatgatgatggggatacaacagggaacaaaccagacaagattcctgctctcatggagtttatgttcttatgagggagacaggaaaagcaaaagtaagcaactcagtaagtcaaagatttatgcattgtcataactgtgtatgaacatatctcaaatctgtaaggtctccccatcttccactctgtcgaagaaagagcttagcttgtctaggtatgtcgaaaaggtttatatggccaatgggtgatggcatcagaggggcttgggtgaggctggagagggaggcaaggctagcctacaagggcctcaaagaccatgccaagcacctagatttcatgcttagattaataggaagaacttgcaagattttcatcaaagggtgacatgatttgatttgtactttatcacagatattctcaacagggctggagtgggggaggtgcaattttgcccctggctccgaagggacacttgacaatgtctagagacatttttttggttgtcacaacttgggagggtatactactggcattgggtaatggcaggggatgccgaggaacgtcctacagtgcgcaggcctcccaccacaaatatccagagtgctgaggttgtgaaacctgcttttggatgactctggctgctgggtgaagagactctcaggggcaactttttggcccctttgcattttaacaggggccttccggtgacgatgccttccatgagccatcagcatgatcagactagctgagcagaggaggcaccctttggaggtatcactgcacacgggccacctcctctgtcagagaggacaagggattacagagacttgctcacactgtaccctctccctccatggtcacagccgagatctcatcatgacagctgctgccagctcagtattcccctcctctctgacctcgcgaatgccaggcctgcacagggctgcagagaatctgggcactgacagcactcaatgcctggcactttacagagagctcatgggtatttacacaggcatgcaagcctgtcatcacagcctcaccatgaaaatcaacatagtgttaagggctctcctcttgtcccagtcccccaacttgaggttggttttaagatttaggacagggaagcctggctggctcagcagttgagcatctgccttcagctggagtcgtgatcccgtggtcctgggatcgagtcccacaccgggctccctgcatggagcctgcttctccctctgcctgtgtctcttcctgtttctctgtgtctctcatgaatgaataaataaaatcttaaaaaaaaaaaaaaaggtttaggacaggcatgattgagctgtactgataatgggaggtctagagaatatgtcttcaaaggaggaagagactggtacctcctcaggggtggggttggccaagcagatgacaagagagtttgtcttgtgttccagttatggaccattcttcttccatttctatggagggtgttttttttttacttttttttgagggggggggtgtggtttgtgtcatggcaactttgaagaaagctgtagaaaacctctctctgggaaaatgaatactgaaggcaaaagtttattgacaatttaggagatcctgaaggaactaattcgcaccaacgtgtgaatgactaacaaggatctgtatttccatcttaatggggaataaagcccttaacccaaaggaactggagttcttactagggaaactactccatcagtgggttgagacacactctaacggggctgggaaagcatctccctaacttctgaagccttcccatatgcccactgtacctactataaaactgggtttggaggtagggaagcaaaaagagaggaaaggcaacaggggctgtttttaggctaatttggaatcaacaggccacctgagacttgacccaatgtggcttgttgggaccacagtaccagatattcctggtcagcccagagcatctgatctcattaatgggccagtaaaaattaggggtacaaaggccgagtcctggcagctcaaatgaatctcctcagcaagagggaacaatcttgtaaagagctgtaactaagcaaacggaggactcattgcgtttcattaactttaatggtgctcgttaggttggcttccaagggctgtgggataggagagagaaagccagactcatcatcggggcttgggacggggctggctctcctgagcactcctgaggcgcccagcaccgagctggaagtagctgttcttgctgcccccacgggctccccagcccagcatgacatcctggctacacaggcaagaagcccaggcctccaggactaattctttcctgccagggtaaaaaaagacagggacaaagagcttggggcaaacccatctccaagctgggcaggccccctggctctgggcacccacatcgaggcccttcccgggatgtcaaaagtctggctccaatgctcaccaagcccgcgccacaggatcctgccagcccagagcccggccccagggccattgtcaatgctggccacgtccctgacctcctccttcttctccatcccagacgtgtacactgccagaaaaatggaaaacaaacagacagggccagcagaaaacacatcaccaaacaaacccgtctcacattgtcctctgtggtcagccagggactggagccagaggccacgggcctggaaaagccagaacagctccctaagtgcagcccctgagcggagcctccctccccctgcagggtcagctgcgcctcctcctccgctgctcccttctccatctttctttcccttctgttcattctttcccttccttttactttctttgtgtgtgtgtgtgtgtgtgtgtgtgtgtgtgtgtctttcccccttcttctgctctctttcaatgcaataagtccactaaacattgaagaaatcctgcagaatacctaggcccagagtatataaaaccaattcctgatgggagctgcccacgctgccacctcgcttttgagtcatacatcagggaggggttccagacccacgcacaacccagcagcatcacagggaacccagctcttcattgtctggctcacctttcagatcttcacactaacactcctccccttgaataccacatgattagttccctgaagaccatcccccctctgggtccttgctcacctcatgtcccccacccagaaaggcccttgccctcttcatgtaactccacatctgggaattctacgtattcttcgaggttgtctttaaaccctcccctctggggcgtccccaagattccagctggcattaatctgtctcctttgtgccctcattagaattttatgttggcacttttgtatttgggcatttaccatgttctaccttatattctaattatttagatgcaaatttctctctcctacttaattacacgaacttgaaagcaaaaattatgtcatctttgagttcccatatcctttaagttcctggcacatagtgagtgcacaaagaatgtcaaactcattaacaattgaattacggttatacagaggcacgcatacaattaattccacatcttaacttcaccatttgcaaatttgtgtgaggcactgggctccttgtgttggctcccgagggtctgctttccggcgtttgcccagggctggaggatggtatgttagatggcggcacctactggcgaaggatggcattagcgctgggtccgccgaagaggagccacccaatctttccctcaatcccaacaggactggaccggggcgtggggcggcgggtgccatgcggcaggagaggactacaatgacttcctctccctcttcagtagctttagactggtcaaggggaggagcatccctgacttagggccagggctcgttctctaccagcgcactgcagcctcctgcagacccataattttgcaggaccagagtaagacaaccaaggaataacaacctagctgagatgcccttgagctttgccaacccagcctggcatgatgccccagacagctctccacctgagacagaggaagagaggtggcatgaagggagagcctcttgccagacaagggaggcaaacttctgtatggatattgatgctcagcataagtacacagccagcaaacattctgaccccttccttactgaaagttttcagcttctcctaacaggattctcagttctatgggagcccttctcagaaaatacaatagaagctattggagaactgaggttttttttaaagagccattcgctttatgaattggtacatgaacaccttgaacttggccccagtccctccatccaccttttctttgttccagggtacccagaggaattacactgttaagtggagaggtccccctctgtctctccaacttttcctctggtgagaaaacccagtggggatttgggggagggcagccagtgggaaacagaacaaagctgagctggctctcagcaaagttccaggttcatataggaacacccctatattgcccctcctttgccacacctcggttaaggtttcaactgataactaaagatttaactggcaaaggcttaatctagctactttgtctcacagagatatttgtatttgggacccaaggaacacaaggtttagctcaaaggagtgaccctctttttttttttttttaaagattttatttatttattcatgatagtcacacagagagagacagagaggcacagacacaggcagagggagaagcaggctccatgcaccgggagcctgacgtgggattcgatcccgggtctccaggatcgcgccccgggccaaaggcaggcaccaaaccgctgcgccacccagggatcccaaggagtgaccctcttatgatggaattttaagcatcggtgggaaagatcttggatggagtggttgaaagataatgagagttctgcctcctgagcctgcttcctccaaacagaagctgcctgtggaccaaggccatccaccttggcccctggcctttggagagatcctgagctctggcttgcaaggttccagttctgcttctatgtcttccagaatctgagagtctctggccagagtggcttcataggccccagcatctctggggtttttcttcatcttggagtctctgcactgcctctccatttaaccctctgctgccatcagtcctttcagcaacccaaagcaatctctggtgggaggcagagagacaggtcaagagatattccttggcattcccttgaatctccttgggattcccatgaactcacattccttcattcttttattcattcaacaaacattcactgagcacacaactatatgctcagggctggggatacggtggtgaccaatatgggtcttgccctcaacagttttgaagatgagcaaaggaaaacagctcatcacagtacagtatggccagggccaccacaaggaccactgagctcaaggccagcaacaagacacatttaagctggatcttaaagggtagtggtggttttccagctggcaagaacatggtatatgccaggcacagtgttgtctaagtacagtgacggtgagatcagaagacaaacataagatgtcattggggagaagggtccaggactggcacagagggccatgtatgccatactaggggtgtggaacttacccctgtcaggcaatggtccacgggagatgtagcgagtgtccaaacgaaggtagtggcaatgggggttggcagaaaggatggatttgagggagatttcacaggatctggtgccctgttagatggagagaaagagtccttcggtcccggagaaacccacctggggctgctcagtgggttatggacccattaacctcaaggtggaggtcacaggaggaggacagctcacaggaatgctttgagaggaactgtgagtttggttgggtgtctattcagcttgaggtcttgaaaaaatgccattggaaagcactataaataggaagaaatacaggactagatagaaaagagaggaaggagctagagatagagatctgaaaatcagacacctagcataaaagctagaagaaaagtgggggttagggatgtagatctgggagcttttggcacattgtggtagctggagccatagggccccgcaatgtagagcaaactgtccacctactgtgtgctgggacttccatgagatttatcagcagtaactgtccaacaacctgcaacgtcagaattttatcttcctctcctcatttgctggatgaagaagttgaagctcagagatgtgaagaaacttgatcaaactcacccactgatgggctgggatttaaacttagaaccctctgaccacaaagccagtattctttccgccaccctcgctgtcactgggtgagagtccccagggaggtcatgtagtatgagaactgagaaaaatccaagctggaaacacttaagatgccagtgggggatctgggaagagaaagggctccaagaaggaaaagaaaaatgttcagaggcttctgatgacgcaaggaggtcaggctagataacgactggcaggcagccccagatagggaaacgtggaagtcactgggcccccagcaggtgtgtgttgggagccctgggacagactgccctagggtgaggggttaagggaagcaacgaagtggagatgaagagcaggtgtgctcgcagcagggtctggggaagtttgttgtctactgctaccgtaggatgctgcgggttgttctgggtttgtaggagaaggagctgaggtcagggattcaggagagggaggagatagctctagctcaccgtagggccaagacaagatgggatccttgcacgtgtatgtggggttggccttggccaagaggagggacccctctcccagcaatggaaggaagagggggctgggggacaggatgttcaatgccctctccgtgaaacagaagttgagggtactgatgggagaagtgagggggctgaggctggcagaggggaaaccaaagtttagaagagcagctgtgtggaaagggacagagcacaaacgcagggcagtttggagacttgcctcgtgatgtggaggggtctggaaccaggcattggtgtcaatgccatttggcaggctgggtatttttgtttccttcatggaagcagccagggagcaggtgggaaggaagcaggtggcaaagtgactcaggtgtgggggtgggcagggaggacagactgggtggacatggggccaaggggccaaggagagagactggaacaggtctgggcagcttggacgaggctgtactgcctccccacccaaatagacctctcttataaaggcaagactgagggtcttggagcaagttagtcctagaatcccagggccagaacagaccttggagagcattacttcctatcctctgcctatatgaccaaatggctcctgagtcatcccagataggtgggaaacaaggacagaccagggtcaacatgtccagtgacctgatatgatccctccctcctttcttccatttctttggttgttgttattctgagagttctctttttttttctctgtcaaccaccgatttttgtttatatttctatcttatccattgatttctctctaagtgtcatcaagattcacctcaaatccctcttcatccatgaagtctctacttggatgatagacttctgtttcctgacttttcatggcacttccatctggattgcttgatgttgcattcagataactttgttttgtgtatacaaatcttgccttcctggtgagattccagcatttgggggatttgccatgtgatgcagaggggtttggaacgatatgcactgatgttgatatatcttcttgagtagggaatcacattttctacttcttttgcacaccttaaagggcccaggacaatgtatattggggagagggtatgctataagtaccatattccacttgatagaaggatgcatgactgatcaaattatcaggaaaaggaagagtgagaattagaagaggtgggactggcaactctgagggtactaggctaaggagcactcatccatgagtcagaagtcagggaagacatggattctgcttctagctttgtctcttaaatttgtgtgacatctatgttctcatcagacaaatgtgatagctaaagcctttttttttttttttttaagatttattgatttacttgatgtgggagaggagagagagtcttaagcagactccacgctgagcatgaagctggatgaagggcttgatctcacaatcctaagaccatgaccccgagatcaaaccaagagtcagctgcttaaccgactgtgccactcaggagccccgatggctcaagccttttgaagttgtactcctacatgatcctccagaacaagatgactgccctattccctcttatgtgtgaagggactggtctgtgactctcactcagcctgtcccaaatgattaaactgtaacagtggccagaatgtgttaggactctgtggattcagaggaggctgcatagagaatggagggggtacacaagcttcagagtcaagtccaggcccaagtcctggctttttctcttcttagttggtcatctgggcaggttgacctacttgagcctcggtttttctcatcaacagaatgaatataatgattcttgcctgataggcttgctggaatgcctgctacagtgcctggcacacatagaaaagcactcagtaaacagtagctatgagctctaattggtctgagtgtctgggttttcttcacgcaaggtaggaggtgcaagggcatagggaaagcgggattctggaatgaactaccctccctggcaggtgcacttccttctactctccaacttgaaaatgctgctgacaagtgcggtgagtttgaatgcactgcacttctggaaacctcccagtaagaaaggataatgcacagaacctattggaaggtggtgagaactgagcccagtttgttgtactcatgctcagcggcatcaaagtctggcccaggacaagactgcttcttcccaggcactatgatacctttactatcaagcactgtggcctttgttctttctgagaagcagtcaaaataacagcagtagctaccgcctactgaatgcctactatgtgccagaggctttctgttcgttgcttcatgtaattaatgccatataatttcgaggtgggcatttctattccctttgtcagaagacaaaactgaagctcactgagattaaatgacctacctgaagtcacacagctagaaaattaacagagctgagatttgcttttttttgagagagagagagaacatgagtgggagtgggggcagagggagagggagagagagaatcttaagcgggctccacacccagcacagagccctactctggactcagtctcacaaccctaagatcatgacctgagctgaaatcagagtcggatgcttaactaactgagccacccaggtgccccaacagagctgagattggaaccgcagggtttcttttactctcaaacccatgtagttaggcagggatgcatccccacctttgaggttatgtgaccatacccattctgtagatgaggcagctgaggctcagagaagtgaaataactagcagaaatagatagatggctggaaaatgggagggcccaacattgtcgttggggtagtctaattctgacacataagtgttctccatcagaatatactgcctatcgaggagggtcactggacccattttacagatggggaagctgagatgccgagagaaaaagcaaaggctcatggaaggagacttgacaggggaggggaagtcccagagtatgatgaagccctggcagaggtatccctaaagcaggatcaggctgggtccccagcccagtcctctccctagacatttgcaggggaaattagaatgaaatgaacatcagaagcaatcccaaaggaaagggaaacctgaaagaaacctggcctgagagggtgtgggaggcccagagaacccagggacgtttttgctcctgccagtgagggtatggcatatgctgctgcttttgtaataccactcgtaagagtcatttcattatttcttccttgtcatcttcctgtgtcattaccccgttgtgagtccctgcagaagtggacagggcagagggtcgtgggaccggcccctcaattcacagtgcccagtgatagaagccttgcttctgttcccacagaatcctcagaagggctgggggtgggctggaaccagaccggatggtggggagcagagcagggacctgtgcttctgccagttgtggaggaagctcatctggtcctagaggagcagagcaaaagctggcaaaatggaggggggcaggcagaggaaaccagagtaaaggacactgaacctcccagagactcagcagctatgatagggcaaggtccacactcagggggccaggaaaccaccgaactagagagagggtctgaggtgacctatagatctgcccctacagactccttcattcccacctcccctgtggtctagagggtgagccggtgccctccaccctagggacccagagaagctctcacgagtgtccaagacaaggcagagacaaagcaaggcacggtgcagtctcccttccctgcgttggagggactcctcagctctctccctatgaccccatgtagatccagcaccatctggcaacctccaactcttcttcttctccttttttttttttaaaaaaaaaaaaaaaaaaaaaaaaaaaccactctcttgtttggggcagagaggatggcaagtttgcacttgtcccccagccctatacataattggtggcagcaggcaaagcagcttcaaggggaggggtttgccagtggaatgaaggagggagggagtcctagagtgacagagcaggaagggacctgggagatcacttgacccaaacttttgtggcctccacaccattcctgtgatctgtgtgcttccatccctaccatcatccataccatgccaggcaggggctctcaagacctcctctcggaggcttcctaagggcattgtctcctttcagccaaggggctaatccatcctcttcttttctagatagcactgagaggcccattgagatgtgatttgcccaaaggcaatcttcatcccatgacacagccaggacaaataccccaagtgcttgagtctgttttcatcctcctactcttctactcaatccctagggaaggaagggctcaagtcttctccctgggggctcaggagacctctgacacatcacacctgtcacctacctggtgtgagctgctactgtcaaggttctgagaactgagttattttcaggatgattctggtcatttcccttcctccctgggtaccctgagggctttgtgaggctagtctgggtcccaattgccttttcgctgcagaaagttggctttgaaataactgtctggaacctggcatggtctcaggctgacgaagccccatgctccaagaaagccctcactatcttttcaaggggtttttctctagtgatgagaggagagaagatgccaggctgtaaatccatccaggaggcagtgtccagggctcagagacacttccttttataccctttgcatatatatatatatatatattttttttcaaatatcattcatcactcctctgctgctgaatagttggagatatgaagcgttcagaatggactgtcggggccacatcctgaagctgtgagggcaggtttggagaagcgtgttgtgccgatctttgtgtctgcatttacacgcataggcatattcccgtggattagctttggcccctgtgccgagcgcatgagagttttatccgtaaaaccacctctgtaggggtagggtgactcagtgggctacctccaaggccttaactgcaagggagtgtgccctggggctggcagtttgagctgacggaagactactttcttcttggtcctcaattaaagtggactcggcactaggatcgaacactgagaccagagggtgtgtgtggggggtggggggtggaggtaagagttggcagggagtcgctcggcccgaagtcggcgccgttctcggtctttcttggtcctgtgcggccgcatctcccgtgcccggccgcgtcggccggcgggccggggtgccagcgcgattccgtccgccccagcctccccgacaccccgagctctctttgtctcggggcagaggtgtgcgtgcaaacctgcgtcgcgcggcccccagctcgtgcgagcgcggggggcgcaccctagcttccccgctctttcggcggggagagaggacgagccggagccgggtgctgtttggtctggagcggagcggggcttgcattgatccattgattgtgcgcggtctgcgcctgacctccctgctcccggggaagccgtctccatggagaccgggcccgctcccccagcgccggattgtaaattcctgcaggcagcggcccggcagcctggggagggggccgccgcgcccgggcgcgcagggggagcggccgccgcgccgaggccccatttgaaagaaaaaaggggcacgaaaaaggaggtggtggaggaggggggggggaggaggaagaaaacgaaaaggagcagaggagaggaggagaaagaggaggaggaggaggagaaaggcgaagaaaaagagacggagcccgagacgcggagaaggagcgagagaggaagaaagagaggcagaaagggcgtgtttctggcgcggcgtttcccctcccctttctcaggtccctcgctcgggctctgcgcgctctgccgccgcagctctctccgggcgaagccgggagttggggaggattggacggagcagccccgccgccgccgcccgctgagcccggctcggacacggcgggggctcccctccgtccgcggcgcccggcgcccccagcctcgtcgcgccctccgcgccgctctccccgcgtcgggccgggagaagccggcggcaccgggagcctcccgccgagggcgccgcgccctcgcagccccgcgcccgcagcccccggcccgggcccggcggggcgccccctgccctgccctcctctcccctcccctcccgcgcgcggggcccggccggcttccgccctcgcggggctgcgaccccagcccgggccgcccggccgcccgcggctccagccatgggctcggggcgcgtgcccgggctctgcctgctggtcctgctggtccacgcccgcgccgcgcagcacagcagagccgcgcaaggtaaggcaggaggggcgcgcggcggcggggcggcggggcggcggggcggcggggcggccgggcggcggggccccagggcgggcgcgcggtgtccgcggggccgggcaggtgccgggggcgtgcggctgtcagagcccggcgccgtgcggggccccggtcggggggcccggacctcggggggcccgggcctcggggcgccgcgtcctggccgcgaggctggaggggccgggagcgaccccgagcagtgagacgtctgcccccacccccggggcagaagtcgccacgcacctcagcattctccgcccgccttctgggccaaacgcagcatcttcgaaagacttctgtctccaaaagtacgagagagaatcttctcttctctcagacatgccagannnnnnnnnnnnnnnnnnnnnnnnnnnnnnnnnnnnnnnnnnnnnnnnnnnnnnnnnnntctcttcccttcacccaaccccccccccccgccccaaccctcacgcggagtcagacaaaatttcccagttgttgtcttatcagtagaaaaatgttaaagaaaaataggatctttcctcgaaagaccagctcgtctctcactggaaggtagggggctgaagaagagaagaaagatttctgactggctcccagcaagaatgtcgcttttctgcctctttggggggaaatctctttcctcttgcatggctttcatttcttatcataatatttatttattaaggcctcgggtttccaattccatttaaatccaggtcagaattgcattaaaataacaaagtaaaattccaggccagggagctctgacaggcccctctaggaattagagagcgagccagggaggccctgcggcccccatccctgaccccaggctcgctgccgggcgggtccgaggctctgctggcagaaaccaggctggtgggctacagttctcttggggacagcctcccctccccgttgacctcttgttgcacccttcccccatcatgtcctcacccaggaagagatttatatggacaaaaagaaaattcttcccgacaagccttcgctgaggaggatctgattctgcctattgtcccaggggctcctgaagccaagctagggtgtggaagtggctgagccagaagggaaagttgaacttgggcactggggaagcctgagcccccagcagtcaggttgctgtatcctggagcctgagcgcccgcctggctcttaggctgctcttgcgtactggatgggctcccactccgggtgaaaggaaggtgctgtaccaacactgcctcttcagctacctccttcctccaacctgccctttaacggagcccaagtggtggagatccgcagctgtcacataccagagctcacccccaccccctggcaatcccaaactgcctcttctccggtcctggctccagacagcccactaccactgccacccccagcctgggagcagcccctcttgcactgtggatttgcttgtgttttcataaacaaagctggcttttgtagtgtgtgctgacttactcataacatagaattagctggggagtttagtctgaaggaaggaacagatttcattcagtaatctagagacaagataagggcctctttcaagttggagccagtgtctgtagtggccctagtgagaccggggggctgggggcaagagggggagcaaacagtatatccagggaggttcccagggctgatggagactcctacaagggacaggtgccaaggggaggtcagctcatcctttagggacagaagactcaagatccctccacagggaaaaaaaaatccctccacggtgctccagggctccctctttcatcagacaccctgctaaacgctgtggagggctagggagatgcagccggagtagaggcccctgccctcagggaacttaacatcctaatagttgcatccactacttatattcaggccacacctgcgctgactgggccacagttagctgtgtgtcttctttccttctgacccttgagtctaacctggcatagaataatagcctgttatttcagctccctgtgatgctgctgttcaggaaatataccaaccggggctgccaaagattggctaatgacaggtcttttgggttagagggatgtttccgcacccaaacctacagaccagtgccgccggaaagccaagtactgacggggcacacagcggagtactgcagacactccttgctcccagacatacctcctaggtatccccagtgccaggaggtgtgcctttaatgccacatgcttttaaataaagctctggtgggtctctttatattacaaatacccttggtaaatgtcttgtgtggttattatacctctgggtatagtgtgtgtgtatatatagtatggttactatatttcagtgccttttccccaaagactccatcccaccaaagaactaaagtggaaagggatagggaggaggagagggacaaggaggggagccctgagtgtgcaagtgtgtgtgtggggtgaggttcaccacgatcacccacaggtgatatagctgggtgtctatgtctattgtgacttggtcattaagcctagagatgtacattttagtgtctgaaaactgtggtggacgaatgggtgggtaagcgcgtgtgactgggaatgagtgagcatgagggtacatggttttgagtgtttttcaagtgcccgtctgtgtattttaaagtagacagactggataaccaagataattgttaacttaaaagcattaatttgctttgctttttttggggagggggtgtgtgtgtgcagcagtggttaaaaaagacctaatccttgcttagggctcaggttacagctgaatgaaaaggtctcctggcctcccggggaaaacttgtccccagggcgggctcagggagagccagcctggccgcttagtttacctggttgttttctcttctcattagggataaaatgttgataaagtcgcgtatttagagtttcccagtaacaccatccccaggactgagcccgttcatctggtggcaaacagtgtctctctgtctccgtgcgtctctctgggtctctgtctgggtgtatgtgtgtctctctctttctttcccccacccctctcttcctctttaatgtggctgtttcctttcctccccgcttccctgggctcctgtggccagctcttacagtgaggggactgttcctcctagcccctccctccaaaatatgaaatgaaaaccataaccgtgtcagcgggtgagggtggccccgtgggcagccggctattgcctgtgccccatccaggccacactgggagagagagaaagcaagtcagtccccactcttggagcctgatcttcaatcagttgcttctaagcctgtctctccaccaccaccaccacccccctccatttttccagaagggtggagaaggggggtggactgcttagaaattcctcaggaatccctttgacctctcttctctcagtgacatgtcccccggggaggtgggggggaagcctggggccaggggaggacttcttcacttctcacccctcatctccttgagtctctgcagggtggaatgagagagaggggagcagaagacaccgaccaaggccagaattactacaggcggacagaaaagaaagttattagccacccctaaatgagattgttttctgaaaccttcaggaatccgagagcatgagaaccggtttgagatgtgagcggctgagacctgttgtaaaaggagccggccctgggtgtgagtttgggaatgcgaggtgtgcattcactggggcatgcaagcgtgcgtgtgcatgactcagggtgtgtgtgtgtgtgtgtgtgtgtgtgtgtgtgtgtccgtccatccgtgcgtgtgtgcgtgcacagtgctctggtgagaggaaaaaggaagcagggaaatgtgcattttgttttcgttggagaagtaaagaaatggaatggcttggtctggtgccttcgattgagagtgggggaagggaatggatggtttcagacactcttgtgaagatggagctggaggagcttgctgcctgagctcaccccagtccctgccccgggctcctgtccccgcttgtcagggtgtgggcctcctttgacgtccctgtacccctagcacatgaccacttgcaagaaagagtccctgtcagggctggaaactgcagagctgctctgaggctggcagtgcccgcaagaggcccagacctggggacagcttcttcaggctcagttagttataagacaggagtctgctgggccctggggggagaagtgatacggctgccaacccagtgacgtctgcagggttgaggacataggcacctgggtgaagaggggacatagaccctctcctcttccccagtggcccctctgtcaccagactggccactctcctcctgtgccctatactgccagcccgacgtagcatgtggtagggcagttagtgccagtggggttaggtagatgcagagcctgaggactggggcctttgagggaaaaactgaaattcccttcctcccttgtaaatgggctagagtattcagctctgaggttctgcacatcttatcaaaatccttcctgctagaagacagaagacaccacagcaaggctcagtcctgtccccagaccttctcaggccttctcgcctgacactcaggccctcttctccccatctgcttagtttccctgattgttttctcttctcattagggataaaatattgataatgttatgcatttagagtttgccagtaacaccatccctggactgagcgtgtccctgccacttggctactcatcctttcttcccccaccccagtttcctggggcccaaagtactcaatagtttcgtgtccccaactagagtgccccctccccgcccgggaaaacaagtgtgtgtttctgtgcctgtgtgtggatgtgtgtgtacccaacaactttgggaagttgagctgcagtggttgtgttctaggaactgaatactgtctaggcagggcccctaggccccagcccctggtcctataccgtatattctcagatccaagactagccctctgtgttttgctccagccgaaacatctcccctttatagaccaaggtactgttctgtcgttgccattgggtttggccccagaggtgaagagatgactcctaaatagggcgctgtggccctcactctcaactacggtctccctgcggctataactgcagccctagacagctgtggggtttggatttcagagcctcaggccaggggctgtccacatctggtccctgatggcgacaagctgaggagagacctgggcaggaggtgccggagctggagggaagatcgagaataaggccagagatggaaggaatccctgggtgagggtggagtgtcaggatggatgtgtgggcatgggggagggggccctgggagaaatggggaactcaaaggacagatcctggggagcaagttgacagagaggacgtttttacaagtttctaattatatttatttggagtttttcctctggcggtttgaagctgttaacagcaggaacctgtatccctggtgtttgtttttgtttctaaccagctgcttggcccagcagagtgaatccaagttggagacacctgcccacggctgctgcccaccccttcttcgctgcagctctgtctgtgcccaccctggtgcactgccctccttttcctgcctgccactctgcgctgccctccttccagctacccccatgcccaaagctggtctcccaacaggaacatccaaatggcagctccaagacattccctggttacgtatcgaatgcttgcttcatgcctgtgctttgcactgagttggggtggtggggtgcacaacaacgactaaggcggggattcctccctcgggtgtttatggaccataatgcgtagtgactaagcactggactgggagtcaggagacccagggtctggctctgcacaagctgttcactcttatcctctctgggcttgttccccgtctgtgtcgtgagagacaggaccatgtgaggaccatgcgaaatagcctgcgtcaaggctctatgcacataattatgcaccatctgatatcatcgtcattcatgctgtcattttctccatcaatataaagagagaaggctgataatcatgaagctggagcttgccttggcccactgcctgcctccctgcccctgtctttctagtgctctgttctttccttcctacccatcctctaaaggcctctgaatgggtgacaagactctcaggttcagccctgctcccctccggtcacctctggtcactctacagtcaggctggctcagcttatatataataggaagggtccttttttttacaaaagaagcaagtgctctgtgtcctctccttggggtcatttgtgtggtttcctggattctctccaggcattccttagtcctgcctatgctttgtccaggccgaggatgggccctggctccagctgaggtcacagagtcgcatcccagttccagattgggaagacagcctgaggagccagagctgggaagccaggctctaccagtttccctggttgcccttttgatctagaggtagagcacatgcacacatatgcaggttaaggtgtcatggccaaagcccgggctggtcctactttggatgttacttatgtgtgggaggcaacatggaggaaaggataagtaaacggaccagaagcagcaatggtatgctggtgtcaagtggactctggggccctgtcatcccgtgctagttagcactgaggctggggaacatctattggacaaagatgctccaaagagatgcctgagcagctccagataatatctgaagcccctgggagcctatggatcctacagaattccctaggaatcctaccctcgattcattggtcccagtctcttctggcctcagcatcaccaaatagatgtgtttaagtgggtctcttattttccctgagtttcctatccccctacccttaatttaagactaaatttcctaggactgtgctccacctagaacaaccgtggggtcacaggaaaataaaaagctttttccttgtggtaacagagaacggagaagatgacacaaatgtggacctcatctactcacccatcaacccatcctcctgtctgtcatttatatcttgttcattgctggatgcccagctcctagcacagtgtttggcatgttgcaaatgctcagtaactttgtgttgaatgcctgaatgcatgttctcagcccctagctgctatgtgggtttcaaagattatcagaagccctggcctcagggaggtttcaagagggagataatacatgtgacctaaaagttaaataatgcacaagcagcatgtaataggcattacaagactgtgattggccaggcaatcagagagcctgcactcagcccaaacaccctggggtaacctggcttgggcaggaaggatgtcataggggccattaggacaccaggcaggctgctttggaccttctcactggacccagcaaatctgcccacaactcccccgccacccagacactgaatgatagggacactacggtggtaatgtaaaagtgaggtggactctccctaggggtgcctgcttatctgcagcctgcattctgcatttccatttgttgttattcctgagttggaccagagcaaaattctggagcagacagagtatttccttgggggggggtgggggggggtctcctgcttccattttgaggtatacttccccatccttggagggaatcttagggctgcccatgttcaaataatccaccctttcagggctgccctctcaccctctatacaccaccccccacatcccagccttcctccctgcattgagcagaatttaagagcgctctgcaggcactgaagcaaatccagaagaatgtcaggtggcactggggaaagctactggcagtacaaccagtgcattcaaacagagagggtgaggcaggaggtcttactcattgggtatctcgcagccacaccctccctaattcagctttgatccagccacgtactgagggtgggataagggcacaaaaggataactctcacaaaggatcatggagggtagcttttggttcccagctggcccctcgcccacttcaccctcttccttgggcagttcccagcgtggtggagtaggcaggcagtggagaaggtaccttcaggtatgtatctccccaacatgccctgtaccatcacatgctctcctgcggctgcacgtcctcacaccaggcctgtagtggggcctttgatgaaacaaaggaggagcagagttgggggttaagaaatgatactggggagaaagttggagaaggaataaaaatagcagacctttttgagcacatactgtatgcctgcactgcagtgctaagtacttgataagtattaactcatctgatactcacagcagccccatgaggaggtgctattattactaaatgtgtttacagaggagggagcaggtaagttcagaggctggcccaggaccacatggacacgggtggagctggcatttgcactgacacggtaccactccagaatctgttttctcagacactctgtcagcttgcttcccagctcaggcaaatggtctgttcacattatttgagatgggaaaggaagacagaccacagcccagcccaacctcaccctcgaggtcctgatgcagccggtctaggagagtgcctagacatccacattttttttaaaggcccccagggaatcccagtgtgcagccagagttgagaaccaccagtctagaccaatccatgtccaactagcatcaacttgtttgtcaggccagtagtaaatacttgctccctgagagctatgatgagactatgcctatgggtattgaagggatcaccgaatggacaattctgggtgggcagatgtggtggaagggtgctctgaaagaatgaactggcaaaaggaagagacactggatataatttagggtcctttttcagagctctgttttgtttatttttagagaaggggagggacagagggagagaatctcaagcagagctccatgcccagtgtggaacctgatgcagggcttgatctcacaaccctgagatcacgacctgaacctcaattaagagttggaagcaaactgactgagtcaccagtagcccctcagagctctgctttaggcctgaactgattcaaaagattccattcaaatggttgaagggtcccgtccttggtggtgaccagccaagtgaggaaagctgaccatgccacacaggagcattagcagagcgactcagcaatggcagcaagtgagcagaggtaggctgagtcccctgggaccaggaactcttaaggaatagggcttagcaggaagagctttgggggagacaattctgagccagatttgggaagccaggaacagtgtggctagaaaagagaagactgtgtctcacatgtgaagaatgagatgtgtgtgaatgcttgcacaggggggagaatgcttagatgttgtagagggaggaggtaagagataaagactttcagagctgagactcttggctggagagggataagaaccatgagtgggaggtgagggagtgggtaggatggtgggaagagcccagctgttggaagggtctaaaggttctgccaggaagcctgggtttgctgccatcagcatcagtggcactcaggtactagcaagcattgaggtggaggcaaagcaaagaattgagagcccagatagtctggtgtagactcaagcgaagcacccagtaattgtgagacaggcctgttcctcggagatggcctagaggaaaggcttgctgatgggtttccaaattgccctactggctgctgggtaagggatggcgagagacagagagggctcaaagcaggatggacaggatgattattagtcactgggattgtccaatgccccatgccagcctcaaagactcacagggcgtggatataaatgtggggacagagaataaggactgggacctctggataccttgtcttaatgcgtttagccacacttgaaattacctcttttctcttctgacagtcaaatgcttagccagtctctaaaactcaacttgaatcccacgccttaggaagttttttggtccatccaggcctaggagcatcccttatgaactccaagagcagtgctccaatagaacttcctgtgattgggatgcctgggtggctcagtggttgagcatctgtctgcctttggctcaggtcatgatcctggggtcctaggatcgagtcccatatcgggctccccgcagggagcctgcttcttcctttgcctgtgtctctgcctctctctgtgtgtctctcatgaataaataaataaaatctttttttttttttaaagaacttcctgtgatgtctgaagactctccattagtgtcagtatagacatatctcagaaacaaaatatagagcaagacagcaaaatggacatgaataaatacaacctcatgtcctcacaaataatagtagacacaaaatagtatgcaattttggaaatgcaatatgttatctatgagtatacaaacaagaagagctacttttttctttctaatgatgctggatcattagcacagaagtcagggtacagaggacatctcctggggtggtggctaacagtgatgttagctatatctttgatatttcagatctttaaatagagcttaatcaaagcatacacaaatgtcagcagcaaagtatggatggtagggtaggaatatgggattttattttctactattggtagttatctcagtttttaaaattaaaaanggccagcaggtagacaccatgattgtagagcctgaggtggagagtaagtgtgagttacagcagttgggcatggcggactgccacagaggagtcaaagagagaaagtagagtgcagagctgaatagaagcccagaagattggaggcaggatttggggggcactcttccaaatttccgttctcttcaccccacgaagctttggtcctgcccccgaagtacttcttgaaatagggaagcagaggacaatgaactatttcaagcaatgattcacgggtgtctaagttggagtgattcctggtccacttgttcattcatattcagtaaaaatcaagcacctttaggatttggattccatagcttggtgataaggcctgagaatctgcattttcacaaaagccaggcaactctgcaatcctcttctcttgatcgcaaataccattcctttattggcaggttgctacttatacacttgggttccccagttcacagctagaagtagcttcttcctcctctgatgttccttttcacagagattctcagtcctggctgcacgttagactcactggggagcttttgaaaaatactgtgggcttgttgactaagacctctggggatgggtctgggcatctccaaggggagttaactctgatgatgtgtagccagggttgaggaccctgtcaccttatctctaatgtctctgtgactctcaaccacaccctacctcatgttactggtctctcctttaggctgggctgagtcacctcggagcctccacagccttcatcatagtaccttccacaaatacaccctgtagaacaattttcaaccgaatgtaacatgttgccatattttagttctgctctatgcataccataacactgccacagaagttggaatcttttgcccaaagatgataaatgattctctctgttatgtccttggagaaccattctcttttttgctagatcttggctggcctcttcgtttagcatagctctgggaagagcaccttgtgtcagagcgaaagccaggagtgagatgagtaccctgggttagatagaagagttcaaggtggcgggctgaatgagcctgagtcagctggagagccaaagggctccactgatcaggcttcaggttgctggtaccagcccctgccaggtcctggtctctctgctattgacagcacagaggccgagggaaatcttctaggatggaacttctttcctttaaagattcttggcgccttagtgggcaagtgggagcaggcctggtctcaagcagaactgtgaggcagatgaggatttctcaggtgccctgtctcctctgtttcttcctccttcaattactaagggccactggaccctgccgctttctcagaggccactgtccctgtgcttcttctcttcctcccacccagcccccttctaagcctactcataagagaggtgaactaattcacactgaattgaatatttctaataaaggtaagtgtgctacctaagggtttttgtttttaaatcagagtgtttcaaatgatggaattttagctgtcactgtggattaagtatttctgaggggagtgggggttctttctgaattcctgaaattacagagtcgacccactgtgaaatcaggagggtgtggacgatcatctgtctctggaagggtcactgtgtctattttagaggagagaggattttgcccttggggaaccaccttcaaggcacctgtggagtgtgctgacggtctcatgtgccccctctgcccctgccagatgtggatgaatgtgtggaggggaccgatagctgccacattgatgctctctgccagaacaccccgcggtcctacaagtgcatctgcaagtctggctacacgggggatgggaaacactgcaaaggtgaggctgggagggtgctggggagggggacctgcctgagaggggaaatcagtgccacaccaaggcctgcaatccctgccaccggcaggaggaagaggcttgggaggggaggctgttttttctcagagagggcaccacagaggccaactgaggctctggtgggaagagtcacagcctcccagctagggtgggagggggatccaaatcctgagatgaaggccggaggtgccctgccattgggacctccatctttagaccctcctaccattcccacataggatgagaacagacagttcaccgcaggggaaattcgtaccgtaaacaaacacagtcttcccctctcataattaaagcaatgcaaattaaagcactcttgagatgttattttagatttatgaccttccatgttggtaagactttagtggacaaggtacactcattaattcttggtgacattataaattgaagagtgatttttttgtcagacctagccagaatctgaaaaggtatttataccctttgacccagaaatttaattcctagggacttattcaagagaaattcaaagaaacaaaataatgtacagggaaaggtattctttaatgcattatttatgataagaaaataaatggaaggaagaaagagtgaatacattatgatatagcaatgcaatggaatattttacaaccacgtacaggtggtaattagaaagactgggtggagacctatgaaaatgtttatgacttaagtttatttatatgtatgtatgtatgtatgtatttagagagggagagagtggtgtggtaggaggcagagtgagagggagaaagagaatcctaagcaggctgcacatggggctgacatggggcttgatcccacgaccctgagatgaaatcaagagttagatgcttaactaactgagccatccaagcacccctatgacttaagtttagatgaaaatagcaaaatggtttatgggctatgaaagtaactatgtaaacacatacacacagagagaaaatatatatacatacaaacatacatatttaaaccaccgcagggctgagcccaggggaggacagtgagggagcatgctagtgggtccggctgcctcagatactctttgcccacagatgtggatgagtgtgaacgagaagataatgcgggttgtgtgcacgattgtgtcaacatccctggcaattaccgatgcacctgctatgatggattccacctggcacatgacggacacaactgtctgggtgagcaaaggagagggagaggaggtgtgggcaagtggtgtcttgtggggaaggagttgtttccagcatttcccatttcccagggaaaggtgaggagaggaaggtgatcaaaaagctgcattctcacaaagtaaagaacaaggtgagcctctcctttgagatggggtgctaaggatgaaataattctactgctggatgaaaaacatcagaggggatgctgcttgaaaatgctcccagggcaagggccagaggatgacaataatgggtgtagccacagggaacggagcatggtgggaaggcaatttggctccatgcttcaataaatgggaggaatgttaaatgatgatgatgatactgatggtgatgatgatgatgatgcatccctgggccccggggagcctctaacccttaaaggctggttctctcccagcttgtcctgcaatctccaggttcaccctttcctcacttcttctggcctgatctttgtcccaggaactgggtcagagataggagactctctaggggacaaaattcaactttggtctcttaatcattttggaaaattaccggaaccatggcagattcttccccaagtggaaacactgaagcccgaagcagagaaggatttgaggtgtgaggccaggagactggaagactagaagaccaggaaaggaagagaagaggaatgatgctcagaaaattgggctaggctgcttccccaccaaaccgataaattatctgaggttctattagttgaggagagcctccttcctacagtgctgcctctagacctaaacccagtcacatcccatctttgggccagacttataggtttccactgccaacacaggcctctatagcctgacccctatggggccttccccccagccctgaccacctggccacctcttctaccaggaaaggacctcacttctcttccactcagtcacctatgagggcctctttggagactcctttggaaagagaatctatgacactttgaccaggacagtgagtttcctgcaggacaggaaacatcagtttctgagttatttggttgcttttgacctttctaggctcctgattctcaccaagtcttgttttcctgtgatctggggagaaataaccagagggatgagagaatgaataggcataggaagggtcagagggagcaaaggtctaccaaaccctagccttagggttgtggttcaatgtctcaactctatctttggcttttaggggaaccctaagtcatccatgccctgggcctcagtttccccactgagaactggaagaaagaacttggctagagcagcaaagtcacaaggttgcactagaagggagcaaatagaaggacggacggtaggatgggtcaacagtgggaagacaaggatggggagaagtgagagagggggaagggacaggaataaggcaaaggatagtatacctccttgactttaccacagatacctctcaggcaggaacctgctggatccatgcccctctgcccttggccagaaagggggaaaaggatgggatttcagggctcagcagagaggatgggaagagaggggcagatgagggcctcaggagctcaaactccagctgctctgtttggagaccaatctccctgaagcctgctgggccaaggaaaaccgagaagggctatagactcaggagggcagtaggtagcacagagatggagtcaaggcattgaagtgggagccccagaatgagcttggctctgggacctgggggtggtgatttggggtagtaattagggtgtggcctggcagctttcctcccacccctccccgccaagctaccagactgttttgttaaaccaaaataggagaaaggctagggactgtggcagcaagcccaggcatggggggaagggaggaaggacgggactgtggcctgtccacagaaatggtccctgccctgcaaggagttgaggcttgctgcctttacccacattgtccctcagacctagcaccatggccacagccctccctgcacttagagccagttccacattctctcattccctggctgtgaccactgccccagtgcctctctctgaccaatccccatccttaccatcatctctgttcctcttgccctggcccctttcctgatctcctctgccctcacaccctgttcccacaagtgagggaaggggaggccagtcttcacctagaagaggcaggttcaaatgtcccctctccaccagtgtagctccccagctctgccctcttaggatgacaccttcaagagcagtggggcattcactgatgagtgggtaggaactttctggcctaaggcttggtgctgaattggggcagggaggttgtgctagattttaagaccgttctcagcccttgatgctaaagtctcaggatcctgggctgcaccccatggcctcaccacccacctatctacacagatgtggacgagtgtgccgagggcaacggtggctgtcagcagagctgtgtcaacatgatgggcagctatgagtgccactgccgagagggcttcttcctcagcgacaaccagcacacctgtattcagaggccagaaggtcagcccatgacctgggagggcccagctatgcacccccaggcttctctccacctgctgggaacttttccctcaatacccgctatgtctcaccctctgttcagaactccactagctccttttgctctagtccctccacttagtcatatcctaagggctctatggaccaacactgtgctggagcaaaatctggagttcatttggggttgggatcagtgtgggattgaggtaccctatggggtaccctctgtccagacccaagatggatgttgtgccaaaccgtggatggctgagctctcagctgctgttatctgaggacctcaccaatgtcttattcttggactggatagggaaggtgaggcaggaatagtggggtattgtctgtttctgtgactctgccatccacctgcaccccaagcctgcgacatccctgaggacagggctacgcctaattcattttgtgtcctcggaaccttatatactgctctgtatgtagtgggagcttaataaatatttgtggaataaaatcttatagtaatgaggggtactcacctggctcagttggtagagcaggtgacccttgatctcgggttgtaagctggagccccatgtagggcatagagtttactttaaaacttaaagtaattatctgcaccaattatttcctactcacattattatcttcttcctgatttgatggtaagctctttgaggaaagacatcgtgtttgtttgttttaaagattttatttttaagtaatctccatatccaacatggggctcagactcacaatcctgagatcaagagtcaccatgctccaccaactgagccagtcaggcactcccaagagatgtttatttttctgggtccttcctaaatccactggtacctagcacagtaactattagatactacttttggttgtctgaaggagaaggtgcttgtgcagggctttgggggcgctgggtatcaatacctatatatcattcagaatgactctgagccccactcattagcaccaaagcaggatggggggttggcgaggggagttcctctcatctgtgttgcagcctcagtggattctctcaatttcctaggccccaactatcctacccgttcctcttcctccagcatccagagatacacagagcactcacctccctcctcttcctttttagaaggaatgaattgcatgaacaagaaccatggctgtgctcacatttgccgggagacacccaaagggggtattgcctgtgaatgccgccctggcttcgagctcaccaagaaccaacgggactgtaaacgtgagataactgggatggcagtggaggaggagagacaaagaggaaatgcatggggccttggcagcaagacgtgggaggcaaagggagcatgggagaggcgactagaccagtctccatgctgtggagaatggtggtacccaaggaaaagcaagctgacaagcctcccaccctctctgcacagtgacgtgcaactatggtaatggtggctgccaacacacgtgtgatgatacagagcagggtccccggtgcggctgccatgtcaagtttgtgctccatacggacgggaagacgtgcatcggtgggtgaggccagtgaacacgagtgcacctgtgatgggggtgaggggaggggccctggggagcccagggaggcgggagcacacggggccaggtgctaggcacagaatgattggcgagtggactgaagacccagatgacaaggccaggtctagggaggcacaactctgagagcttgcagggctcactttcttctctgccccacccctgggggccttgccatcctctttatccagggcacagttttgccaaagtgggaataatcagcagaggtgcgtgttgaccaaggctgtgcttaggagggggaggagagctgggccaatgcaactgacaaagcctgacctgaggccctggtgactagcatgggaagatgggagccatcacatcccttggtctgcactctggaactggggttgggacacagtattctttcctggaacagccagccctgaaccaacaaatggggtttcctgactccaggtgtcttcctctccatcctgtgtatcctggcctgctctcctccctagcccccctcattgcctcctctctcctccacacctctacctgcagcccttcactgcctcaccagctccagccttccatccctctcgctctggctggggccttcttaacacctggatccctcttcctgaattcctaggccttaccgcacatatcttcaggtactatagatggatttaattccttaattcctggagctgaattcctaacgccttctgtctttaggtattttgtgaaggccaattactgtgtgctcacagagtgctgagagagacggtgggacaaggtgccccttggagaagtgggaaacaaaagggaagggtctggtcagggagccaggcaggggtgagcttgctgtgtgggcaacgggtatttatggaggtcggtcatctcaggggctacagaatgtggaggacaaggaagcatgaacacagtcactgtatatttgtcagagacatgacattcagcttaagagccagactctccccatctccctccagtgaccccacccgtctctgcagacagcactgccctactccctggatagaagaacagggaaacaaatgatgctgttagaggtgtcctccaagtacctgctccagaaacttcatacacatggctctaaacttctttaattaaactctctcctgctacatgtttccctctgaactaacccttcaaagggacacttttatgtctccgtgtcaccttctcctagctggttccttccagctcctttcatctttcccctcataagttgagttcttctgcttcttaaacctcccaccccccacccccaggacatactcccacattctcagagtctcccaaaagaaactgcatgccatccccaaagaaagctgcatgtatcaggacagagctcggactagtgaatgtggggccagctccctctctggcttccttttgttcagatagtcctgggcatggctgcttttgaaaacaccccatgtaagcttgagctcttctctaatgcaagacccaatctgtcttctggaccatggccaaatgaggcagaagagagcaaatgaggctgttctagggttgacggctatattcttcccaagttcttctccctcttttcccatagaacttattttgccttgtgctaatctcatttttctccccagccctggtaggaggaaatgtcattgtttggggccaccaggacattcaggtttagtggggagatggagaggccagtataattgagcccaaagggtgggccccctttgggatttggcaacttgtaagatttgaaatcacatcccagctctgccattggcatgctgtgtggtactaggcccatgacgacccctttctgagactctgttttccatcagtcacctggtgggagcctagcttctttgaggacaccaggcaggacaaggctggagagctaagtgtaggagtctctgggctcatcacttggggccagtggtttgggcctacagggcggaggagggtggggagggggctgggacacagtgggccacagtggctgctgcccagcatctaaacagcttttttacaatgtcaaacaggggaaaggcggctagagcagcacgtcccccctcaggccgtttctaatggtaaatatgtctgctgtctgttgctctcactggcttgctaggggaagggctaacctgctggggctcccactaactgcatgcccattgggcccagcctgactggactccagccaaccagcagggctcccctgaagcctgggtaccgggcccattgggtgacaggaaacccgagtccccaagagtgggccaggggggccttcatgttggttttgtccttctttgtttctgtcactctcctcctctccttcctctcctgctctctcctgccaccttctcccacactcactttttaacacctcaccccttttcagccatctgccccctccctctctctgccttctacacagcagaagatccagcagttccatctcacccgctgtgctcatgagatggctgagataggggtgggatagttacaggccatcccatccttggggttgtgtccttacccgggccagctcacagccccagcatcactagccattctgtcccaccataatgggtaccagcatgacatctgaattcagactgacctgagtttgaatgctgcctatgccactttctaacctcaagcaagctacttgcttctctgatcctcagtttactcttctattaacagggagactgagagttctcccttagggttgctgagaagacttgggacaatgtgtgcagaggatctaagtgcctggcacagagcaagcatagattaaactgtggtttaatcccccacccaaacgctgccctacaggagagggcagctatacccaggttcctgttctgacctgcatggacactgtgccagcttggctgccccccaccctggattcctccaaacgtacctagtcttggtgcaggatctctgttcccctctccctgctccagagcttgggggacctcttatactaagagcactcttggggggagtggctaggcttggagcttgaactcaaggttctctctaggttcctcccatggtcttgaggaacctcaggagactaaggtgggagtggcacataagagatcccactgtggctgctcccagacctgatcctggttgtatttgagcaacgagggcctgactagggacccacaggcagagttgggcttcttctagaacccttgctttggtggcctccttggtgacaagggttgcgcctggttttgggagtcaaagattcaaaatgataggattctctgctgcttttctcattcggttcccctgatttggggaaccactctcctttcttccctaggagagggcttgggattttgtctctccaaaaggagacctctaggccccccagaggatggcctgcacctcctccagatcactgggtcagggccttgcactatttgaactgacggttttcccctgcctgggctcacctgagctgcagtttaaacttgtttacgtcctcttctgaattcagaaaatagggagagtgatccatccatactccccctatggtgactcttcagtgaagagagaacttaccagtcaagaggggacaacagaagagacttagctctgaggttttctagttctgtaactcttttatctaccttcttacatcctgcctcatcctttggattcttcttttcccattgccctcctcccctacctagacagtctctctccattaggaaaggaaaacaacaacagaacagccagctcatctccatctggaacaaaagggaggtcttgggatgagttggatgtagctgggcaggggctgggaaatgaccaagtttgtgcctctcttctgagaatgaccagttaggcctggaactggggatctttttttaagagtgtggagccaggcggaaggggaagatgaattggtggccatccctcagctgtcttagggatcactaggctcactcttccccagactgtcctaccctggcccccccaaccaccaaagaaatagttggagggaaagaggaagagactcctatctgtcccttcttgttccctggcggctgagaaccacccttcctgagctcccatccctccctgcaccctccccactccacctcctccaccccctcagcacattcctgcctgacagctctggcttgtacctgcctcactgctgtccaccttgtttcaatcaagaagggggcagggaagtggactgcttggctgcacttgtgaggggatgggggctgggagcctccacggaatgctccttcgaaagcccagggaggcagctgaggccttcccttgggcctctgtgctctctactcccctcaagtctgggactcttccaagccagtaacccaattaccatcccctacctccctcctatacagagacctgtgctgtcaacaacgggggctgcgacagtaagtgtcatgatgcggccacgggtgtccactgcagctgccccgtgggcttcatgctgcagccagacaggaagacctgcaaaggtaagggctctcaggagacaggagcacagggggaaggggctgaggttgggaccagagatacagtaccttttatgagacctcctcaaccccccgaggctatactgattagaaagaactgagggcatggctaaggcttgtctcttttccacctttcccatcccagttcaaggggcacaaaagtccagccagttccttagtgcctcctgcccacagcctactttgttttccttactctcatttctatccctctatgggttcctaaccctcttgcttaatgagcatgccactctcatttgtccctggtctagaaggatatttgagccctgactgtgtgtgtacaaggtcacagatgtgttctgtaacctccttaacccacattccccagacctttccaagtggaaaggctatactggtcggagggagaataggtagtagctgggagtgctgatgctggagcctggctacctgggttcagatcccagctctgcaatccaaggcaaattacttagcatctctgtgcctcagttcccctacaatgatagtgcttgttgtaaggattagatcagttatatataaattatatataaagtacttagaatggtacctgacatatggtaagcgtcttatgttagtgattattatggtataatttccaatattgtccatcctatttcccttccttttaataagccaggtctgggagaaaggtggagtgggggagcaaaagggagggcagccatactgataataatgagtcatcaggtccgggtctcctggtcacaaggaggactgggttccttctttgtgtcttttggcccaacaactggtggagaggatggggagacagggagggctggggcagcaggtcagacagccagagttgagaggttttctgctgagaaggactgttgacagatatgctaagagtgaagtggaagacttgccctctctgccccctcccccaagtaggggtgagtagcctgggtcctgtctgccaccagcttggggaacttgacctcaggaaggaagctgctcatgggcccccccccttcccttccctagtgctgaaagccgcctcaggcctgagcctctccagacctcttgcagtccagccccctgcttgcctccttgccccccccacccctccccgcaactacccagcctcactggctctcctggaggtcctggtgcctggctgtctcctagctcctccactctgaggggctgcccctttgaatcccccttctctgtgccaccccacacaccatggcccagggctcttaggctaggtaggggtggggggcagcaaggtataaacctgatccaccagccttttgggggaaggaccatcagcacagaatgaggggcagaaattcacatatgcttaaaatgcctacctacttcctactccaggtagggagggcctgactctgcttcccatctgtccctttctgagagggctcagtcccaggaatggtgttcctaatggccacagatcccaggaagagggaagaaagacaccagagagtgagagaggggtcagaagggcgggcccagggctctgcttgattttctctgtctttgcaagggctggagggagtgagggaggcaggaaaggaggtcatcttatttgtccctggccttgggtatcacctttgattctctctacttcatcttgcttccccagacatagacgagtgccgcttgaacaatgggggctgtgaccacatttgccgcaacacagtgggcagctttgaatgcagctgcaagaagggctataagctgctcatcaatgagaggaactgccagggtgagcagacttgggccaaggggaaagccttgggagaggttctaggggtaggagagcttcaagcagcccagaaggccagagtcttgagaaggtcaatggacaccatggggagtctccatagccagtgtcatgccgcaaattaacagacatatcccttcctcttgatggaccagctctaccttgctcttggcaaggaggaggagggatggatttctccccaattcaaacccttggtgggatctgacttgcctgaccacatatggtggccctgatccacaggtaccagatcgcaccattccccactccaaagactgtaagtgaaggggcacagggaatgggcaggcaatgttaaatcgctgttcctaggctggtccatgagggagggccaaagcccctcacgtgggtccttcacctgggcaaggggtcccagtgtcaagtgtcccaagacagattcagtggcttgcatccctgttcttccagatatcgacgagtgttcttttgatcgaacctgtgaccacatatgtgtcaacacaccaggaagtttccagtgcctctgccatcatggctacctgctgtatggtgtcacccactgtgggggtaagctagcaaatttagacgatctgccacctggcccctctcacctccaaacccttcagttgaataagttcctgagttggcttatggctatgggcaatccccgggtgcacatgccatgtttgtgtccctcatgatgacttgggagaaactgagacactaggagacgagaacagagaacagcatcctgcctccccggtatctatcccccatcccatctctgcctctttgactcccatcctcaacctcctttttatagctccagtggtaggaaggagtggaaggctttaaaaagcttgtcagcggggtcccttcttagtccattgttctttgacatgggacagatataagggaagaaggtcctaggcttgagcttttcccaagacaatagtcatcttggagtgcctggaactctagccaagggtcctcctcactcactgccccactccctggctcctactgcgcccccaccattgttggtgtctctctactccttcccccagatgtggatgagtgcagcatcaaccggggaggttgccgcttcggctgcatcaacactcctggcagctaccagtgtacctgcccagctggccagggccggctgcactggaatggcaaagattgcacaggtgggcagcaccctctgctggccagagctggcactgcacttttgcgggtgggtgggaattggtgtcctgcgcagagaaagctgtgaggtagtaggggaggagaatgtagctatttgagatagagacatgaagcttctggtaaagaatcccttcatcagtctctttacaattaaccgttctgcgtgtagctaattctcttcctccaaattagcaaaaggtgaaggagggcagaagaggaagaccctctcttcctcaggtctctctccccttcctagagccggtaaaatgtcaaagcagtcctggtgcctcaaaagccatgctcagctgcaaccggtctggcaagaaggacacctgtgccctgacctgcccctcccgggcccggtttttgccaggtatatagaggcagttgctgcaggactggcagggaggaaaggttggctgtgcagggagcccttccacttcccttgcattactccaaccagcgggtgttggggggccaggccagagctgtgacagcccccttttctcagagtctgagaatggcttcacggtgagctgtggcactcccagccccagggccactccagcccgagctggccacatcgggaacagcacaaactccaaccactgccatggtgagcaccagcccggaggccttgttcccaccttatccttttgcttagtcacccctatttctctccattaatcgtcctggccttacttgttcctggatccccttctttgccctgtcattcttcaaaccttctgccttgctccctctgcccctaacatccgattcccctggctttcataacctttctccagccaagcccctggcttgttgcccagctccttgataccctccacaggggttcccacccccacagggctcccaggccatgctgagcttttgccatccctctagaggctgcagtgctatcagttaaacagcgggcctccttcaagatcaaggacgccaaatgccgtttgcatctgcgaaacaaaggcaaaatggaggaggccagcagaatcctggggcaaggtctggactggggaccccactccaatgggttgtctggccaccacacccttcccacccctcagttcctctgtttagcgagatctccaaaaaactactgggatcctgaacatcctagacagagcaggggaagagatccctgtaggcacaggacccaaggaagtcctgggatacccccccacgccccaccaccaaataactggtatcctacattaaaagcgaactgagctagttgtggagatctggtgaggtctgtctgggtcggggtggaaaagtgagagctgggagtgagaactttctctccccaggggctgcccctgggggttgacaaggcctctcccccagggggtgccccctgctctgactgccaggtcaccttcatccacctcaagtgtgactcctctcggaagggcaagggccggcgggcccggacccctccaggcaaggaagtcactcggctcaccctggaactggaggcagaagtcagagccgaagaaaccacaggtgggactgggggcactgctgggaggagggtggagagccgggggtcagaggtggggaagccacaggtctcagcagcaaaggagggggcagcgcctctactaagggcagacccggcccaccgccaagcccaggggccagtctttcttaccatgcccctcctagctttgccccctgccctccagctcacggccactttctctgccttccccgactcctaccatcatctaccaccagctgcctgtggactgcactgcctccgacagcgaatggaacgacggctgaaagggtccctgaagatgcttagaaagtccatcaaccaggaccgcttcctgctgcgtctggcaggcctcgattatgaactggcccacaagccaggcccaggggctggggaccgagccgagctggtggaagtctgtaggcctggacagcaccgtgccggggccaagtgtggtaagggagcttgctggggaatgagggagtgggaagggcccgacttgagcctgacccagagcaggacactttacagccttggttgtacttcaaaccgtgaggcagccaagaccctgtggcctatcaccctcctatccctcgtcctgggctgaaatctagaggatgttatgtctagagggaccatcaacccccctgtgtgtggctttggcccctgatcttcccaagcaggattctctctattcccaggagattctccttgaatctgggggagtgggaaggggaatcccaggcctgggtggcgggaaatagggggggtgggtggctagcacggccgactctccctcagtcagctgcccgcagggaacgtattaccacggccagacggagcagtgtgtgccatgcccggcgggcaccttccaggagagagaagggcagctctcctgcgacctttgccctgggagtgatgcccacgggcctcttggagccaccaacgtcaccacatgtgcaggtgccagtggggtcgggtgggcactgggacgcccacgggcatgggatttcccaagggcaggcccaggctccagatcactctcttagcctacatcctgttttgtgtgcctctgtcccctgtgactgggtgatcccgtggggatgaccaggaccatccccatcagagctgggaccttgattcattgcaggtcagtgctcgcctggccaatactctgtagatgggttcaagccctgccacccatgtccacgcggcacctaccaacctgaagcaggacggaccttgtgcttcccatgtggtgggggccttaccaccaagcatgagggggctgtctccttccaggactgtgacaccaaaggtgaatgggctactcgctgggggactccctagcttgtactacttccaagaaaactctccaagtcctcagagcaaacctaactatgctgccctaccatcttccccagactgagcaaggcccacctgcctgaccaaccatactgtcctgctcagagggcacatcctgacccaccaccagcctcaggtctaggaattaggaaataaataacagtcccacttaccccatcagctctggagaactggtaacacattcccttagtattacagatgagtttctataggtctggcactaggctcaagtgcctgaaagaaaaggattggcatggtagccaattactctgttcaagtttgttcatcccttgggcttacagtctggcatgactaagaaaggctgggactctggaaggaactttggtgtcttcagtcccctgcttctccatgatgaacatgtcctgctcatcccatgccccagaacttccactttcccaccatctcaattaactcctgcctttcccccttgcctgtagtccagtgctcccctggtcactactacaacatcagcatccatcgctgcatccgctgtgccatgggctcctatcagcccgacttccgtcagaacttctgtacccgctgtccaggaaacacaagcaccgactttgatggctccaccagtgtggcccagtgcaagagtacgtggcaggccagactgtggaaaacggggtagagaggcctgggaatggtgggcatgggaagatgttggggtgggataaggaaaccaacagggagcaaggctaggaagtggactggcagtaatgtcccactttccatctctctcaattcactcaatctcaagaccagtagctgggatgggtcctgtggcaccctctccctggacacaggtaatggggaaaccaaagaggtgaagtgagacaagaaggtactaaaagggcagaaaggaagatggacccagaacttggagacagatgatgaaccaggaaggtggcttgcctacatgtgtctggtttccactttgaaatgcttcaacatccctaacccatttccctactgactttacttctctttcttgctctctttcttgcaccattctgtacagatcgccagtgtggtggggagctgggtgagttcactggctatatcgagtcccccaactacccaggcaactacccagctggtgtggagtgtgtctggaacatcaaccccccacccaagcgcaagatccttattgtggtacccgagatcttcctgccatctgaggatgagtgtggggacgtcctcgtcatgagaaagaactgtgggtggctacagagctgggccaggggagggcagttcaaataagattgggaaggagaaagagaaagagagggagagagattagtacaggaagaagtggggaagtgagaagggaggccgtgggaggagagctaacaaaggaaaacagcaatgaatgttttacgtttgatggagagcagagttaaagccagcactgggactagaaatctaatagggttaaacatgtgtcactttcctgttctagcatttttgctcttccattcatttaaatgtcaaatttcttaaactctgtgggtgcctggatgtcaaagaggagttgtggaacaagtggagggcagggggagaagacatgtatatgctggagggtgggggaggtgtgtgcactgggagggggtgggttctgtcagcatgacttcttcccccacagccctcctccaggagggcttgggcagcctgccctgctgctctcctgacctgcttcttgccttcccagcctccccatcctccattaccacctacgagacctgccagacctacgagcggcccattgccttcacggcccgctccaggaagctctggatcaactttaagacgagtgaggccaacagtgctcgtggcttccagatcccctatgttacctatgatggtgagcaggggcaggaatgccagggaggtgggtgagaaaggggaggctcatgagtcttcgggggggagcagggagcgcaggaagagtttccagccctaaaccgctccacttggttgattttgcagaggactatgagcagctagtagaagacatcgttcgagatggccggctctatgcgtctgaaaaccaccaggagattttaaaggcaagtgaacatgcacaacagtaagaacagccagcatttaatgagcgtgtaacagtatgcaggcagtaggctgaaagcttacatgaatagtctcatttggtatgcatggtagctctatgaactaggtactttcatcattcccactttgcacctaagacaactgaggcacagagggttgcagaacttgccgggtgtgtctgagtccatctgactgcagagtcactcacgctaccttacactgtggggggaggcagatgaggagatgaaatgcctcctactgcttgcacagtaggagaaatatggagcacacataatatggggcaagggaggtacaggaagatccttctgtataagtccctcccctccctgcctccctcttcagttcccacagaaaaagagcagatcgagtgcagcatgacctgttttaaagaaaaataaatgttaccagcattgaagaataaactagactcctgggtttgtggatcccagtttgagaaaactttacttagcaaactacagtcctagccacagtattatccttcacaaattatccatgcaagaaaaagttttatctttatggttactaaaatcatttttataaggccatcagaatgagagacacaatgacaaaaatccagaacttgcagactacaaaggaaataatttcagcactgctttttgaacatgttttagagcatctgaacccttaattcagatgtgctgtggaactctgatgcatatagtagtggagctgttttgattaaagtggagatgagaggccggaagccctgcctcttcttttaaaaacctgctgatgccaaagggagaatactagcctagaagccagaagatctgagtctcagtgcacagtgcctggcacctcataggctctccacacaccacattgctgtttcagacagaatggtcagaaaaggcctctgagaagagacctggatcaggtaaagagctacgtgttagaagatcaggaaaggagcatttcaagccaaggagcatgggagcagtgtggcatgtctgagaacccgcaggaggccaggggagctcagcagaataagaaagtccaggggggctggagaacagagagcagaatatggatcacgttcagtccatgggccatgcaagggattggattttactgggtgaaaaaaaaggaaccagagaagtgttttgaatagaaaaaggacatgatctaattaaaaaccaaaaaaagtcacttgggctgctttaggggagaacagtctattagaggcacaagggtaggtagaagcagggagaccagttaggaggctactgcaagtagtccaagtgagagatgacggtggcctggacagggtggtagctgtggaggctgtgagaagtggtcagaccccagatatgttttgaaggtagaatcaacaggattggttgtggttgtgggcaagagagaggagtcaaggatgactccaaggcctggggcctgagcatcagaagaatggatggagctgcaaatgactgagctgtaagattctcaaggacgaacaggtggtggggttggaaatccagagttcacctctgggtatgcctattcaccatcaagaggggctgcttctaagttgaggcttggtgttcctctttcccactcccaatgctgaggctgacatggctacctgctatcctctgcaggacaagaagcttatcaaggccttcttcgaggtgctggcccacccccagaactacttcaagtatacagagaagcacaaggagatgttgccaaaatccttcattaagctcctccgctccaaagtttccagcttcctgaggccctacaaatagtgctcctggggcccaagacccaggttttaaagcccccagactccttagccctcagagccggcagcccccatcccgagatgaggaactctctcctctctttcttttggaggaaaaaaaatatcattatagaccaagcactctccctttctgtctctctagcttcctttcctgcctttctctgcctctttctttctccctctctctctctttactatggtcccttttccttacatactccctggaaaagccattaagtgctggctctattccccctgaggggtgaaagaacagcatctccttccccttccccttcccagccacactgcccattttaccagctcacttccctggccccatcagtttggaagggtgctagaggcccatgaaggaagtgggtctagtgggggatggggagggggaagaagggcttctgccattatagggtcgtgccttgctagtcatgagccaaaatgtcccctggctgtgccccccagggtgattcaaacaacccagggttctgccaaagaatccttgaccttcaggcttaatgccagcactggtcctctggggcgcgtggtttgagccctggactgcccacacagctggctttcttgtctacacagctcctctttcttcccccacatgcctgcttggggtccaatccacgagggctcacaaaaggcccataccactgggctagtggatactagctgaatgaggaaaaacagcaggcattaccatgttgaatgtgccgctgtcactccccaagaggaaagacttagctctgcaggacagaaaccaggttttaaagcatcaccaaaaaaaaaaaaaagaagaaaaaaagaaagagaaagaagaaagaaaagaaaagaaaagagaaaagaaagaagaaagagaaagaaaagagagaaagaaagaaagaaagaaagaaagaaagaaagaaagaaagaaagaaagaaagaaaaagaaagaaagaaagagaaaatgtatcatctgaaggactagactacaaaattggaagccagcctcaaatactaaccccttttctttcttgtcttcctggcccagccatctcctcacccctacctgagtgctccctgggggagccctactctccttgctaagtgttgtccttagagaaacatggctgctgaccagaagccagcctgggccttgccccaaagttgtctttcccttgtagccccagatggcttgcgggctccaccaaagaggatcctgctcagcagccagccaagagccacctacctctggccccaagctgtgggcaacaagaggaatgtgtgcacacttggcgagccttctgcccaccctgtccacatctaataagtgcaatcattttgagtcttcctatgttgtctagagggaggagttttgttttctggttttgttttttgtttttgtttctttttcctctattagaacaaccctatttatagctgcccaagagagaagagtgtatgtttgaagtggaagaaaaaaggttttgaatctcatgaaccttgagtgctggagcatctgatctgtctctgctctcccaccagtggccatccagactgctggagcgctcagctgggggaacccagaactgtagctcagaggcacctgatgtgtagaagtaattctggggacgtgatggagcaagaagagggacctgtgtttgctaaaccaatcctgccatccctgtgtccccccatggactcagcatggacctcatggttgtagaggccaatgaactggtcagtgattctccaccctcaaggagggaaagcctccatcttttccctgccttcatcctgttttcccccaggtgtgcacatggaagaggatcaggaccaacccccaggggatgggctgactcagggccctgaggccagagacaagcctatgggtaccaagaataggacaagttatctaggcatgaagttgtttgcctgaccttggcggtctgccattccctctgggagcagactcaagactagttcctccactactgtttttcaaaaggaagaatccaagtccatgcccaagctcacatcctacacctcattccactgctgcctataaacttattttccacttgctccttttagtttacccaaaactgtagaaagctatagttctattcaatcaaaagctgccgattaacttctagggttcatttctaagtgactgtcctaggcttttgctcccccaggagactcgacactaaacaaaggggtttgcaccatcccctcactccctaatcagtaggccttaggcagtaggtagccaaggtcaaagctagttcccctgagctccattagccaacaccatgacccttggaagcagagtatctggtttcttttgtctctctgagtctctgagggctctgctataaagacaaaaaaatggctgcttgcatgcaagaaaatggccatttaatagaagtatcaacacttcccaggaaatgccatgaaaactgctttaagcaactctgaccatcctaattctccaccagaagctagggtaactttctgattctctccctgccattccatctctcttagctagagagtacttctcaattttatgcctcagggtctggcttcttgctctcctcctttcttgtcaccccatacatatacacataaacatacttcctccaataatttatttcatggtttctggaaactgcaaatgatttccacagtatggaaagtatgtatagaccactaggcttcttaactaatgtcaaaacagatcttggtgagcaggtaaagatttgctaatgtccatcacgcttagtttaggtcgtcctgcaagttggggttagcaatccaggcaaagctgctgctcaacctatggaggaggccagtcctagggcatcaaaccagggggtgagtggactgaatgagtcaacactcagggactctctaggcctttacaggtcagacagaaaaaagggttttaccagtatagggaaggaagatggtgtgaatgggaacccttcatgaaccagtcccaaggcctctgcccgaaggtgtgtttacagggccataagaccgtgaggcctcatttatcttagtataaaacctgccctgatctgaatctggggatgggaagccatttctgcaaagactctgagcgccaagtggtacacatcagaaaggcacttaaatattcagcaacatggcaattcctttttacttttctgactccctctttctatattactaggccaggtccattccctaaatctgaaggaatgggaaggaaactctcagtcaggagaaaactgaccagagcccagacttgagctgtcctgccccagacctataaactcccagaggcagacattgagttgtgactgctctgagtaactccagccaggattggtttagtttgaggtaatggaggctcagacttgttgctgcaagttcagttatacagccctggtctctggctctaaagaagttttttgtatctgagaagtgtactccctatgtatgtttgaggggactttgtagtggattggtaggtcatatctcaaaatgtcagaaaacagagtattcaaacttttgtatttgttgcttaacctcaatgtaacaggctcaaactaggggaaaggagacaaagcataacagatcataagcagaaaataatgttaacctgcttggcttctttctaaagcacagtaagagaaaaaagtggaagcaaacaacacaaggacatctttaaatctgacctgtctcaaagatagcacaccctgtccttgggccgttatttggactaggaaccctttaagaaaatatatgattagggagaatagaacccctagttctgttattagcttatctacacaacacattttagcagtttggacaaactgaaaactttattctatgtgagttaaactgaagtttcagagaataatcatttctacatgggagacttttttttaatgcagaaaaaaaaaatctcaaaatgttgtatttatatctgccttccactgctgccaatatagtaagcatctcctacacaatcaacaataagcagtaaatgatgcagttcatagagtattttgcacttggggaaaaaatgtatctgaacttgtaaaaaggaatgtttggattttgtattgtctttttttattattattattaaaatactaaatgaaactccttggcctgacatcttttcctttgtctcaatagtttatcctggagctgaaatagctttgaggaaacaaagtatcttctggcttccatacaggacttatatttttcatttatccatcttattcctaatgattttggaatttgaaaaggcctgtctctttgtcttttttttttttttaaagattctatttatttattcactagagacacacagagagaggcagagacacaggcagagggagaagcaggctccacgcagggactccaggatcacaccctgggccgaaggcaggcactaaaccactgagccacccaggtgtcccatctttgactatttttaaaggcagtatcaagaattatcccttaaggagggtctagggagtaggggaaatttagggtatttagtacagttccccaaatctagtcaggccacaggttccctaattaagatgtcccactctaccaaatgccagcactgagagtcacccaaatttgttccttttatgcagtatactcttggtcacccaacagaattttgaaatatcattcagccactgagaccattactactacagggcaggaatgcaatttccaatatcttacaaatgaatagtcccaatttctaggctcagagatgatagataaaacttaattgttataattctataattccctgacatgatattttattggatttaatatctatatgatgtagcaatttaagagaaacaaggcaaaatctacctaatcaaaaaatacgttgggttggtctactagaaccctgaatttccctgtttagcatctataaaggataggcaggcacattcacctcacaattactgaactgtaacgtgccccgcatcgtgcatcaggctatctgtcatagcttgataacaatagccatgctcaagatccatactcctcaagggaagaatctgattacaactgacctttccatatatattttccaacaggagagaaaatccagtctacctggtcactatgagtataaattaattcactgcatttgattttatacattaacttcctgtaagtttgatttagtgtgacaaaacatgaacacttgaccacaaaatcacatttctagaactgcaaacaaggaccgatacaggactattatgactatatcaacttggggccatcctctgacttatcctttcactctcttttttattccaaacaccaagtcttctaccttcttcctaggacatttgtgaggatgtcccaggtttacgtataatcaaggccagtagagtatagttctatctatatcaaagtcttttaaaacagggcacatgaaaactttctagggaattcttaacaagggtatgtgaagacctcccaagaggtactgggcaaggaatcaatctgaggggcattttaaggaaataagtttccagatactcagcttctattagaaatctttccccaaatgaatctgtttgagaaccagccaggatacttaaacacactctccattctacctcctctttcagcatagtccttatcctactttacaaaagaaaggcatatccctcacctacactgaatcttcgtgcctaggatataaaaacctggggaataggagggaggggttgtttttttccactcatagaaaaatattcctattacaattggtccatcttagaagatgtttactgttctctacctcctactagagaactaaattgtttattagctgttcaatccattatctcctagcaaatatcctttctttaaaaaaaaagtaagaactttttaacattttttttacttttttacagtaagaaaaagtttgtcatgaaatctaaaaaattatttggagttatttctgatttttaaacatgagtcttatttgtcccccaaagccaaacatcagaattcaacacaagcacatacccatatatgccaagggataacatgccttctaatctactactcacttattagctagtggatttaactacatattatatggcattgttccaaactatataatgagaaacagtactatcttgtttttacaggtttttgtaatgttaatattaactctataatttttttagattttatttattcatgagagacacacagagagaggcagagacacaggcagaaggagaaacaggctccatgcagggagcccgatatgggacttgatcccaggaccccaggatcacgccctgggctaaaggcagacactcaaccgctgagccacccaggcatcccaactctatataactttaatcatgaccaatttttagtaatctattttattagctatagctaataatttctttcccagtgatttttacaatattctttaaaacagatattaacatatttatttggattgaagaatgaagtcagactttttcctaacagaaagtaagtctaatttggctgattggtttgaaagaaaaatggctttgttaattccaaaaatggcaagtgctttccatactgaagtcaatctgcacttcggtattttcacaaaaagatcataaaaacatgtaatgataaaataattttataaaaaaaaaactgtattggtaaaagagtatgaaaattagtcttcagggatacctgggaggctcagttggttaaacatctgccttcggctctggtcataatcctagggtcctgggatcaaggcccacatcgggctctctgctcagcagactgcctgcttctatctctccatctgctgctcccctgcttgtgctctttctccctctcaaataaataaacaaaatcttaaaaaaagaaaatcagtctgattaacaaggtgcctctgagtgaaacaaggtaacaggtaactaagaataatttttataaaactgaaactgagactctaatgactagataacaaatccttttgcaagtttagtagtttccaattctttccttttaataagattaaacgactctatctgatagtacttgagaattgtatttggtaacaggatgctttgtaattgttggcatgtattttaggagtagatcaaaacttcaggaattttgctgtaacaaatctcttcctttctcaattactacatgaacaagctttctcaatattcaggtctataaaaataaaaaccaaagaatggatactgtaccttatctccttttaccattaggaatacctaataccatgaatacctgaaccaattgaggaacacagtatttctcattaagggatgcattttctttctttctttctttctttctttctttctttctttctttctttctttctttctttctttcttctttctttctttctttctcttccttccttcctccctccctccctttctctttctttctttctttctttctttctttctttctttctttctttctttctttcttttctttctttctttctttctttctttctttctttctttctttctttctttctttctttctttctttctattattcatttaaggaatctctatacccaatgtgggactcaaactcaagaccccaagatcaagagtgcatgctcttctgactaagccagccagggaccccaagggatgcattttcaataaaaactgttctttctaggtttcacatgttataccaatatgtaatttatttatgttgtttaataaattgtgtaccagtaataactgtaatgacaattcaatacagaagaaactttttaacaattaaagcctatggtcacagacaataaacttaaatttacactcattcttgttgcaaagaactgtgatgtgatcaataaaagtctttaaaacatacaaatacactaatttggacacagttatgtagaggaagtgaatggacttaggagttcaagaagaaagggaatcatataaagtctctactaaagtagagcttgttcatgtatttttaaatagataatggtgggcatcaagtatttagggtatttggagtctgctggatacaattaagagttacagtatggttttagtttaaaatgttaaaatctacagtaactcagaagtcatatcttctacaagttcttaaatatgtgatggaaaatttagataccaacttttttttttttaatattttatttatttactcatgagagatacagagagagaaaggcagagacacaggcagagggagaagcaggctccatgcagggagcccgatgtgggactcgatcctgggtctccaggatcactccctgggccgaaggcaggcgctaaactgctgcgccacccagggatccccgataccaacttttaaatgaacaagagggtacacaatcatctcaaattattcaatggagtccatgaaaaacaaaaacaaaaaaaaaaatcttaagaccactagcctctatgggggctcaaaggcagaagataagctgtctggaatgacctccagtccttccctccaaaatatattcctcaccagttctcctaagaacctgaaattacccactatcagaatcttattactacaaagtcacacactgatttcccagtttttattcactgtgtaaataggagaggtcatgagccaatcagattggcatctgcacggaatgtgagaaagggcaaacgtattttttattatggaaaaaggtgcggggggggggacacaactaggacaacctgagttccattccctactctatttctcaccaagagtttatgctgtaggacatgctatgtattctctcggtaggtatgtaaaatgacttgtcaaactttgaccaaaaaggaacagaagggggcaccacactagtcaggctgtttatttctatactgaggggtatataaaggctctgttattaactgtaagcaggggccctcaattgtcactcactgcccactgaaaccaagaatccgatgagaacttgggccccagtcccacctctggaaaggttgtgtcaaaacaagtaagataggcaaggggtgatgcctaaaattggaaagcaagctttctggttaagctctgctgacaggggaggagaaaaagatgctgtcagtgccctcaatggcatctttagttaccatagcccccaaatccagtactttataaatgtttctctttaaaaaaaaatgtatttatttttttcatgagagacacagagagaggcagagacacaggctgagggagaagcaggctccatgcagggagccagacgtgggactcgaccctgggccaaaggcagatgctcaagcactgagccacccagatgccctgtgaatgtttcgatttcatcagaatacttcctttgaaaattcttttttttttttcttaagttaaattttttggggtgaggggagggaggatacaagggggaaaaaaagttcaagtctaaaggacagagagggaaaagtttctcacctcattcctccaggcacccagttcctctcctaagaagcaaccttgaccagttccttgtctaactcctctcagttatttctaacgttttaccaaaaacctctcgctcccttttaatgttcccttggatttctgcaaattcccccatcacagcccttccctcctggaggggggttagtagcaaaagggcttggtttggttcaccccgaagcaagccccgtggggagcagctggttttaaggctgcgcgtggggctgagggggaatgagagtgagagaacccacgaggaccgtcagggcgccctccctggagaggcacgtccctcgcggctcctcggtgccgtccctttccagaagggcctagtaatacctgcaattgctttcttcaagggggctggctcgaagatcggaggcagtgcctgcgggccgcgcacagtaaagcgcttcggggcggttaggttcagcagaagcccgggggctccgaaccccgagaaggtccgcagccccagggcgggctgtgagacccccgggaatggcttccctcaccacctaatcctccggtcctccccggctcctgaagcgcccttctcgcccgcaggcagccgacgagacggcgaggaaccctcgcggcctccgctcctcaccgttcccgcctcgggcctcaggtggaccgagtccctcggcgggacagggggcggctccccattgctatggcgacgacccggctcgccagccgcgcccaggccccgaccggggcgtcgtgacgtcatcacgccctccccgggcgctcggcctcgcgggcagtgcgtcacccggccggggggcggggcggggctccgaggggcacggttcagagcccggccgcaccggctccaggggcccgggaacctggataagcaggacggcggccgcggcgacggggggtgcggggtggagcgtgccctgtatttcctatacgggttccggggcccggtagaggcgcgccgcgaggagaggaaagtgcggcggccctggaacctggatatcgcgcgaggcaagctgcgcgcgggcgggcgggctatggcgcaggcgggttgcggggccggcgctggtggcggggcccggtgcatggcggtctgtcggcggagtcgccctcgggggctgtcaggttggtggctgcgggaagagtgggtccaccgtgcccaggtgggaggccgggcgggcgcagggccccgggaaggtcccgagcccggcgtgcccaccctcctccggccctagcccagcgtccgggcggctagacggcgacccgacccctcccccaccccgggccccggcccccggcccccggcccccagcccccagcccccatccctgccccttctttccgccctgggacgccccccccatgacttctaaaccccacccaggctcccaaaccccacgcccgcctccacctctgtgaccctacacaccatccactgaccctaaaacctgcccaggcaatcttcagttcttattcattgactctgtccatccaggaatttccccagcactgcccagggatccactaacccagaaactccctcagttctaaaccaatgactcaagacccgagacccccacacccctccgaagtgacccccccccaaccttttcagtgaccccattggtccggtaactcccacggtcctaccccgtgttgacccacaaacttggtgacgcccctcagacctttcttggtaactcttaagccgtactccaataatttcccacccagtcgtcttctacagaaccctcaatatctaataaccccttcttttcccctgtagcctcatgatcttcattccatgctcccccttcaccctaaaattacccccaccgacatccctctctgcaccctcagcccctcaatatcaatcagcacatgacttacaagtgcccgagcaccgtgctgatactcaggaagatgtagcgatgagtatgaagtagtggtagtagtagttggaggcatcaaagaactctggattgagtgtgtgatcccacactcaagttccagctctgaccctgttgtgctttggagacctaggacagcttccttttcgctgaggctcagcttctcatctgttttgttgataaggttgagtaaagtgatctcagagtttccttccagctgtaaaattctgcagttctcagtcaagataatatttgtttgcaatcatttttgtaccctccctagaaatttactcttgtaacctcacttagggcccactcgcttcatgaaccttattccctcactctcatgaccccgtaccctacactttgaatagtccattcccatttcctttgatcaggcccatcagttaacatgtttgcaaagcagggtagcagagcacttcagctaggagcattgatgtgatgagagaccttggttgtagtctgactctggttcttcagctgtggcacctcaggcatggcatttagcctgtctgaatcctcagcctccacctctgctaagggaaaatgataatcttgcctgagatggtgcatgcaaagcactcggcaccatgcctggcccatggaaacccttagatataagctgagaaactcttatggctcttactctgtcctgggtaactagggattcaacattgaagacagggcccatacgttacattacttcaccaccaccactgaactcgtggaatccccatctcatacttctgctgtggcctcctctgattctttacttcatatctctttaattatgattggccgagcacctgctgtgtgccatgcctgtatgtattaaattaaatttacccttcaacaagggtaaatcaccaagagttgattattactgtatccaccaccatttcacatttctgttggtttggtttggttttaaataaataacccaaaacagatgagtagcagagcgagtatttgagcccacatcttccaaacccacttgctccgctgcctctcttgcccccaggaccggcagagttttccggatcacccagagccccttgttccttagtttctaatgattcttaagcccaacatcaacctatgtcatgacccccaaactttctgttacccttcaccccatggcttagtgacttcctcaacccatggttcatgactttctgccccacattgcctgagacccctgcaccttaatacttttcttcgtcttttctccacatagcctgtcacagtccttactccacaatctcactcgccctaaaggggctaccatcttcctggcacttttccccaaactgactcatcctgctaagtctcttccccaccaggagttcaaatactctaaaaccctgaggcccagtaatctttcctcataggatttcctattttcagtcacttttcagtattctagctgcctcctttcaaccatcctcagccatgtcctgttacccagagcctttagcccttttacctagtgacttccccagcttcagtgaaatgagccccttccatcctgacatgaacctatctttcataacctctacaccctcctattctaagacccctcttcaccttctgcacagtatcctgtaagatcctgcctcccatatccccagatctcatctgggcatcctcctccttgtcatcagtgagctccgtttcaaaccagaattgtcttcaccctgtttcccctccctgtatccctgccacttctcacagtactcagcatccttcctcttatttttttttcccagccatcctcaccacatcaattttgataacattgattatcatgcaaacgtccctctcatcccaattctcccttttcccactcttctgtgcatctaactccagggccacatgaatgaccctgccactctcagctctcctacattcatacaccgcactgtccatccaaacctcattggcttctttggtttgtccaaagaactacactcttctctgggaacttctcatcatagatcaccagatcacagtcctttaggtaacaaggagagagatcttagaaatccagaattgatctagcattgtctccttgacacactcccacaatcccatttgatttttgaagctgcttggtgtatatgccctcagggtggaatgttttgggtgttagcttctgccggcattgaattagccccattgttttccaagttctgggaggactttccagttccctcccaccagaacactggacagtgaatagcaaaatgtgacattaaagatccacatcgcaaagtctgttctgtggatcactaaattcccaggtctcctgtgatgttcttgttggctgtatagcaataaataacagtaaacctagacttagggaaagagtaaaccctggagtctacaaattgacttgtaaaagaagcttttgccttaggcttgcttaatctttcttaggtcacagaacttctgccgcatatcttaatgatttgggtattcacccactccccagccccacagaggctgggttttctctgtcttctatcatcttgctctgataccttgtattatggggtggtctgtaaatactgactgaattgaatggactccctcagaaattctgtatcaggtgcaaacaagtaaaaacaggtcatgtcagtgttcattttgtagacccagaatccctccccccaaatccctgcagacgaataatgggcaagtcccttgatttaaacagactggaatttagacacttcctttttcagtctgtcaagtgggggaatgggcatagtatttgttttgactatatatctggtaagactagagagattggttgccattcttgcaatacagtggtaacaaggccagggtctgttatatacagaccagttctcaagaaaacagccaggtgaaatacttactggggtttgcaaagacaaccagggaataggagaaaccaaattggcaaaatgttggcaattgttgaagttggataataggttcatgagacacgttacactcttctttctagttttgtgtatgtttgaaatccataatagaagttaaaaaaaaaaaaaaaagacagctagatgaacaagtgcaaacttagcactgttccttggaaaacacctcaacacaaatgttactgagtcagtactattatctaggttaggtagtatatttaggtagttaggtagtatatttagtctaacctatccctgacctcttctgtttgtgagtagcaggatgctaaataacaaaaattagcaccctgcagaattgtgtaccagtggcccggatattgtaacatgctggcaataagcacctattgccctgaacctgagaaggtaaggagtgggggtaggtgaaggagagaccagagctcaactaggatcttctccttctggcataaggccttcgggtactgggatatcttaacgatatggatgctcgttcattcattccattcattctttctcattgccaaatgtttgctgactatctgctagaggccaggtaatttgctagacatataataataagtaaagtctatgttgaggaaattaagcagagaagagagtaccaggagtcagagttttaaattttaaatagggtgggtaaggaagttctcactgaaaaggcaacatttgagcaaaaacttgtaggaagttaaggagtgagtcaagcatacatctgggggaaatgtattccagtcaaaaggaatagcaagtgcaaaggcctcagagcaggagtatgccttctatattctatatttgaggaacacaaagacactagccagtatggcttcagtagaataaaacaggaaaaacagagcagaagatggggcaggtgggagagaattggtggcaggtcatgttagcattttgttgtgcattaagagagaggagccattagagggttctaaccagttaagtgacatgatctgacattcaggaccatctggctgctttgttcagaataacctgtagaaggcgagagtggaaggagggaaactggttaggaggctaatataagagtccaggcaggggatccctgggtggcgcagaggtttagtgcctgcctttggcccagggcatgatcctggagacccgggatcgaatcccacgtcgggctccctgtgcatgaagcctgcttctccctctgcctatgtctctgcctttctctctctctctgtgtgtgactatcataaataaattaaaaaaaaaaaaaaaaaaaaagagtccaggcaagggaacttgatgccttggacctaaagttaaagcagtggaagagtgaaaagtggttggatattttgaaagaggagccaacaagatttgccaatggattagaaaagagaaattgacgatagctccctaatttttggcctgagcacccaaaggatggagttataatttactgaaataggggagccaagaggagggggcaagatgtgagaaggggtagataaggaattcacttgtgaatgtgtcaagtttcaggtgtttggggactcgagatgttgcataagcagctggatagacaagtctgttagacatgcgtaaatttctgctctcctgagaactgaaagaacactatttcctgagcaagagacaaggcagtacagtggaagaacactggcatttcaggtgtgaggcctggctctgccaccagctagttggtgatcctttggaactcttcccacagctctggcctccagaacttcatctgcaaaatgactgcattagactagaaatgagcgctcttctcagcccacactcattgtgagagtcagtgaattagggctcagagtaaacaagataacatctgtgtatttgagagcattttgaaaactgctgagccctacaccaggtagcagtgttggtcataagattccttccttcattcctccttaaagtaatatccagtgagtgctcgacacaggatacagtggtggagaagatgcatccatgcccccgggtaacactacagactagtttgtctggtgcaacttcgctgctaaatgtggaggaaacaggccagaggctggtggtctggtgtgacattagccggggaaagcctgtgcttttgcaggctttaagcctatggccttaagctacggacaaaaccgcagacacctcttgatctggcagctctctgtcaaggtagagaaacgtgtgtcaagtgagggtctcacagatcctaacctgggtctgggaaaaaagtgaacatggatgtcagagatgaggcaagatgatattccaagtgagggaaagtggtcattgttcctggggtggtaggactctgtttctttgttccttcattcttacactcaacatatactcctctgctaggatcttctctttaggagctcatgggtttttgttttgttaactattttatttatttgggagagagtggcgcacagggagagcacaagctgggggaagaggaagaaatagactcaccgctgagtggagagcccaacacggagctcgatcctaggatctggacctgggcggaaggcaaacacttaaccaactgagccacccagacgccccagagctcattgttctatagtagtttcaaatcctgcctcaggagtttcaattagatctaattcacagtaagtggagttgacttaggattcaaatttgagctaaagagcttgattagctatgtgatctaataatattattcatttggaatctgtggccgcattcttcgttaggtgctaattacgccaaagtgcatgctctccagaaactaagttataagcagtgtaacagaaagtaggagtgtgttattttccccccagaagagtcagatttagggaagacacatactgtggcagagtaattcctttgctgcatctagaagcagtggctgtgccttgtttatccttgtgtcattcagatgtcaatgtttatattataaggagagtctctgaccaactaaataagagtacaagatatagtccatctccattgacaggtcacccacaaaatttgtttagagtggatatgtaatcatctttctttaatggaatggggaagttttgtcctggtgaatgaaacaaaaccactgagataaaatccaagtgcagctgaagccattgtctttatcctatggccttaagctacggacaaaacctcagacacctcttggctctggcagctctctgtcaaggtaaagaaacgtgtgtcaacctgagggtctcacagatcctaaatggttgtctctgttttgctgctgcagggcctatttaagctcctcacttatagctcagaatcagaaagatgtgggctgttggatgtgatgtacaaagcctaaagcctcacagcacattagaatgtcaccagctggaagtcagagcacttcttctggtacctctggattaacattcgccctgaacttgccctcaggatatggttcatctctgagaagcccagatagaacttgctagcttggtactttttctcactgtatttgttggaagcccctgctgctgtgggatagttgataaagcatgactcccatgcacttatggtaagaaccaaggaaatgagggctctgtgaaattgtagaactggcctgaatcttagatgtggaggatatatctgaaatcagagttctctttgaggatatcatcctctcaacctaggaaggaagtactgtctgaggccacagaaacaatgagggagaaaacccgtacctagccaccacttcagcggaacccgcccttatgacctggcgagggccatgtatgctagagccagcatgtcctcaggtcctgtgcaaatttgcagttgcctcatgttcagcttgatcacttttccatatgatccatgaattgtgaagctatgttttcaggcttggttttcctgcaaatctataacctggaatctatgctgtcagtactgaactgagctatgcctcatgaatggagaatcataaatattcctatagccaaccaaaagtgcaaggcatgctttcagactgttttttattccttcatttgtacttgtttattttacatagataatccattcatgagacctaagctcagtgaaaagtcaaccttgtattgctcttcccccactcagttacccttctacaggtgaccctagttagtaatttcttgactgtctttcctcagatttttggataccagtgatgtcatacagaaggcactgttttataccttcccatttttttaaattgaatatgttttggtgatctttgcatgtcaatatgtaaacaccttcctcatttacctatgtctgcatagtataaaagttccatattgaaaaaaattgtttttaaaaattaaaaataaatttaaagttccatattgagagacatttatactgcttctaatgttttcgctattactacatataggggtgccataactaacctgtgtcattgtccagacatgcgtgtcttcctgcagaccagacatgaaattgctgggtcagatggtacatacatttgtacttttgatcaatactgccaaattgtcctacgtagagctcataccaatgtatactccccaccggcagtagaagagtctgtgtgtttcccccacagcctcatagacattgctctgagttaaaactatacagatcaacataggatattgagcaacggggccccaccttgacacactattctgcaggacacacaaaacacagcacagccccactttgaggaataccacacttaaaaacgtagccaccagactctggtggttagaagaaaggaaaatcttagaggaagaaacttcctacctcagttcttagactggcatgaattaaaggagaaatagatgtctttttttttttttttttaagattttatttattcatgagaaacacacagagagaggcagagacacaggcagaggaagaagcaggccccacatagggagcccaacgtgggacttgatcctggcactccaggatcacaccctggactgaaggcaggagctcaactgctgagccacccaggtgtccctagacatctttttctgcaggacttgggagggctgtgggggaaataaagggagatcctgtgagggaggagcttgcaaccaagcaaatgtgtttagtgttcactggagaagtacctctcagctccatgctggtttcttatcatttcagcaactttatcttttttaaaggttataccccttttagtgcaactgttcatttctttttggcctctttggttctcacctcacttgaagttaaggtgtctgcaagttgaaactggatgagtgttcaaccttatgtcctgtttcacttagtgttcatttgttaactttcctccattaattcagatggtcctcatggttcttgtccaaaaagcttaaacaagcatcctgtgcagtagcgtttttttctgtgcattcttttttgcggaatgaattatgaagatgaggttcttagatctgagatcctgaaccttccccggtggggttaagcattgatggtttgtcctctgaagagcctggagcagtctctagtgccatctgcaagcccatttgtgcctgcctcctgaccttgccgacatggatggacaatttatttcttagagcattttaggtttatagagaaattgaatataaatgcagagagttctgggggtgcctgggtggctcaggtcatgatcccagggtcctgggattgagctctgcattgggcttcctgctcagtggggagtcagcttctccttcaactgctgcccctccccacactttgctcttgcacgcacctgtgcgttctctctctctctctctctctctctctctctctctctctctcgtaaataaatgaaatcttttaaagaatgcagagggacgcctgggtggctcagcagttgagcatctgcctttggatcaaggtgtgatcccggtgtccgggatcgagtcccacatcaggcttcttgtgggcagtctgcttctccctctgcctatgtctctgcttctctgtgtgtgtctctctgatgaataaataaataaaattttaaaaaatttaaaaatgcagagagttgggatccctgggtggctcagcagttaagcgtctgccttgggctcagggcgtgatcctagagtcctgggatcaaaccccacatcgggctccctgcatggagcctgcttttccctctgcctgtgtctctgcccctctctctctctctctctctctctctctcatgaataaataaaatcttaaaaaaaataaagtccaaattaaaaaaaaatgcagagttcccattcacccccttccccactccagttctgttttccctattagtagcatcttgcattggtgtatatttgctataattggtgaattaatattgatgcattattattaaccaaagttcatagtttacattatggttcactctttgtgctgtatattctacaggttttgacaaatacataatgtcaggtgtccattgaccattacagaaccatttcactgccctaaaaatgctctaggctccatctatgcatccctcctctcttcccaccccctcccccaccacacccttggcaaccgctgattttattagtgtctctaaagttttcccttttcagaagctgtatagttgaaaccatactgtatgtagccttttcagattggcttctttcacttagtaaaatgcatgtaaatttcctccatgtcttttctgtgtcttaatagttcatttctttttatcactgaataatattccattgtctgggtgtaccacagtttgtttattggaggacaccttagttgcttcgagcttttggcaattatgaataaagctgctgtaaatatccacgtgcagtttttctgttgacatgagttttcaacccatttaggagtaggaacgctgaatcatttagtaagactttaattttgtaagaaactgccaaactgtcttccagagtaccatgttgcatccccaccaacaatgaatgaaagttcctgttcctccacatccttgtcagcattgagtgttattgctgtttggatttgggctattgtgattggtgtgtagtggtatctcattggctgtaggatgttaatacttttactttgatttatggtaatggaataagaattataccactgtgattgttcgttcttgtacttcagttactaatgagagtgagccttttttgcattatttatttactactagcattttccttgcatgaattcatattgttatgtgtccagtgagaatttgatattgttcttggaaatttaaatatgtatgtgtctacgtgtggttttttttccacaccattttttttattgtggtaaaatacacataactgtcttcaccatttttaagtgtatatttaaattgcatgtgtttttaatatcatgtcttatattttctttagtatttcccttaatactgatttttttaaacctgactcttcttctgacttgattttcttttgcgtcaaaagtgaaaagtatcttctcttcctagttgagatttgactattgttccaaactgatagaataaatttaaccttttagtcccagggtgatgtttttaaataacatgatgatcctaaataactatgatgatccagtccctcctgatggctgatggcatgtttcattttcaaataacccttcccaagccagcagtgaccccaagctgaattccagaaacaaagtcagatataacttgataaaatctgtataaatgtgcatattgttataaaacacacccttccaaaatgactttattctggacttttctttccatggactaaatgtggatttgaaacagccatgattccatgttgggtgttaaggtgttaaagttcaccttaaatttcaactgaaaattaggtttttaagttacctgttttagtttaaatgaattctgttctgcagtaaaggagtctgcattttcattgcccttttggaattaaaaataatccagtttgcctaattactctctcttctgtgactaattcaaatctataaaattgtagtagccaaataggaaccatactaaaaagtgatttgagcttttaaaatcagtgtgcattttgcaaagagatgtttagctgatgttttaaatgtgtgtgtgcaagtttctgttattaatttcctgttttctctttagtgtttggaaacccacagaaccaagcctgttccactagggtttttgtgtgtgcattgaagtcattttctataataacaaatactgaatcattttaatacagctcttgcaaatctggttctcatttgtttgcccgtgactcgctcagcctctgtctctcccaacttaatacaattctgtcccctctgagttttatttctaaatgaggaattttctgagtgaaagtcaagtcttgtgtacccccctcccccgcaaagttaaacattcttctctttccaagcagatgttttgttttgtttgggggtggggggttgtttgtcttttggctgctgaatacagttatcctctggtctggctgaaacagagcacagaaagccttgttccaaatgtccaaggagtctgggtttgccagaaaatgatggaagagtgaacaggtgcctgtagtcaaggcgaagcctagcttgggtatgggtcagattagacatgaaccttgccaaagtagagagacacaaatttatggctgccatttagtttcttgtctttcattgtctgtctttctgctttgaggagacaattgaagcacttcttgtttcatagaaagacctaagacccgaagtacccaaaaagcttttctaaatgttctgtctccctgataaattataatttaggtttttacattaggaaacatttatatattatgaagccatagggctcttttctgcatcagagccaacaatagcttaagttcattttaaaaagcaacaaacaagctggctgcaagctctggaagagtctggagtatgccctattcttccctacccatggtcatggctcttattcctcccctcccctcccctcccctcccacaacccccagtctgtctctctcttgtacccggcttaggtcactggggagctgacaaaccttataccctacaaggagaaaatagagtagctgcccctgcaccccctccatcctttctcagaaggccacgggagttatgaatctgaaatgtcaagtgcaggcaggaaatgtgaagtcacagccatcctgaggcagtgacaagcctctctttggctctgccagtatcaccattattagtttagtaccagcacagaacgactcagagtaaagcatcctttcacagaggaaaggaagaaaagtggcaattagatacttgtacatgcctggcagccacaagacacttccgcacccgaggtcaggctctgctggaaggcagcagcagagatcgggaaatgttggagagccagagtggactatcttaaatgtttatattacgggcttaaggacaaaaattgaatagttagcctggacatgagaacatgtaaaggagtggagatttgttttctttaagtctaagaagcgttattttggaaaatgttcctctttccattgtgctcaagtcctggaggactgggcttaagttatcgtgggtgagataaaagttaaacaatcaatagtcaagtgttttgagtgctgacactgtgtcacagtggattagcataaggaagaaatgcaccagatattgaaaggtatggacctggaccagctagcctggctttgaatccttgcttcacattgactagctgtgggaccttgggataattactctgcctctaagcctcagtcacctcatccataaagtggggataatgtacctatttcttcatagggttatttttaagattaaaagagctaatataggtaaagtgctttgaacaatggcttgcactcttaagggctgtatatatgataaatataattagcatgagcagtgcaaaggattttagggtcatctggggcagcacttcattttacagattgggaggcagacacagaagatagacttgagatcagaagccatttcttttaagattttatttacttatgagagacacagagacacaggaagagggagaagcaggctccttgcagggagcgtgatgcaggacttgatcccaggactccaggatcacgccctgggccaaaggcaggcgctaaaccactgagccacccaggattcccggaagccatttctgcagacttctaatccagggctgtttccactatttggctacagtttagaaatacccattgcttcaaaagcacttcccttgggttcctcttccatctcatcctcctcagagccagtttttctagggtacttctgtgtgccagcactgtaccaaatgctgacatatgtgaccttacttaatccttacagcaacctgtggagagggtgctatttggggggagcgggttaaggatttctttctttcattcattcatccatccatccatccatccatccatccatctgaaatagagggcaagtgagagagagggagaagcaggctctccactaagcagagagtctgatgcggggcttgatcccaggaccctggaatcatggccggagctgaaatcagacgccaaccaacaagccacccaggtgccccaaaggtgctattattatcccccccccctttttttttacaagtggcacctgaagctcagagaggttcaattacttgcccaagggcacacagcttcaaagagggaaagcatgagttaaagcccaggctttctgactctagaacctgtgttctcaaccaagccacagattttccttagaaagtcccaacagagtacagatgtactaagttaaaccagctattgctgcagcagccacaggagccagccataaagatttgaggccattttgtaatggctttggtttcagactgaggtctcatgtgtgtccttattctgactatgttgttaacaaaaacagatcaccaaaagaatttctctccctgcttaaagtcaagggtcagggagtagaccaaaagaggccaggaccagagcttgtggttatcagggctctggacaatgttggggtcactgccaggatcttagtagaatagataagatgggtcatgggatccctgggtggctcagcggttgagcgtctgcctttgactcagggcatgattccggagccctgcatcggcttcccttcatggagtctgcttctccctctgcctgtgtctctgcctctctctgtgtttctcatgaataaatgaataaaatctttaaaaaaaaaaaaaaaagatgggtcagatgtcagttcccatctaaaccagtggttctttacctttaatcgctgtaagacactcgtgacaatcttaaactcccttctgttcggaaaaatgcataagcttgcacaccaagtagtgttttcaggtggcttcagctaaaactccccagctaaaaacctctgtactaggccacataataaagtatttaagagcatactctggagccggatggcctggattcaaatccttctcttccccttagctgtgcaaccttgagccaatttacttagtgtctcaggcttcaattccttcaagtataaaatgaggataataacagtattcaattataggatcattgtgaggattgagttactatgtataaaatgcgtacacatgattagctttacagcactgttcactattaatgctggtagtatcttagcccattcggtaaatgtttatggacagaatgaatgaataattctggtgggaatgccaagtctaaagtagaacatcccaaccagtgtgtcacaagtgggctatagtcctgtaaagatattgacctgctcagccccagctggttgctcctagcttcaagcagcagcatccactgtgtacacacatccttctctctgggtgccctgacatgaaaacagtttgtgcagcactgattgagaagatcagttggcagttagtgagtaccaagtaggcagtccagatcccaagtcctggggaagtctgtggttgggtggcagtgagaatcttaactgctaaacctagagcaagggttcacaagtatgggatgtggctcaagcaggctgaacgccaatgcaagggaagtcctgccagcaggatgcttcagtacctccctccttgcatgcaaggacccgatgattcactccacggggatttgtggagagcccacagtgaaccagaaaccaggctggagcccaaagtcttgtgtggataacagatattaaagaggcagtgataagtattctaggaagtaggtgagtctaggcttgtgtgttaggaagagatagtgccaaatagcccccagccatgcctgcaaagtggtgtgcaaggtggcatccaagggccataggaagcttttgaagagttttggtcaaggaagtagtggatttaggtttgtactttttaattttttttcgaagattttatttgagagagagagaccaagcacaaggaggggcagagggaaagggagaaccaaactccctgctgaatagggaactttgaggcagggcttgatctcaggaccctatgattctgacctaagcagaaggcagacaattaacctgctaagccactcaggcacccctgttctttttaaagtcattctgacacaatattacaaaatgactaggaaacaggcaagagtttatttgacatacattaggaggctcttcttacagtagtcaagatgtgacttgacaagatgatactcacctgaaataggtacatagactttttgtttgtttgaagattttgtttttttgacagagcacaagcaggggaagctgcaggaggagagggagaagcaggcttcctgcttccccactgagcagagagcccgatatggggcttgatcccaggaccctaggatcatgacctgagccaaaggcaggcacttaactgactgagccactcagatgcccccatttaagtttttattgtttttaattgaggtaaaattgacatacaacattatatttaaatttttttatttttattttttttaagattttatttatttattcatggggggcgggcagagacaaaggcagagggagaagcaggctccatgcagggagcctgacgtgggacttgaacccaggactccaggatcaggccctgggctgaaggcaggcgctaaaccgctgagccacccaggcgtccctatatttaaattttagatatatgacataatgacaatatctgtatgcattgcaaaacaatcaccacaattagtttaatactatcaccatacataattatagattttttcttatgttgagaacctttaagatttattctcttagcaactaccaaataatgtaattcgttattattaactttaatcaccatgctgcatattatatccccgtgacttattttataacagcaagtttgtaccttttgactcttgatccatcttgcctacccctaatctctacctctggcagccaccaatctgttctctgtatttgtgggcttgggtgttttttgttttttgtttttatattccattcatgagtaagatcatagggtatttgtcttcaacttatttcacttagcataataccgtctaggtccatccattttggcacagatggcaagatttccttctttatgcctaaataatatcttattatatatattatatattatatatatgcactacagtttctttattcattcatccatccatggacacttaagttgtttccatgtcttggctattgtaaataatgccgaatgcatgtatgcaagtatttttattttcttcggacaaatacccggaagtggaactgctggatcataagctagtcttatttttaacttttgaggaacctctatactgttttccaatttacaccaatttccattcccaccaacagtgcacaagggtccccttttctccacatcttcccaagcccttgttattttgcatctttttgaaatagccattctaacaggtgatacctcattgtggctttgatttgcatttctctggtgactagggatcctgagcatttttttgtgtacttgttggccatttggatgtcatcacggggagactgccaattcaaatcctctacctggttttttaattggattgtttggggttttttgctattaagttgtatgagttcttcatatcttttgcatattaactccttatcagatatatgatttgtagatattttctccctttctgtagctagcttgccttttcattttgttggtggtttcctttaccatgcaggaactctgtagtttgatgtagtcccacttgcttattttcacttttgtttccttggcttttggtgtcaaatccaaaagaagtataaccaagaccatgtcagggagcttaccacctatgttttcttctaggagttttaaggtttttggtcttacattcaagcctttaatccattttgagttaatttttgcctatggtgtcagatagtggtgttatctcgacttttgaaggaaaaggaggaatcaagggtgactccatcgattctgggtggctggagatgccagcccagagatgggggatactagaagaaaaacagttctggggagtacattgtgagttttttgggggactcgttctgtttgtgatacctgtggggtgttcactgatggtagtcaacaaggccagtggatgggtagatccaagcataggaaagctgtcagaatgtgcagagatgtgatatgtgcaccccagaactggcggcagtggggctggcagcctgcctcgaacagggcttcctcctaaagaaaatgagtttaaaaatggattttgatcaatgaatctaactttataaccagtttggctcgcatgattctgttgtacactcaacttgtagaattcttaaataggtatgttttgaccttcttcataaaagctaacatatttctatactttgaagaattcatctctttttcttctcagctggcctcattcactctttcctcatatgtccttgtagcaagaggaagctgtgcaactcataatgtgacactgtccattttctcagacttgtgacccagaaggaaatctctgacctcagctgtggctcttggtgctggccagaagccaacttcatgtctgagtgtatgggtagcggtttgccatggagagcttggggctgcaaacggtgaccctcagtgatgggacaacagcctacgtccagcaagctgtcaagggtaagtattcccaggcaccccagaatcccaccctgtgccccaacctctggagaggagtgtccccttctaagagtctcaccaccactatgccctcccacttgcataccacagcttgctctgcatgagaatttcttgagatcgttgacaaaccctttaagagaaaatgccattcaaggcaagcctgcctagaaaatcagactagccgagccataggaaccaagacctctgaaaggcagaattccttacatggggcaagtggttcataaatgtttctggaaatgaatgaacaccgtgctggctatatgacttcctgctctccagataactccctgtccagtttctttctttttttttttttaattttaatttttttttttttttttttttatgatagtcacacagagagagagagaggcagagacacagacagagggagaagcaggctccatgcactgggagcccgacgtgggattcgatcccgggtctccaggatcgcgccctgggccaaaggcaggcaccaaaccactgcgccacccagggatccccctgtccagtttctcagtgctttctagaaactctcaaacaggttaagccatatacagacaccccagcataggtctcatgccctaggccccactaagtttgccaggaataaacattgaattgccaacaaagagtgaataattttgtagtacaagtatgtcccaaatacaccctgggatagataatgtataaacatgggattaaatactaaaaatagtaaaataatacttcagtactaagtactgaaaaagaatttgctgttgatctgaaatttgaattcacctgatattcatttctcaagaaacttaaaaaaaaagagagaaaagaaacttaaaatcagggtgagcgtggagtgtcactaaaggggcagagccttcaggccagggacactcactgttgtgacagcctctttccttaccagcattctcaggagggccagatagcctgcctgccctccccgaacagcactgggcaaacatcaccacgttcctgctcttttatgttgccttttctagactctgtgagcaccaccatctgcgtgaatgcacggtcattgcaacattgctcgccttcatttcaacacactgtggaagtgtatttcagttcccaagtgtacagataaattgtttgttgattttattttaaattgtctgcttcctgatgacgacaaagaggccccttaatctcatcagtaagcttgttctgtatgacagtgttagggggtggttgccttctggagaggttttttgtcaagagctatctatgatatgtgggtctggttggctttgttttcttgagtgaggaacttctctgggatacttttgaagcctgaaaccctcagtttgcagacttcccgtcacagatcttgcccctcagcagaatgagacggaagaacttagggagtatggaaatgactgtgtctgctccacagacccagttacttcccatgcctcaggcttctgccatgaattagtggtcaagtgaatgaataaaaagcaaatggtgggatccctgggtggctcagtttagcacctgccttgggttcaggacgtgatcctagagttccagggtcgagtcccacatcaggctccctgcatggagcctgcttctccctctgcctatgtctctgcgtctctctctctctgtgtctctcatgaataaaataaaattaaattaaattaaaacaaaacaaaacaaaataaaataaaataaaatagcaaatggcctcacttggtggttgagaaagctactctttttttcttaggtctttcccttttatgtctgggtctttttgcctcccccacctccccgtttatatctttctctggtccctgttctctggctcctccacagcactgcagcgtgtgcttggatgtgtacgcgcacagactcacacacaacagatttcacactcctgaggggagagctggcctccgggaagcgggactacactgttctaaaaggcatctttctcactggtgagcgcctctgaagctcttgaccagggcactgtcattcttgtcagcaggaagctctttctgagtctagcttaggcagcaggaagccctaaaattttatgagatttgtctctaattagggtaagcataaaaacgtgttattcaaacccaacacttctggaagtggaagagtgtgctatgaataaaaatgcactgggactgttctgggcaaacaggaacatattggccacctccccatagtagaatatgagggcccggccgtcagttgtcctccaccgcctggccctcctcattgttgtctctggtgtaaggggtgattgtaggttgaaatcttttctcaaataactcttctctatcttttgtctcatcccttgaagcaatagccacagtgctgccagaagctctgctagcactcttagaaccccaagtgcagtgcccttgccatgacagataaagggttaaatgcagggaagcccatggcttgctgatgggagggtggtgaggggtccccctccctcatctaaatgcctctctcctacttcttacctttgtctctaccttacctgtcttcagctgagttgtagaactgtgggttactgacccaagaagactccatgtgaaagcgagtttgaggattcttctgagggggagatagcagggttaggccagaagcagctgcctggtctttttcctacatcataagaactcaaattcctaaatcctgaaacttgttttttttttttgttttttttttttttaatttttttttatttatttatgatagtcacacacagagagagagaggcagagacacaggcagagggagaagcaggctccatgcaccgggagcccgacgtgggattcgatccagggtctccaggatcgcgccctgggccaaaaaaaggcgccagcccgctgcgccgccccgggctccccacaaaagggaccttttggaaacaagtaagcaggggatccctgggtgggttcagcagttgggcgcctgccttggcccagggcatgatcctgaaatcccgggatccagtcccacgttgggctccctgcatggagcccgcttctccctctgcctgtgtctctgcctctgtgtgtgtgtgtgtctctcatgaataagtaaataaaatcttaaaaaaaaaaaaacgagtaagcaaaccacttgtcaagaacgcttctctctcccttcttacttttctctcttttcccctcatcccctgggaaactcactggatatgaaacgaggcctgtctaatcctaattctaaaccgaagagcccattgctgttagaagtgctcacagtaagcctctctccttgtgtcccgaaaccaacctccccacccccccaccatctctaaaaataaataaataaatgcaatctttaaaaaaagtactttccagtaaagatctgaggtaaaggaaggttaataatctcaggaacgctggactcttgttccgttttatactgcttgcttattgccttacgtgagtcattttttaattagaaaattgaaataatgggatccctgggtggcgcagcggtttggcgcctgcctttggcccagggcacgatcctgaagacccgggatcgaatcccacgtcgggctcccggtgcatggagcctgcttctccctctgcctgtgtctctgcctctctctctctgtgtgactatcataaataaataaaaatttaaaaaaaaaaaaaaaaaaaaaagaaaattgaaataaaaatgtcagagatgaatgaaggagatattccccatggtggcagtgaaacaagaactagaggacacccagtagccctgcagttgtgttcacatttgctccctgtagctttattttctgattattctaaaatgcagatcaggtttatgataataaaagctaaggcggggcagtccaggtggctcagcggtttagcgccaccttcagtccagggcctgatcctggagacccgggatcgagttccacgtccagctccctgcacggaacctgcttctccctctgcctgtctctctctctctctctctctctctctctctctctctatctccccccccccgtgtctctcatgaataaataaaatctaaataaataaataaataaataaataaaagctaaggcttgggacccctgggtggctcagtcggtgaagcagctcctgcctttggctcaggtcatgatcccagggtcctgggatggagccctccgtagggctccctgcttagtggggagcctgcttctccctctgcctgccactctccctacttgttctctctggcaaataaataaaatcttaaaaaaaacaaaaaaaaaaaaaaaactaaggcttggggtgtctgggtggcacagtcgtttgcacatctgactcttgatttcagatcaggtcgtgatctcaggaatgtgagatcaagccccactttgggctctgccctcagcatagaaggctgctaaagtttctctctctctctgttcttctctgctgctctcactctcaaattaaaaaaaaaaaaaagcagcagcagctaaggcttattgaaggctgaccatcaacactcctggctttgtcttatattcattaattcatttaaccctcacagcaacccagtagaagacacagtttttaatcttctttttaaaaggaggaaactgaagtacagggaggttaaataaactgtctgaggacacacaactcgtaagaggtagagcagaaattcaaacccaggatgcctggacagctccagagccacttgcttttaaccattaagctatagtactttattagaaagtctcgttctgggcatactgccacagtgggagacaaggaatgtattttgatttgttagtgtgagtgctgaattttgagccaccgaggtctttccaggtttcagggcgttctttgttctctgtttagatcagtcttggcagcctgctattaagctggaagtcctcacttcatggggcatggacagaataataaatgaagtttctacttcttgagtagaggaagggaatctggtaggagctgtagggctcctcctggtgggatgtctttctacccaccagtacctctgtggcccagacccagggaggcaaggagcaggaggcatagggcatgtcacctgtgcttagacatgcaaactatgcctcaaacaggcctctttgggaagtaggcaggtgttcctcagccatcttcagggcctgacctacttgtctccatttctacctttacaggagagaagttgcttgaagggcaagtgatccagcttgaggatgggaccactgcatacattcaccaagtgatggtgcagaaaggtgagagcaccccaagacaccccaacctcatggagagaggccaggcagcccccactgagggaggtgtgggatggcatcgagctccagaggaagacaagtattgctctcctttcagaacctctctcctttgaggatggacagcctgtacagctggaagatggcagcatggcctacatacaccgaacacccaaaggtggggtcatagtcatcacaactggtgggacagaagggaggctgaatgggcagaggttggggcatagctttgggagctgtagtgcccaagttcagctggattagcagtctcacctcctttccctggtgccgaacacaggagtggcaatttctgcctctgggaaaccgagctgtgggagtcagtagcatgggcctcaatggtggctttctctctaacatagctgcaaaatcttagggctttaaataggacctgaggacatcatccaagaccaggagtaaaaacttattaacatttaagactgaagtctctaagtagtgaggaataacgatttattccttttacaaggagtttcttgagcaactattgtatgccaggcattgtgctagatgtggagtgtgcaagagatgacaaaggcagacacagtccctgcccttctagagaccagtggggaaaacagaagtgagaagaactataaccaatgaactgatcatcacaagccctccagctcagggagggcttccctgataaagtgacgcttgggctgagagcgaaagtgtagacttcactagaggaagaggtacaacaggagggaatgacatgggaggctcagagatggtagaaggaactaccaggagccagaaggagtggggcaggataggtaagatgagagaggcaaggccagagcactgaggcttgagagttaagagaaaggttttattggtggtctttatcctgagactagtgggaagtagttgaaccatcaggtaacatgatctcctatgtgtcctgcaaagatccctctggatgctgcgctgcctggtaggaattagagggccagttaagaggttcttgtatgatcatctaggccatgatcatgatgggtcccctcagttcctcatggaccttgtgacttcccagtcagtgcttcataggaggccttgtcctcaggagaggtggccccagaagaaggaccagccagagtgaatcaccaaggcgagggaccaggagaccttaaaaccttccttggtatatgtacctcttcttaccttaaagcagggtaggaaggtataagataccttatatctcttgcccttgtgtggcatctgggctaacatgtgttccctgcagagggttatgaccccagtgccctggaagctgtccagctggaagatggctccactgcctacattcaccaccccgtggctgtgccgtcagacagcgccatcctggctgtgcagacagaggtgggcttggaggacctggctgcagaggatgatgagggcttcactgcagacacggtagtggctctggagcagtatgccagcaaggtgagctcacagagcttgacactgcccattagctcccttggcccaaactgccacactaggggacaagggcagttccatgcttgggcatggcctgagctactcccctcgccgctctgccctggctccctcaactcatttctcgtgtcactgtccagggcatacatggcagcgtggctggggccactgacagttattgacactctccctagtttaggccgtctctgcagaggaaaggcggctgcaagaaatggtgacatctgtaccatggctattgagacgcagcttcacttttgctgttgtaataatcctctgtgctatctgagaaagcccttgccagtgacttttattttcacaggccagaggtcagatggtctcatctttatttcttctctgcaactcatttagtcatttaggaaaataacctcagtaagcaatgaccagggcagatgcagcagagcagctgagattcttggaacacagggccttcacagtagctcagctgcaagggagaaggatcttggctctcctagcatcggtcactctggcaaagctgcggtcccacccacagggaagtgggcactaatctgtgagggtgccagaccagggtgcacccccctcgggtgaactgcagaccttcagggtggacatggcaaggctcccgagggcactaatgttacccaaagatagggggctgggaaagtttttttaataataagactatgtgggggcagccccggtggcacagcggtttagcaccacctgaagcccggggtgtgatcctggagatccgggatcgagtcccacgttgggctttctgcatggagcctgcttctccctctgcctgtgtctctgcctctctctcgctctctctgaataaataaataaataaataaataaataaatcttaaaaaaaaaaaaaaaaccaattagactatgtggcagtatcagagaagaggaaattctcatgtctttccaaaatgaagcccaaaacttgctaccagaccacttggggctatgcccactcccactgccatttcctgcggtttattgtagaagccagatttgagatttgctgctgttaggatgacaactgggctctgaatcatgatccctgagacccgtgctggctctgcctctacctagtctgacgagtgagtcattctgctcacagacttagctcactcctctgaaaggatgagaacgggactagatgaccttagaggccactttcaactgtgaagttccttgattccctcaagagccagtgaggcaggggaataaaatgtgaacacctgggtaggttagcccaccaagcaggcctggccacctgtgacagtccccctgccattcaccagcggtttaagtgtctgtgaaattttgtcagctgcttgaccccctgacctggagctgacaagacagaccttgctgtgaatttggcctcaccggttcgtcttctactccccaggactcccagagttctatttcaggagctcatgagaaggccaaagtgtcccagaaacaaagactaagggcagtcccaacagatccctgctcaggaaagcagaagagcagcagggctccctgaagcccgcagcaggtgtgaagcgggtggctccagcagtgtccccaagagaaatgatgggggggcctgtcaatcagctgggtgctgtggttagagctgaaacttctgatgcagacctgtaggcccctgccctgggtgcttctgcagttcgttgcttgtggccacctcatccggtgaacccaggtgagcttctccccatggcatgtccgttgttagtggcccttctgagcacaggtttcctaaagggagggaggggtctcctaccatcagaagatacgtgtccagagctgtggccttctaggtacatatggtcaaaagtgggggttgctggggcacctggctggctcagtggagcatatgatgatcttgggggttgtgggtttgagccccacattgggtgtagagattacttaaaaataaaatcttaaggggctcctggatggcacggttgattgagtgttcgactctcagctcaggtttcagctcaggtcatgatctcagcatcctgggatcaagccccacgttaggctctacgctcagcacagaatctgcttgagattgtttctccctctgctcccctcccccatactcactggctcatacacacatatgtactctgtctctctcataaataaataaatcttttttttaaaaaggaaaaagccatggttgggcggctgccttcgactcaggtcataatcctggaatccgggattgagacccgcattgggctccctgcaaggagcctgcttctccctctgcctctgtctctacctctctctatctgtgtctctcatgaataagtaaataaatcttttaaaaaatgttttagggacgcctgggtggctcagcggttgagtgtctatctttggcccagggcatgaccctgaagtcccaggatccctgcatgaagcctgcttctctctctgcctgtatctctgcctctctctgtgtgtctctcatgaataaataaataaaacctaaaaagagaaaaaaaagtttaaaaattttttaaataaattaattaattaattaaaaagtctttaaaaaagtggatgttgctagctgtcaacctagctcaggggtggcctgaatggctacctttcctagatgtctgggagatgccatttcttccatcactgtcacaggctctgtgacatcgagtcctgcctctatccatgagagacaggtggagacaccacaagtcacccccgtttcttctgtagagtgtttcagtgcctgtttcctgtgtgtatgggtctgtcactcctagttgcccttcccccgccctcccagcaggtttagccctgtgtgttgggtcctaagctgccagcaaggccctatatcccacctcatcccgctcatcattgaagaggatataaataggaacctcaagatttttttccctcaggtcctgcatgacagccaggctccccataacggcaaaggacagcaagttggggacagagcattccgctgtggctacaaagggtgtgggcgtctctacacgactgctcatcacttaaaggtaaggtcatcacgcacacctctcagatgtcttccctaccagggggaaacttcctgctttgaccagaaccagtccctgccctcaagtttgaactcattgcctactgaaaggaagagatgagtgtacagaaatggcagcccagggtcctgtaacacacatgaagagtacaggaaggaagagaataatcagggagggcactctggacgaagtggcagaagaggaagaataaaggaggtggccagtactgatactttgagccctcaagagaaccaaagagccccttcataccctggttcctgagtcccctggttgcttgtcctcacaggtgcatgaaagagctcatacaggtgaccgtccatacaggtgtgatttccccagctgcggaaaggcctttgccacaggtaatctacctggaagaagactaaaggtggactgcttccagttgagggcagaaagttctaggttcacttgggaatttcctgccttcccagagaaactgctgccccagcactctgactcgcagggctctgtctctgggaggaaaccatgttacagaagtgagggggagcatcatccaggccagcgaaaggagccgggggcttggtagagagggttcctgcatcggctgtggggtatctaggccattgcatctctctgagcttccttacccctctgaaacatttagccccagcccaggcttatgctctggaaggacaccggctgcccctggagggggaatgggagcagcgtgggcttttctacccctcttatctgcccaggctggggaggggtagaagcagacacaggcttcttgtgcctgaggaggtgtggagtctcacagagcacacctgaacatggcgagcctctgaattaggatgatgaagcagtggtggtgaggccctccagagtgcccttctcagccctccctcccacacactgataggatatgggctgaagagccatgtgcgcacccacactggtgaaaagccatataagtgcccagaggaactgtgcagcaaggccttcaagacctcaggagacctacagaagcacgtacggacccacaccggtaggttgggccctgccctgttcacgcttggacctggagtcctaaccctggcatgacccctgcttcctgagccagcccaccccacacaccccatctccacaggtgaacgcccattccggtgccccttcgagggctgtggccgctccttcaccacctctaacatccgcaaggtacatgtgcgcacccacacaggcgagcggccctacacctgccctgagccccactgcggccgcggcttcaccagtgccaccaactacaagaatcacgtgcgcatccacacaggtgggccagctggcatgcaagaagcaccctttctgaggccccactcctctcgactgtaatcctctgacctgagacgcattcttgactctgagccccaagcccttcttccagccagtccaggctggcctgtgggcgggaagaggaggctttgtacttttctggccagatctccagaaccatctcacttgcagtgagcgattccttccctcccagttaggtcccgtctgacaggtcctgctgtccctctcaagctccctgccaccttcctacagccaccctggatactccccttctagctgagctccccggaaaaggccagggtcagggctgatgggggaaaaagagtgaaatgtcgcccttagctcctcgcctcctccactgcccatatgactcctgtgtgtcctccctccccggtgtctgtccctcgtccagccttctgtgtcctctctcagccgtatgtgtcccctcactcccccgtcacccctgcgacatcagtcatccctctctgtctcctgcctcttctgtttacgaccttcaactttacaagcccctacccccgcaccccctctccctccacctgtcccttcactagccccagcattacttctgggctcagtggtcccacacgcctgtcccctctgtgttctgctggacatcgcccccagctgtgtctattcagagtcccagtctctctccgtccccaccaactaaccccgtctcccacacccacacccccaccccctagttttccccttgccagccccagttcccacccccctcacagcccagtgtccccaggggagaagccatacgtttgcacggtcccaggctgcgggaagcgcttcaccgagtactcaagcctatacaagcaccatgtggtacacacgcactgcaagccttacacctgcagtacgtgcggcaagacctaccggcagacttccaccctggccatgcacaagcgcagtgcccacggcgagctggaggccacggaggagagtgagcaggccctgtacgagcaacaacagctagacggtgagggctacgggcaggaggcgagagcgggggcaggcctggcctccccatggcctggcaggtggcgggtgtcagcttgggctctcctccctcagctgcctgcgccacagaggagagcccgccacccaaacgcccccgcattacctacctctcagaggtgaaagaggagggctgtgacgtcccagcccaagtggccatggtgacagaagaggatggggccccccaggtggctctgatcactcaggacggtgcccagcaggtacgggccctggggaaggggtgggggctactccagctgggaccttctcgctctcaccaggtatgggccctgggagaggggtgggagggcctctctggctgagaccttctctcactctctggggagcccagaagatctgatggccccacctctacccgagttctctttttagcctctactcaagttctctttttagcctttttagtggacctcagtggaggctgagggtaccgagtcttgtaagccagcccctcctcctcatgcttccacctcagcctctggaacttctagagcacagttaacagcttccctttttacgtggaggctgacaggtcctggttatgtgagtgagacacacttcggtgtccttctcaagaaaggcatgttgctgtggggcccagagcattttgtgggttctggaggcctgggctttctagtcagcagtatagtaggacctttgtcagcaccctcactgtcaagtgcacctctgtctcatggagttgacatgaggaagaaattgtcttgaaaccctgaactgcgtggaacagagccccgatgcaaagtggtgctaaagagaagcggtcaacagaattcttctagtgtctccttttggcaatttaggacttgttttactagcttgtccctgtccccctctacctctgtgatatgaagctaatcttctagattatcaagaagctaacgttgtctggaagaccagatacatccacccaggggctttcagacaaccatccaaccatactccctgctcatcttcctttctatttgcaggtcagtctgtccccggaagacctgcaggccctggggagtgctatcaccatggtgacccagcacagcagcaccaccctcaccatacccagtgaggacgatgaccttgccacatctggcacacatacagtcaccatggtcagcgctgatggcacccagacgcagcccgtatgaccaggcggtttgcttggggtttcttgttctctcatccttcctttttgtggggtgggcattaaagcagactgacctcatcaggccaccttacgaggaccaagattccccccacaaaaaaagggtctttcttccccatggctcctctgggccatcagcaattctcgtcttgaaaagtatttcactggggaggtcaagaggcagtttctaaaatcttgatctacctctaatttactttgcttccataggcaagtcatttttccacggacttcagtccattttcaaaggaggttatctttgggcctttgacagctttgacctcctatgaatcaaaatccctaaattaagttggctctcagagaaaaataccacctcacaaagctctgagccccatgctaattaatctgacctataatggttttattcatcccagccaccttgctttgaagggattttttttttttaagattttattcatttattcatgagagacacagagaagcaggctccatgcagggaccccgatgtgggactggatgccagatcctgggatcatgccctgagccaaaggcaggcgctcaaccgctgagccacccaggcggcctgctttgaagggatttttatgtggattgagggcagggagggtaacataggtgggtcggaaaatctcattttcttctatatttcaggttacaatcattacctctggggctgtggtggccgacgactcaagtgtagcatctcttcatcaccaacaagtggcactgttggccacagccaatggaacgcacattgcggtgcaggtgggtagaggtcccagagcctgaaaaaggaaggaataagcagaggagaggaatgagacagagatcttgaagagaagggcatttggcttggaaaagctcatttcagaagacaaatccctttctgcctacatccacacagctgtctcaggctttttcttgactgaagcagagcactgaagccccttccggccttcagactaatttcgatggcagcatacctggtggtctaaaccctttgtctctttgtgtctccatttcttcattagaaaaataagtgggcccctcctctagccagtcatccctttctgtgaacaagcccctctcactgatcctggcccattctttggctccctgagcacaccttgcctaccaggactctatcgccaagcttgctgttaacttggggaggggggcacactaagtgctcagtatgtggcactgggccaatggaaggattcagaaaagtaggctacttacttactagcactgaaatctggtggggagtgtctcactctccttccttctcaccctcttctctgcagctggaggagcagcagaccttagaggaggccatcagcgtggccactgctgccatgcagcaaggggctgtgaccctggaggctacagagtcagggaatggctgctgagtttcagggggctgagtccacaccgtttcagacgagatgccgtgccacaaaggcatccctgcctccaggggcccggactgtggctgacacttggaaggtggccatagaggtctccaggcaagacggcagcaggaaaacagtctaactggaacggacaggggccctgctcaagaggagggctgcacggctggagtcaggggagtgtgtcatcctcaggaacaaaagaggacaagctgatcaccaggctgcactggagtgtcctcagagtcagcggggtacccactcttctccctccagagaacacccttctctcaatccactccctttctcaggtggcgatggagattgctctggggacttgtcctgtgttctaatggtccctgcccaccaggggaaggggcccaccgctcttcagcccagtaggagccaagcaggcccagccctgctcctcccagcaataaccacctccctggaagcctgccaagatacctgaccacttggcaacagagcttcctgccaccgtagtcagaatcactcaggggcctgtggctggagaaaaggtgcccagccccacccacccccagctgccccctatcctctctgtggcagagaggcagggaatggccttgtacatactggggattgggtttaatttgttgttgtttttttaattccattttgataatttttttttcctgctctggttggtggtggcaaatgggtgaatgagtatttaataaaagttccaagtttccacctgggtccctccctcctttcttctttgggccctgatgccaagatggtcaaatcaggctcttagccctgtctgtatccctgacacaactcctctgagtctcagtgccagactgatggaactagcctaccagggacacggagggaagaagcccaggtataagaaaagccctgagtagcagccagtggcttcctgcccacacctgagcaggtggactccagggtggccagacgggaccagtgtgaccactgctgtcaggctctgcttggatctcaggcatcaggatggttggactggaggaattctgtttttttcccaccttactggtgtgatatagagcccttccatgcccagccacacggtcacctactccaagtgggcaaagccccatggtggagtggaggtaggtgcctttgccaaggttagcaagggtctctgattgattctgctgctccgagaccgaagtcccagctctggggatgcccacctaggtgtctgggaccatgctgtggaatcccaaagccacgatgggaccgtagtggaaagtgtgtgggaggaccagcccagccctggtgggaagggagggacacgggaagggacctgaagggaagaactctgggtttacctctgacatgggagcactgcaggggttggaggggcctcttttcctctcttcacagtgatggatgtatcctagtcccttcctgccacctggaaatggagcttcccccagcccaggtaccctttcctgagatgcctagcaagcttccatttacttgggccagcagctctttggaagcagaggggggccggagcatgcccccaggggaaggagtgtctcaggtacctaagcttcatccctgcccactgttccgggctggagtgatctcagtggcaatggagctacagaaaaggaagccctgacatggagggccctgagtgccaagcctcctgctgtcagtggccctggaactaggccccaccacaaggttctcacatacacacacacacacacacacacacacacacacacacacacccatgcttcagaaacaggctctaatcttcagggccagtgaccccagagtgggcagcactgtgagctgagccctttcagagccaaagcccagaggatagggaggcaaccaagcacgtgccaagtccgcctgacctggagagctgccctggcccaggtcctctgccaactttgtgtcattgcctttgttttcttccacttgggaggagccccaccaccacagtgatgttagatggccctaaaagaaatgctttgtccggtgcctgcgctgcttcacatccatccccagacctcacagctgtgagaggtgggtatttttcctgctttaccatgagggcactgcttaaggaggttagcaactcacccaagttcaaaaggcagggtgggcttgcttccctgcccctcttctccagcaagctgcttctgggaatccaggaagcccccagaaaattctggggctgaggaggcttctaaaagcctcacactgaacagaaccagggccctggctctccagggtttggttcccaggtcccatacagagagaggggccacccacgagcactgcaagagcaggagcaacaggccggttcctggcagctgggaagcacgcgcaagcaggcaggtggagctcttgctccgcgccatggcccctctgcggtctctgcagccgtttgcatttcctgaaaccggatctcggtgtcagagccgcccccgggccgggcgggtacctcagccatggccctgcgcaaggagctcctgaagtccatctggtacgcgttcactgccctggatgtggagaagagcggcaaggtctccaagtcccagctcaaggtgaggggtccccggagcccaggagaggccggcacacatgcccctcaagcccctgccgcccaggagccaggcaacaacgctgtgctgatggcactcagccatcccaaggcccaggcctggggacgggagatgggaccgggtggtcgggacagtgcagcctgctggatgctgctgcccatgttctgggaccccagggaggcatgtgcggagcctttgcccagagacctgccccccaactccctggagggtggaggcggcattattcggttttgaaggccaacaggccaggctacatcctctactgggtgtgatgagcacacttctccgcagagtgaggcttgggcacgcaccctactccttcctgctgcttcctcctggctttgaagagagacagttagttcttgtcagtcactgcctccccgagctgagagaggcttcaagagcctctccgagttccagaccaggctgactgggtcacctttggcagaaatcagctactccgaaccccatctcccagatgcagccatgctgggaaggggcaatggagagaccctgttctgctgctactcagctcacccttccctcctctcccacactaggttgggaaactgttgttccctttggccgtgggacctcaggtgggaaggaggtaggatccgagcccaggaagagccccatcagtgatcgccctgaagtttagtactaggtcctagacaattcctgggagaccagcacagcaagtttctctccttccttcctccatccctggctcttggaaccagggaacactgggggacaggagcagggtaagcctcagcaatctgcgacctgccttaggggatcattcattcagttcacgtgtttactgagtggctctgtgcctggtgcgaagctaagccctagatttctggtgtctccactggacacccccaaaggacgagtgcagcctccaggaaacctccatttttaatgaccgaggtaggaggtgcctgcaaacgtgggagagatgaatgaggcaggagagatgttatgccccacccccactccaacccctactttgctgaacttggacagagtaagcttgaatatcccaaactggccctatcccataatctgttccataaccaggcttatgagcatccaaacaaaaattattcttgactctcccaggaaagacagtccactcctacctttgatcatcggggaggattccttaacattctacttaaatccttttattgtagatcatgtcatctagtgggggcttcaggatagaacagcagatcatccaaaatccagccctgcagaaacccgtgccctaccatgggaaggcccatgtcatacaagagaaggctagggaaggtgattcttccctaagaccatactgggggatactggaataggaggaagtagtgatagtgttgggggcagggatgccggaaaggcaaaggagcaatagagaagtggtcagaagtcagaggaagaagtagatgagagagataccagcaggggccaaccccacccctgcaaaggcttgggggaaaagggggaagaccttgaccttggggttagtctgtcttcactaacactgtccctggccttaggtccttgactgggaccaggcaggagacctgtaccagtccagcgagctatgtctgtctgtgacagtcaccacttccctgatgtgttggtagaaaggctgccactggctgtggtgggcaaagccatgatgaagaaggaggaaggagggaggaggaaggacagtgaggtctctgagaagtggcccaaggagtcaggattgttttctctggaaaagagaagtcttgagggagagagcagatggcttttcctctattgaatttttgtagaaagtacaatggcctttgtcccggtgagttgagaaaagtacaattagaccaataggaatggcacttctgcccaggatggatttagattgagcacaaaattccccaggtgttgaggactctgagttttcccaggatccccagaacccccttctctaaagaactttgggagtgagtagcagttccaccagaaggctgcaaggaggtgagccttaggaatgatgggtctcttaatggccacgtccatttccctagaggagaagccttggttctaggcctagtgggggggattagctgagaattggggtgaggggtctgggattggggatgtggatggagtagtatgtctctggctcaggaggctcttaggagacaggaggcctgccccttccccttgactggcaggagctggggtgggcaggagggcaaactggcaccctccctcctgggctttttcaggtcttctagactcctgagcttcaggctttacctgtggaggggaataacaagcttccctttggtgaagggaaagttaagagcaactccagtccaggaatctgcaggctgggatcttcagctttgttctgacccctacctgctgctggtctcaggctaggatggcagggagtggcaggctgatttagtgatgtgcagagtacttgactcagagccacataggcctgctcctcagctggatgagcttgggcatgtggccttgcgactctgaacttgcggtttcttgtctgtaaagacagggggttgaactggggatcaccaggctatccagcttggctaccaaaaaaaaaattttactgaagtacatctagcagatgaaactgacccttgatacagcctcccctttccctttcctgagcctgtcttttctttagtgctcaccctcaaccccttctagccctttcttgctgtcaacaggcacacagagctcatccagaaatccccaccttctaaaactcccagtgctcctccctggtgatagtagttatgctttagtacctgctggttgagaaaaatacattcagggatccctgggtggcgcagcggtttggcgcctgcctttggcccagggtgtgatcctggagacccgggatcgaatcccacatcaggctcccgttgcatggagcctgcttctccctctgcctgtgtctctgcctctctctctctctgtgagactatcataaataaataaataaaaataaataaagaaagaaagaaaaatacattcagtaactcttacaaggatctgtatatatttttttaagattgtatttatttatctgacagagagagcacaagcaggaggatctacagagggagaggaagaaccaggctccccactgagcagggagcccgatgcagggatgtggggctcagtcccaggaccttgaaatcatggcccaagccaaaagcagaagcttaccagactgagccttccaggtgccctggatctgtttattttaaaagaatcacctggcacctagatatattaaaacaaaaacaaaaaccaaaaaaaaaactatatgccatctaaaaaagagattattcattttctctgcagccattacttggtgctgttgatggattcccaaatcccttgtatttatccagtgatggctagaaaccacaggaccatgggtactggcccccatgaccacacttgagtttttagggaactcacaagcccctagaggagaaccacttccccacatgccttcagaggacatagtgcataaatgaagcctctcaaaggtcaatggctgccacctcagaggtcaggggctgcttggttgggcggtgagactatgagagtcctctctgagggagcgcgaatggcggcttgtgaaagctgcagacacctggatcccacccctggaaactctgagtcagtgagacagggcgggcctctgctcacttcagtttcaccagctccccaggtgattctgaggctcagccagagctaacatgacagagagatcaagagtagggctttagaggcagacttccagcaagacacttcacctctctgcaccttgatttcctcatctgtcaaaggaggattatgagagtccctgcctctgggtctgaggattgatagaaatcagcctgtgagctcctgcgcactctggtctccacccctgccatttcctttccagcctgaccctccttaggtcacaccctctccccacctctagccccaacccgcacccaggcacaggaagcctggcagtctgaggtctgctaagctctctggggagaggccctgagccccgagcatctggagccttcagttccttcttgtcctgacacctgacggctcacagggattggagcctctgtcctgggcccctcagattccaccagccaaaggtacaagtgaggacagcaggtcttagaggacagtgcagatggaggaaccgaggcaaggaacagctcaaatgacaatgcagctgcgtagtccgttctattcccggggtggcagggattttgtatgtcatctcttcgaaccctgtttttagagctatgaaaactgaggcccagtgaggttcatttgctcagagagattcagtccacctctgtctggcttttgtatttctcctacttcttcccgcaaagcgtttaggttcattcaacagatatttattgcgcgtctgttaggtgccagacctggtgatacagcagtgaatacagtagttaataaaatggacaaagatcaccaccccccttgtggtgctgacattctagtcagagaatacagatgaaaaacaaaataagtaaaaatgtatcatgtaatggaagatgattcatgacatagaagtaaataaagcagaaatagggatagagagttgtgggggggtattgagggaatggggttatagatttaaatagaatggtccagagaagccctccttgagaaggtgacatctaaataaagagtagaaggagaagagggtatgtgccatgcctagacctgggagaagaatgttctaggataaaggaatagcaagtgcaaaggccctgaggcaagtatgtgcctggcctgtctgaagaatgtcaagagggccagagtagccgcagagaagtgagccagagggatgaacccagagaaggtgcagcaggttgggtcctatggagcccaaggcctctctagggggacttgcgattttactcagagaacgatgggaaaccactggagcatttaagttagacttgaggagtcagtcaaaaacattgaacgtgtgcaggacatcgtactgagtctggaatcaggcctgagcttagagtccttgctcaaagaatgtagaacacccagaaatgctcacacaaaaagggaagagcaaaagaatgctattatagagcaacttaataacagagtacataaataacagtggttaatggcactctgctttttatctctatagttttaaatttttgtcataaaaacaatatatgctcctagttaagaaaaaaacagtgtagaagaatataattttaaggaagatgaaatttattctataagtaaaacatgttactggttaaaaaattcaaagacaaatgtaatactaaagatgatgaaagttcctcccctccctggggaaggatggtggagtgatagctattaacagtttgctgagtcttctagatttttcctatgtacaaataaacttactaggttgaaccatgtgaaattgctgacattgtattgtttcagccctattaaaacagctattaaaatttgccatggttcaacctaatctttgcacacatttattttacaaacatttcattctatagcttgcttttttcaccagccggtataggatgcatatctttccatgtctgttcataaaaacataataataaaaatagcacacagcttttattaaacaatgaactatgtaccaggtgctatgctaagctctttattcaaaaaaaaaaaccctttggagtagacctcctttttttttttaatttttatttatttatgatagtcacagagagagagagagagaggcagagacacaggcagagggagaagcaggctccatgcaccgggagcctgatgtgggattcgatcctgggtctccaggatcgcgccctgggccaaaggcaggcgccaaaccgctgcgccacccagggatccctggagtagaccttcttatcattctcacagaggagaccaaggtcttagagaagttaaatcacttgcctgtaagcacaccagtggcagatgtaaaatctttcctaccaacacgtaggtccatgacacggtgtacctgtcccctattgaaggatacccaagctatccctgttcctcatattgtaaagaatgcttcagtgaacattctcgtacatgttgctctgttcccttgagcatctaaaggttagatgatcagtgcgtgcctggtgcagttggttgggcgaccaactcttggtttggctcaggtcatgatctctgggttggaagatcaagccctcctggggcagcagggagttcatttcccttctccctctccttctgcccctcccccagctcatacacacacacacacacacacacactctctctctctctctctctctctctctgaagtaaatgaataaatctttaaaaaataaataaaaacaatcaaaatgctgggatcctgcccaattttaagtttgatacattcttgccctccagaaagattaccaattcacacctcaacagtagggcatttgtgtcctcacttcacaacctcttcaatacctggtgttatcagtcttgtgatctatgtcaattcgttcagtaaaaaattgcactttctgtacaggaagggatctaacatttgctccatacagatccaactggctctcttcacatgtcctctcactccatcttcacagcctctccatgggacaggtgaaggtgttcaactcccttctaatagcttagctgttccagttttagggctgccaagcgagcaccagcttagcaattccaggggaagagtatacctctttccactagaggaagcaaaaatcgtagggctgattctcattggtccaagattgatcatatgcccttccttgagccaatcatcaatcaccatgactctgatgtgcccacccctgcaggcaggtgggctagggttgcaaatagtcgataccacagatattgagaataagggagaggtgcttctcaaaggaaaagcaaggctccattaccaaatatgggtggagacaacagagttcctcaggaagaaacttaagatgtactctagaacaggagaagcaaaaccaaacatgcatgggagatgaagagcatgggaaagagggtggtgggtgtgtgggtcagggatggctgcctggagaggaatgagggaaaagagaagcaccctcttgctaggccttccaacttcccactttgcccagtcaagcctgaggcccgggagaatactggaggaagtctcaatcctttggtccacctcatctcacaagagaataaagaagtgaagacttggtgcacgcgccacctctgggatgtggccagctcctgcatcaggaactgattctaagcataactactggtggtggaagcagcattcatcgactgcctttcatgtgcagaagaggatgtagggggtgtgggacatagagatgaacagagacgttgtctccagagttcacaatctacctggacttggggtcagcactgtaatagtgaggtcaccttcagagccaggcacacccggttccaacctcagctcagctatttactctttaacttccccaagcctcagcatcttcatctgaaaaacagggataatgtgtgtgcgtatcacagttggagaggaggttagacatggggtatagaacctcatacggtggctgccacatagtaggtgtgcaataatgactattttaccatttttccaaaatttatttttatttttattttttagatagagtgtatgagcaggagggtgggggacagaggaggaaggagagaaccctaagcagactgcccactcactgcagaacccgatgaaggacctgagccaaaatcaagaggtggccatccaaccgattgagccactcagctgtattttcatccttcactctgttttaagtgctacggcagaattaaccccaaggcaatttgattttttttcctgattttgttcaaatttcaacccctttgttcttatgtcgtgggtttgatagccaactcaggtttcccctccgcaccatcacggccaccaccccttctaggtcttttcctccatgtgtcacagaccatttttcatgacccttctttgagctgtctccagctttccatctctgaagggcagtgactagaactgcacttgccttttctagagcagatacacctgagcgctttccttggagctggcacactgcagcctaaacactgaggctttgatggaaatgataagaaacttggctgccgcagggtgacagccacctccctgttgtcagcccaacgtcctaggaagcacctgggctttggaatctgtgggactggatttaaatcccagactcctgctcaccttggatccttgggcaagttactgaatgtcctgagcctcagtgtccttgtctgcagaaagaggacatccctacctaatacagtggctcagaatatggctgcttgggtttgaatcctagctttcttacctcacctgtaaaatggggatactaacaattgttccgggggttaggtgaactatttgtaacgtgcttggctccgtgcttggtgcatagtaagggagtacattttaggttattcggttttttattgaggtataatcgtcatataacgttatattagtttcaggtgtacaacataatgatgcaatatttgtatatattgggaaatgatcatcacaatgtctacttaacatccatcaccatgcacagttacaaagcttctttcttgtgatgagaatttttaagatctgctcttagcaactttcagctttgccagacagtattattaactatagtctccatttggacttgacatcctcatgacttactttatcactggaagttgtaccttttgacctccttcacctattccactgtccccgctattccctgcccctggcaaacgccagtctgttttctgtatctatgagcttggggggaggggaggttaacttgttttttagattccacacataaatatgtgagatcatattgtatatatattttttctgatttacttcattttgcctaatgccctcaaggtccacccatgttgtcgcaaatacaagatttccttcttttttttttttttggttgagtcatattcccttgtatataattgcataagtttgggttatgatagaggtgagcattgtgtgccaaggctttagccaggataggattggggctgagccaagtggtggcagtggtcctctggcccagtttgggctggggcacaggaaggcaaagtgccactctgtctcaggtgctgtcccacaacctgtacacggtcctgcacattccacacgaccctgtggccctggaggagcacttccgagatgacgacgatggccccgtgtccagccagggatacatgccctacctcaacaaatacatcctggacaaggtggggcctggcaggagggggcacctctccccactccccagtacattgccagcccaactcctcccacctataaccccccccttctgtccccaccttccatcccctccctcccacttccatccttcagattccagcctcttgccccgccttgcccctcttcgctcccccttccactccccccacccccccannnnnnnnnnnnnnnnnntaaaaaaagttttgcaatacaaaataaattattccgaataaaattatctccccacatcaaatatctcctacctccacccttccacctcattcctgccaggctcacctcccatctccagctgggacctttacatagggctcccagcttcccctggtgctatgtccgtgctcctcccagctgtccactctcttctcagcctcttccatgtcatccatcccccattgggctcccgatctttctcccctgggctgagggaccagtttctgtattggtaggggtcttgagtgggtatggtggtgggggggtggttggaatcatctagttatctgataagcagctcagggtttcctcaagttagaacaggtggggtgcagggaaataggtgaccccaagaaagcagcaagagcctagtttggtggcagagcagggatgggtggccgttttggctgacttgcaggcctggtggcaggtggaggaaggggccttcgttaaggagcactttgatgagctgtgttggaccctgacggccaagaagaactaccgggtggacagcaatgggaacagcatgctctccaatgaggatgccttccgcctctggtgcctcttcaacttcctgtctgaggacaagtaccctctgatcatggttcctgacgaggtgagggtgatggcagcactggggacagaatcactggggccaggcttcagctaaactgtgaaggaggccaaatcacccgtgtacctttcccacatcccctttcttcttggtctccccatgccggtgcctctctgcacccagctgcctccagatgccaagaattgcccatgtcagagtcactgtgtaccaaggaccaaaactgtgtttccttcaggcctctgttagccctcaaaagacgaaaatgacctcagagttttatttacagaggtagaaatgcctgataccttactgggcatttacaaatgaaaacatttaagattgaatggcaggattttaggcattgtggcaatctgagaaggttactatatgaggagaagggagacttgcctgggatgtctggcccattactccagggggcaaccaaatctggccctggttctagattttccttcccctctcttcccatccctctcctctccccaagggcaggggagacccagctccaggctccagagagggcatcctgagtgtggaagcctggaattggtgcctctacctcctcaactcatgggtgaagaagccagggcaggtgcccccactccataccacttctctcagccttctcctgaccttttagcccttttggtggctgtgcagatgccagggtgaatctaggtcttagggtacggaggggacggcttgtctgtgttataagaagtcctggtatatctaagtgcactcagatttgtctccttctgtttctgggaagggagagggaaatacctaatccctgaaatggtacacgccaccccactcccagctgagacccgttaaccttcagaatgaaagtcctaaagagagtttcccaagaagctgctgcggcaggaaagggacatgtgtccatctacacaggcacctggctaggcacccttgtcagacccctgcttgtcagggtaaggggggccctcagaggccagaaggcggcttgctgctgtgatcagcatgtatgaacaaactgcagcaggatgtaccccaaccaccacttcctgttcctctgtagcaggtttcctgtccctaccctgcttacccccacccccagtccctttgccctcccatgaaggaaggatcctcagggttggggcttgggcttggaataaggactccgatgggattcaggagatagaaatcgagttctggctgccagaacttgctgtatgatttagaacaagtcacttccccctctgggcctcagttttgtcatcggcaaagtaagggtattggatgagagggtcctcacacctcctctgacatcttttaggagtggttgcctctgcctggcctccagccctcaaccttcaccccatgcttaacttaaagctcaaggagaaggacgtgggcctggaagctggggaggggagaggaatgcctgaattggggctggggctccacaaccccccctccccaaatctaccctggtttccacccgacatttagtcttcttgctcccctaccccctgtccctggacgtctctgcacaggccctgggagccagagcgcccccacccctaaccctggattgtcagaggcaacgctgcctgctgcagtcaccaggccttccccttcctccaggtggaatatctgctgaagaaggtgcttagcagcatgagcttggaggtgggcttgggcgaactggaggagctgctggcccaggaagcccaggcagcccagaccaccaccggagggctcagcgtctggcagttcctggagctcttcaactcagggcgctgtcttcgaggtgtggggcgggacacgctcagcatggccatccacgaagtctaccaggagctcatccaagatgtcctgaagcaggtcaggccaagctgggaactcggggaggaccctgaggcagggtgaatgcgggcagggtggggggagtgaaacttgactttgccctggctggcagggctacctatggaagcgagggttctgagaaggaattggacggaacgctggttccagctgcagcccagctccctctgctattttgggagtgaagagtgcaaggagaaaaggggcactatcccactggatgcacaatgttgtgtggaggtgagggggacaggcgaaggggtggagcacaactccaggcccagaggctctggggtggggggtggggtataaaggcaagaggggtgggaggagggtgaatggaaaaagccccagtggcaaatgtctgcttctatgactgtaaccctggatgcctcgaggacattctcatccatgccagcacttaaaaaaaaaaaaaaaaaaactgcaaatcaaatactaaagtcatggctgagtaatgtggattttgctaaggatttcagaggagatgtcttatgccttacactacacagcaaagctttggggtttagagagaaagatagcacgtgggggaggggggtgtggggggcagaaggaaagagaatccttctttaaaaaaagacatatttatgtatttgagagagtgcatgaatggtggaggggcagagggagagagagaatccttgagcagggggcccactgcctccaggctccatcccaccaccccaagatcatgacctgagccaaaatcaggactgagaaaactaactggaccaaccaggcacccacacagtcaaacttataaaaatcctcttgaaaagttattctccttcacccaaattccattctctttggcaattctataccttcctagtctttcttcacatccctctcctcccgtccttcccctcccctggctctctgttgttattttagagacttaaaacaattactttaaattgtactaaaatacacacatacacacacacacacgtaacatgagatttgccattttaaccatttgaagtgtacaaatcatagcattaagttcgttcacaatgttgtgtaaccctcaccactatctatttccaaaactttttcatcatcccaaacagaaattctacctgttaagaaagaattcatcccctcctttcccctcaccccctggtaacctgtattctacttaatgtctccacaaatttgcctattctgggtacctagaatgtaacagaatcatgtagtattttgtccctttgtgactggcttcttttccttagcataatgttccaaggttcatccatgttgtggcgtgggtcagaacttcattcctttttgtgactgaatcatattccatgtgtagagactacattttgtttatccactcattcactggtggacaatgggttgttcccaccattttgctattgtgaataatgctggtttggatatctatgcagaagtttctgggtaggcctatgttttcatttctctgggtacatactaaggagtagaattgctagatcatatggtagttctatgtttaactctttaaggaatagccaaattgttttccatagcagccataccattttacattctcaccagcggtgtgtgagttccactttctccatatccttgtggacatgtgtttttttacattttaaaacattattattattttaaaaattattattatacccatcctaggctctctccatttttgtcacataaggaaatagaggacactaaggacagagcatagatcttaggcagaaagcctagctccaccactaataggcattcctagtgtgaattgggcatgttcctagacttagtaaagcctcaatttcttttttctgtaaagtgaagctaataatgcttgtctagcatgtttgggaattgcccagaaaatgatgcatataaaacagtagtttagcctctagagcataagaagctcaatacatgagacacctaactggctcagttggtggagcatgtgactcttgatgtgggtggggagtgtgagttcaaattccatattggatgcagagattgctttaaaataaaatctttttttttttttttttttttttaagaagctcgatacatggtagctgttattttctactacaatataagtttaggaaaggcagagatttggtctgtcaggcacacatcctagaacaatgagccacactcagtagacactccaaaataactggaatagatgaatggagaactttctcaacaggcagggctatgtgaaaagaatgatttggataatgaggactctgtcactggaagtgctcaagaatgatctacataaacactcagtaatggactaggtgctaattcccctggagaggcaccaagatggaaacaccctggccctccctccaaagagcagaggctccaagagttgttagtatgctcataactaacgtccgtgcccagccatgcaggctcctggcggagtgggagcgatgaccgggaggacggtccccaagacggaggggtgggggatggagctggagcaccctgcggcgggtgtggccacgaccccagtgaagacggcctgtctggggccacctgccctctcccaggtgctgcccgaccgagaggggaagcgctgcatgttctgcgtgaagactgcctcccgcacatacgagatgagcgcctcagacacgcgccagcgccaagaatggacggctggtgagtgctcgctgggtggcctggggctgtgaaaagggggtgataacactgcccagccggagactggaggggggactcgaggaccgcgctgctctctgctggcccgctgctgaccccctcctgaccccctcctgatccccctccgcagccatccagaccgcgatccggctgcaggccgagggcaagacgtcgttgcacaaggacctgaagcagaagcgccgggagcagcgggagcagcgggagcgacggcgggcggccaaggaggaagagctgctgcggctgcagcagctgcaggaggagaaggagcggaagctgcaggagctagagctgctccaggaggcgcagcggcaggcggagcggctgctccaggaggaggaggagcgacgacgcagccagcaccgggagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgagtgctataggtattgagtggggcctggttcagagaccttgactgggggtggggctgctaaagaccccctcctagctggcaatgagcttggacccatgctagactagattggactagacttgatctaagtttcatagtgaaattagtttgaggaattcaggttgggagtaaggagggacgaatgtggaggccaactaggcattagagggaatcagatttagaatttaagagatctagtactggagttagagacatctggatttgatcccagctctgcctcttaggagccttgtgatctcaggcaggctatttagcctctctgtgcctccattacttatcagtgacatgttaatgataactgtgctcatagaggtatggtaaggatcaaatgaggaaacacctatagttgttacaacaatcattataattatagtcactctgcctagcaccagccctaattatagtcataatacctaatattataacgcataataataattattaaggcttgtgctaggcagggcgtgtcttgagccccttgcccccgaggtagcatctgttcactgaccattatctgacctagtcaggctcccagaaagggatcggatcaggaaaccccgacatgaaggaattccttagaccctcactgggaaatcgctatgtgggccagcctagcggagccagagccgtggtgaaagggcagcacacctgcggactcccctcccccacgccgggcccccagtgaccccagtgacgtggctctgcgtcttcgcatccccgcacaggctcgggcctccatgcaggccgagatggaactcaaggaggaggaggctgcccggcagcggcagcggatccaagagctggaggagatgcagcagaggctcgaggaggccctgcacctggaagtgaaagctcggcgggatgaggaggcagtgcgcctagcccagaccaggtaggactgagggccccctctcgggtccccccccccccaccccggctccccagcatcccacttgcggggcacctgtgagggatcttggctctggagacaacccagtgtgcacccggcaggctgctagaggaagaggaggagaagctgaagcagctgctgcagctgaaggaggagcaggagcgctacatcgagcgggcgcagcaggagaagcaagagctgcagcaagagatggcactgcagagccgctccctgcagcaggcgcagcagcagctggaggaagtaaggcagaaccggcagagggccgacgaagatgtggaggtgaggccccaggggcagtgggggtggggggcgtagcaaggaggcccggcggtgagcaccttcgtgcgggatctggaaccttccctcaaaccgtggctctgtcccttcctggctgtgtgacctcaggcaaattgcctgacttctctgagtttcaagcccctctgagaaagaggcctgtaatagcattgtttgaagactgaaggagctaatagggatacttggtacaggtgcggaagaaacattagcagctatatttatcattattatgaatctggacaaaaatttttcctcaatgctcttccagatccctagcttgctttccgggccctttggctgtaatctccatagaagagggagttttgttgttgtttaatttttgatgttctttttttaaaaaaagattttatttatttgaaagagagcataagcagggggagcagcagagggagagggagaagcagactccccgctgagcagggagctcgatgtggggctggatcccaggaccccaggatcatgatgcgagccaaaggcagatgctcaaccaactcaaccacccaggtgcccctagtctttaatgttctgttaatattgattattttattttgcgctgttggctgacacggtcacgtaaaaaattgggacacaaacatgtgacatagaaagggaaagtcccactgtggttcccttacatgacaaccactgctaatggctggggttttgcatttggtcccagagaggtgctatggtgtgggggtttatagcacaacataggtttccgggcaagttgcttgacttcttttgcacttgtttgttgttaacttctgccctggaggttaactgaaataataaatgtactggggcatctgggtggcttgatggttgggtatctgcctttggctcaggttgtgatcccagggtcctgggatcaagtcccgcactgggctccccgtggggagcctgcttctccctctgcctatgtctctgcctctctcagtgtctctcatgaataaataaataaaatcttaaaaataaataaataaataaataaataaataaataaataaataaataaaaaataataaatgtacttagcacatcttagctgcttaatgaatggaaactataattatgattatctttgaccctttggggatccacaagaccactgaaattggaagctgcgtgtgtgtgtgtgtgtataggaaattggaaatatatatatatatgtatatgtatatgtgtatatatatatatgtgtatatatataaatatacatgagtttgagttttctggggagatgatcaatagcctttgtcagattccaaggggcctgcaaacctgaaaaggtcaagacaccctgtctaggatggtgtttctgacccctctccactggccctgctccccacaggctgcccagcagaagttgcgccaggccagcaccaacgtgaaacactggaatgttcagatgaaccggctcatgcacccaattgagcctggaggtgagaaggggtcgaccctggagctttctctggagtggggcgggagaagggagggagaaaggaatacctctagatctacagaatccacgtgggattgaaagccacaagattctcctctcccccgtggggtgagggaggccccttccacttcttccctgtgcatgcacctttctccttactcatgtttgccttttctctgccagataagcgtcccaccatcagcagctccttcacaggcttccagccacatctacttgcccgccgtgactcctccctaaagcgcctgacccgctgggggtcccagggcaccaggacgccctcacccagcagcagtgagcagcagaagtccctcaatggtggggatgaggctcctatctcggcttccgcccctcaggaagataaactggacccagcaccggaaaattagcctctgccatcttctttccccctcaacctcttacccaccagatcctggccacagctggcctgtgggtgatgccagcccctacagaaaagggagctgaggtcctggtgccaggagcccaggtcccccaaccatgacagtccagaacggagcctcattcatttttggcaccaactccaggcccctgaccactgaggcagtctagggtgtagatccttgagaacttgatcctgtgccttaaccccaaggaccctacgccctgggctggaaaagagtaaacaagcaagccaatagcatgtgccctcacactaccaccaagttgtggaggcacatttccaaataaaaactgctcttggaaagaatgctttttaaaaaaattttatttgtttatttgagataatgaatgagagagagagcacacaagcaggggcagagggagagggagaagccagctttccaccaagcagggagcctgacgcagagctcaatcccaagtacccaggatcacgccctgagtcaaaggcagacactcaacctctgagccatcctggcatccctggaatggatccttgatcgagtctgccatctatctttcctgcctcaagtccagttataggtcccagaaggagtcaagtggagggcaggggctgggaaagtacactgggccacttactaactgggtgacttgggtcaagtttgccacctgattgtgcttcagctcccatatgggtaaaatagggatgataatagtacctaccttatagggttgttgtgaggattaagtgtgtggcataggagccagcactattattatatcacccaaaagtgtttagtgagcatctattctatacagtttccctggttatttagttctcgtggcaacccaagagggggatattattctcatgtgaaaaaaaccgaggctcggggaggttagcttgcccaaaaccttccaaactctctctttccccatactattcaactcactgaccttgttacctaagacagagatctgagaatctaggatgctccttccttctcaaccccttcatgcacaaccctctcatgcacaaccatgaaatctgttagatcctccacagtctcatagttatccctccttctttatggctacagctaccaccacgactaaggccttcataacctcctcctgtgtgctcacctttgactccttctccatcttgtcccatatctaatcagtcaagttcaccgtcccagatatggcacctggggtctgtgacaacctagcccaggagcctcctatgcctctgctttatagatttgctaatagatccctccttttctttcctctgggtctatacactcactgtccttcccaccctacttcatgtaacagcctccataactacatgcatgagttccttgagggcacggacgtaacttcttcaactcatgtccccagtagctagcgcagtgcttggttcttagcaggcatgcaacaattgtttgttgaatggttaaattctaaaatgaatgggtgtcatgtagcttaaaagtgatgaaggggctaaaatcaaaactcaagtctattcatttattcaatgaattatttattaagcccttatatgccaggtattgtgctaggtgccggttatatggcacagaagaaaactccttgcattcctgcagcttatgtgctagctgataatcaaagttcatttcttttgcaagtacaccaaacctattgcaaggaacttcattacagcctattgaaagtatcatgaagcaaaactaccagtataactcgtatatttcagggatgggaagtgaggttcaaactctaagggtggggggaattcaaaaaaagggaaggaagcattaggtaggagctgggattcacaatgacccttaaaacttttaataagaaaggagaaaggagagtaggagaatatgggaacaacattaggtagacagaagcataacacatcctcgagcacaagaaatctggattctggatgtgaatctctcctctagtgggaggtccaatggtgttctcattggaggtggggtacctctggggtacaaggagttttaagaaaatcagcttgtagatcttcaacttccaagtgtgctcttgaccaaaactgtccttctcctcctcatcctccttcttcttctcctccttcttttaagatttattcgagagagagagtgagtgagaggggcggagggagaaggtgagagaatctcaagcagacttggcactgagcggggagctggacacaggactcgatcccacaacccccagatcgccacctgagccgaaaccaagagttaggtgcttaactgactgtaccacccaggcggcccaaactgctgtcctctttcacagtgttgccttccctacttttggtaacagggttcaccactccctcacccactatctttcaacggcggactgtccatagggggaaatgccctggaacagtaaacaaagcaatagtttgcaatgctggtggtggctgtgggtgccaagaaaatgaatggctcaaaagctggacaacaaaatctttttgttttcaagtcaggaggtttccaaatctttgttttcaaaacctagaaggactttattgcattgtcagctaaaaaatcattaacaatatcttttcataacagatctttgtgatttttttttttttggtaaaaaactgagatttagatgcccctgctatatcaaaattctcaattccaaaaacaaaacaaaaaacaaaattctcaattaccttctacttggtggtgtgaaatgaaaatgaaacataaatgaaaacatgggcctggaattgatgctgaatgcagtctcattacagcaataagttatatccaattataaacatataaactacctggggaaaaaaacattggcccatccattcattaagaaatacatttccagggcagccctagtggccctgcagtttggcaccgccttcggcccagggtgtgatcctggagacctgggatctaatcccatgtcaggctccctgcatggagcctgcttctctccttctgcctgtgtctctgcctctctctctctctctctctctctctctgtgtgtatcttgtgaataaataaataaaacctttataaaaaaaataaaaaagagggatccctgggtggcgcagcagtttggcgcctgcctttggctcagggcgcgatcctggagacccgggatcgaatcccacatcgggctccctgcatggagcctgcttctccctctgcctgtgtctctgcctctctctctctctctctctctctctctctgtgactatcataaataaataaaaattaaaaaaatatttaaaaaaataaaaaagaaataaaaaagaaatacatttccagaggcacctgggtggctcagtggttgagctctgccttcggctcaggtcatgatcccagagctctgggatcaagtcccaaatcggactccctgcgggaagcctccttctgggcctatgtctctgcctctctctgtgtctctcatgaataaacaaataaataaaatcttttttaaaaaaggaaatataccaggggcatctgagtggcatagtcagttaagtgattcttggttttgactcgggtcaggatcccaggaccctgggatcgagccccgtgttgggcttcctgctcagtgaggagcctgcttctaactcttcctctgcccctcttccctactcttgctctctcaaataaatacataaaatctaatttttaaaaaatttcaacatatatacatattttggttgcagagatgtaggatatggtaatcaataaaagactttttaaaaatttatttatttattcagagagagcgagagagaggcagagacacaggcagagagagaagcaggccccacgcaggaagcccgatgcggaactcgatcccaggtccccagaatcacacccggggctgcaggcagcgctaaaccactgcgccaccgccacccaggctgcccaagtaatcaataaaaaacttaaaaaaaaaatatgttaccttgatcatatttttgaaggaaaagtggaatggaaatgcaagtacaagtagaaaaaagggacaatgtaacattttttattaataaagaagagcttctgcatccatgtaagatggatgatggtaagcatcacatcactatgggatgtgggtcttattcaatacatttaaaagggtggtagggcagttttagtgaaaatgtaaatattgggcagccccggtggcgcagcggtttagcgccgcctgcagcccagggtgtgatcctggagaccctggatcgaaacccacgtttgcttctccctctgcctgggtctctgcctctcattctctctctgtatctctctgaataaataaataaaatcttaaaaaaaaagaaaatgtaaatatttataaagcagtagaaatgacatccattctctacattttaagttttaaactaatggagaaaaatattagatgtcaccttaaaaatgtagccttgtacatttataagctacatagttatattttcttttaggaatagagaggcaaaaaaatttgaagactactaccatgaaggacccatgactaggaaggtagaatgaggcctgattatagacatccttggaaactaggtagagtttagcttgaggtgttaagccaacccctaagctttggttttcctcacctgtaaatggggtccattccgggcttttgaatattccatgaccagccacagggaggcgttgatggttgagggatgagatactgaaaggcagatcgccccagatgcctgaataccatccacattggaactggcacaaaaggttctcagttttgagggacagaactaagcagctggagaaaatattttccagtcttataattccaggattagaaagcaactcctctgtcctttccaacatctggacaagggagagtgtatccaatctccaatgccctcggagatcctcatcaactctggagaccaggtggagagcagtgccattgtgggctcaagtcatcccagtatggcttatttgtgagggggagtagggaggtaggatgattggctgggctggagtgcaacaggcttctcgtgaatcattggcaggatctgcaagatgcctcctcgagtgcagtgtctatctaggtagaagcggtgccagctgagagttgcctctctggcccctgctgtaggtgagaaggggaggaaggaggctgatttgagtaggctaaggagtctcccaactgctggctggtgtctgaaatagctgtggtggaggttggaatctaattcaaagcagatctagctttattccacaccataagttattgttcagttatattgttcagttatatatcatagttatactgtaattgggcatcagaacaggttttggtacctgagatccctggctggtctggaaaaggttacagaggcttggcagggaccaactttcccccctctgaactgtgcctgtggacaaatctggttaaaatgaagattcaagaaacagaaatggaccgatttaagtaaaaagggaatttattaatagagtatagaagagttccttaaataactgggaggatgaaagaaagccacattggaggctgtatagtcaggaaaaatacctcaaatgatggcacactacagttcttatgaagacaccccagctgctttgcctggggtagatgctgctgatttcatggctaatatcactggtgctagacactgctcttacaactgctgcttcttacagctagaagttaggtggagctgctgctctgccacttacccaaatggattatgtgcagttcccagcttttcatctttccaacttctggtaaaaccttagttgtatggctatgccctggctgaaaagggggctagaagcttctacagtggaggaagagtctaaagggggagattccccaaatatgggaaggtgattcagaaattaggtggccaaaagcaaagaagccttgaagaggatgggtatacataaaacggtacattctgaggctagcaatttggtggtaaagggagccataatcattttataggagaattagggtgttgtagcttgaagactccaaggggatgggatcaaacatcagaaggtctcttacatggaaaataatcttttttttttttaatttttatttatttatgatagtcacacagagagagagagagagatgcagagacataggcagaaggagaagcaggctccatgcaccgggagcccgacgtggattcgatcccgggtctccaggatcccgccctgggccaaaggcaggcgccaaaccgctgcgccacccagggatccctttttttttttttttttttttttttaatttttcatggaaaataatctgatttagtttacctccaagggagaggactaaccaactggcatactagaggatataaatttctgctcaatataaggaagatgttacctttttggtctttaaaaaccaatcaaccatgtttcctttatgaaaaagaagtgctcagaaaaaaaaatgtagaaagataataactcatagaaacacaacccaagggctcctgggtggctcagtcagttaagcatctctggtcatgatcccagagggtcctgagattgagcccgcgaggggctccctattcaatagggagtctgcttccccctctccctctgcccttctccctgcttgtgctctctctctctcaaataaataaataaaatcctaaaaaaaggaaacacaaccccaagacaacagctgacaatattttagtgtgtcctttcaggttttctctatccctttttgttttccaagctatatataccatcagattctgccttttgccacttaatactatatcataacattcccctccccccatttctttaccaactttttttttttttatgatagtcacacacagagagagagagagagaggcagagacacaggcagagggagaagcagagggagaagcagaaggagaagcaggcttcatgcaccgggagcctgatgtgggattcgatcccaggtctccaggatcgtgccctgggccaaaggcaggcgctaaaccgctgtgccacccagggatccccttctttaccaactttacagagcatgatattctatcgggagcatacaacgtaattaacctaaacatttctttgttgttgataatgagcttagctccacgtttttgttttttaaataatattgcaatgagcaatggatttatgtggtctaaatgctaaatacatacttattaaatataatattctctcagggcacctgggtggctcagtggttgagcatctgccttcagtttaggtcatgatcccagggttctgggatcaagtcccacatcaggctcccttcatggagcctgcttctccctctgcccatgtctctgcctgtgtgtgtctctcatgaataaataaataaataatttaaaataaacaaatgttaatattctctctatatatatctctttttaatataaaaatgagatgagggatccctgggtggctcagcgatttagcgcctgccttcagcccagggcgtgatcctggagacccgggatcgagtcccacatcgggctgcctgcatggagcctgcttctccctctgcctgtgtctctgcctctctctgtgtctctcatgaataaataaaatctttttaaaaaaataaaaatgaaatgagatggaaaatgtaatttcttgacagtatttgccaatttcttttaggaagagagctgcttttattaggagaaataaatctcttaggagtagaaagtaagatgttcagggcatgagtgttggcaggacccctagcaatgaagagataaggttaagttgtctgtctgcctggaaatcaggaagaatttgtttttctccagagagggtggggtagaggagagaatgatgaggcaggcaggagaggtagtgattcaggagaaggcaagaccctcagaggtgaagggccagttagaaaacctcaaatggattgttcagaaaagactctaaagaatgtctggtgtgtgagtctaaactgtttgcaatgcatcatcatgtgaccctgctccagggctcaaggcatcataatgtcttctctgaccatgaatgctttgtgtgggaagacatgtgggcagtcctcaggaagggctgtttcatctctacatttttgaactgtgccaccacaacagcctggcaaaaacaagagcctggagccggtgagatttagaagaatatcagttcccagaaatttgcaggaatcttagggaaggctttgacctctacaattcattcttacttcagtctcaaaggacaaggaggttgatgtctaaatcacaaaaataatgcacacttatttcaaaaattaaaaaaaaagagagagagaagcaggaaaagaaaaatcactcatggttctatcatccagacatctgaggtgtggcttgaggaatgtattccagagggaagaggtaatcctagttttaaagacggtattgagaagggagtcagccattgctcatatacctgagagtcaagttttgttcctctgccagatgacaaacccaacttcttccgtaccacctaccagctgctagatatctttttatggtatatctgaagggacaggttgggagaacaagtcccttccaagtcttgaaaaactgggttaagaagcaggaacagaatttgctgcagcagtaaggaggatgctccccatttaggtggacaataatataacataaggacataggaagagaggtaaaaactccatgaccataaatttctagttatagaagcctgtccagggaggaaaggcaattcattaaaattatgggcagcattgactcctccagaggaatctggaggctccggctttgcttctcactgcaagttgctcaccttctctgggactctttttcttttttttcttttcttcttttcttcttttttttttcttcttttcttcttttcttttctttctttcttctttctttcttttctttctttcttttctttctttctttctttctttctttctttctttctttctttctttctttctttctttctttctttctttctttctttctctttcttttcttctctttctttcttctttctttttttctttctttctcctccacgcccctaccctacaaataccaaaggctctgtttgtcagtctgggggaatattttggggaggagatgaaacttcagattaaaagccctcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatccccactcccgcgcccgcctcggccgccgcgcccgcctcccgcaccagagggcgctgcaggcgggcgctgggtagcgtgcggtgggcggagtccagaatcaggacgcgcggtgattggcgccagccggggcggaagggggcgtggacaggagccgcgggaggcccgagctgcgcggtgacgtcagggggtgggggcggggccgagccgcgcagcgtgtgacgccgcggcggccgcggagctggggattaatgggaaaagttttggcaggcttcggaggagcctgcggagcctgcgggaccgcggcggcggcggcgcgggaggcggccggggcaggtcagtccggggcggggagacggtgggcaggcggcggcagggggcggcgggccggggctgaggcggcccgcggggccggggcgcgagccggggggagcgggccggggggagcggcagggggccgcgcggctgcggctgcggctgcggctgcggctgcggctgcggctgcggcttcccggcacccgggcccgggccggtccgcggcggtgtgtggctctcctggcgcccccccggccctgcgcccccgagcttagggaccccgaagcgcgcggcctcccccacgcgactctgtgcgctctcttgggcctagtggctccgtctcctgccccttctgtgtcctgagagccgggtctggggctcggggtcctctcccgttccctcctgttgcctctgacctcttcctccgtcccttccctggtgtctccagatccatgggtgcccgctctacccagggtctctgtccctgtccacgtctttatctcctgccttctcctcccagccttgccctgtcattgctctcttttcccatccctggctcccgctctgggtgacgggtcctcctcgtcatcttcgcggcgttattaggctctttcagccccttgccggcagtccctatctccctaagccccttctaccctggcttccccccccccccaccccccgggcctgtttttgccctgtttctccctcatttccttgtgattgagccttgccccctgcattcctgtcaccaacttccatcccctcacttctactctgggagaagagttagctccacacgctgctttgctttcccttgacttgctgttgagacaccgctgggttggggtgggggctgttcagccagggattgaagtaaggggctgaatgtccgaggtaagcagcaggcatgtctgtatgggtgcttgggtgttgcatcaggggtgaggtccaatttgtagaccattcttctgatctcagctttaaaacttcccctttatgggtctgttgacttccaggaacccttggggagagagcagccgctgagttgggtatgtgccaggggtaactggaggccttgtccaactcttttccccttccaggaaacagggctctatgtctttccactctggatgtaccaagcacagttatacaatcatactccagattatctctgccctcattcccactctgagccccgtccccaagagctaagaggagtcttcagaagttgtgccccagagaatgccttacccttttcttctgtactggctccaagacatttttttcttacttgagttttgaaatagattgccagcccgatagccctggggctggcaggcatctgccccatctgttattggtcacaaccagcttctgattttcactctgcatctctgagccactgaatgttagggcctttgatgtcagtcacttagcaggttctcttgaagattcttctccctccattttccctgagagcttcatttcctatcgatccaagaggctgatcctaagttctggtccctttgctctgtcaggtgggtacctgcctgggaaggttgtgggactgcattagatggtgtcaggaatttgagtggcttccagtcacagggatgtcctgtctgcggctagagagcccaccgccttcctggtatgtctgggggtttaacctagtcagacagaaagttcttttcagatgccttcaatcttagctcctttatttggcgttggtaccctggagagatctttaggaaataacattatcctctgtttctactcagtctgatcttggaggattctgagtgtgtgacccactcacgtttagaaatgaaggccttttggggagcctgggtggctcagtcagttaagcgtctgccttcagttccagtcacgatcccagcgggaatcctacttctccttttccctctgtcttacgcttgtgctctgtcaaataaataaataaatttaaataaagtatgctctgtcaaataaataaaatctttggaaaaaaaaaaagaaagaaatgaaggcctgctgtttcacctggctccgggtttctaggtctcctcttttgaggatcctgctctctgtctttgagccagaattggacacagaattggcacccttcaggagctgtggtggagagccaagtgaaccagcttagaccagactttacgttttggaatcctcttgtgcactgacccttttctgtgaaaggaataggactgtggatggctgagccagtctcctctcctcagccccttcctaaacagtacttgggcaggatttgggcagagtggaccaaaaggggtcccttgttcttatgaagagcacccttctagggttttaatgggtcgttctgatgaagttgaggctgtgtgtttggcagtgagttggtccaacccctactcccaaggactttacctgactcttttgagaagtttgctactcctctgtcttcacttacccattagtggttacactccaccgaggcagcaggtgagaagggcttaagcagaggtcaagcccagaccttacagaatagcgtgggcaccaccagctctgctggatagcttcttgcaatttgtccgctctgtggccttggtggatggtcagggttatcagttaccaagttcccatccagtgatttttgcagagtttgggtcaaaggtgtggggaggcaggcctctgacattattctccagatagtgtagcccatcaactccttagttgaatggactgatcttttttgtctggctgtctttcttcttgcttgtccaccactcgtccccctttggcatgggcctctacccattcaaaaagaatgacccttaccccacctatggtccctcagatctcttccctaatgcttgacagaggccagtcagtgttgtacgctggccggggaagcatgtaagctctgctttggagagtgcagctgttctggctgttgtgcaagctgtcccgagggcctgcagatcctggcctgtcctgggacagtgcagctcctctgtctcaggaagagttggacctgtcacttctaaaggcttcagctgtatgtcttgtgtcactgcggcctacctcccagggtgctccctgctggctggaagctaaatttcagggctttcctccagggcctagtaggacctggaagtgccaggagtttcccgattgccctgcactgtccatgctgggatcattctcttttttcctccctatgcagcatttccatggactttgtctgtcttgccaggctctggcttgtgttatgtcagaagttctgtgtgcgatgcctttgcctgtaccatgttgccccagattgcacagtggctgcttcttgtagatggtttgatgtcctttagtatttttctgtgcctttggatccaggggaggagccattttcagcagctgcgtttcactgtgtcagaggtgagctggacacttgtttgagcctggcagggaggagatggccccttgtgtcaggtttcagacatgtgggtcttcttggcagatggttcctggccttcataactcagaggctggtgattagggtgtgactctagtcctgtggccattaggctttggccaaggactcaagcatgactcagggcatctccatttatgagctgccacctgtggggggatgttgggctccaggtccttcttcactttgccagcaatttctgcctccccctgataaaagcagcaaagccggtgtctgcttacttggaaatgagcagactacttccaggattgggaaatatttgctgactcaggctcagaataacctgtctcagggtgtgcatgtgtgagggacaaagaaagagccagtttaggagcagtttctgagctttggtgtttaattacaacattaatgctgcttttctggcccctggcacctcaactaaagatattgggtttctttctcttctgcagtgttgcgtggtgttttgggcatgcacatggtactcacgcagtggcttctgttcactgacagatgaggacagatgcaccaaagaggtaatcccagtttccttatacaaagacccctgacgactgactgacacatcccagatttaggatcctggcctaaaagataaaataatttcactggggctgagttcccagatcccaagtgcctgtcataacatttggtactcattgcttacacatagcaggctcttaattaaataattattaaatgtctgtggcttatgtagttttttggggagcattgagatttctcacctttagacccgctaaaacaaattctacaagggcagagactgactggctttgtttcctgttgtgtctaggtctgcctagcactgaggagatgctaaatatttgttgaatgaatcaatatacaaacttttctctgttcatatgggtaccaggccacaaagatggtgtctgtcattctctttcatttatgtaatagacatttctgagtgtctgttatgtaccaagcacatactagacacatgggaaatggtgatagaaaaaaacagattcagtccctgtctgatgggtccatagtttgttggcatatatgagatctgggcataacacacaagggtttttccttccatctctgctggtgtagcaggccctcaccagagtctgacaatgctctgggcttctcattactgtttccctgtttgtttgttctcaggatgcctggcagattttataaactctcagaaggggagctgcagggaattcgatgttcattgtctcaactatttaggaggctgggctatggtgaagtcgctgctgggggccaggggaaacatgcgctcctgtctgatttaatctctgaagttcagtggttccagcagctgtttatgggcttcacttccctttctctgcctttaacaccctgtgggttttcctgttgcctaacagggtgctgagcccatatggctgtcagtctaggggggtcaggtcgtttgtggatcttgcaggaaggccttaggcaggggcccctcctgttgtcaaacccataccaagtcctttcctttgaaggaaatgtgaatgaggaagaaggagggtgtgggaggctccctaggttccctgggagggaataaacgtagcaaggagaactactgagttaattgctgtgtcctttgctccagcagcagctggccacagtggcagcaactgtacatgtccaggcatcacttgtccagtttatccctgagctttaagctcccggtcctagcaagaaacttctttcttagtttccactgtcaaaggtgaggctagagctttatcagatttttcagtgctaatctcagaagactgtagttaggtcgttatcttagtctttcccatctgaggcgcttttgtgggtcaggtcctgtgacagatgtttcagatacgttccttggctgtgcccctccccggccccgcaaaatgtggagtctagccgggaagagaagacataggcacaaaaagattttgaaaatattaagagagctagtgggttctgagaatatggtcagggatgctcatttagaggagcaggtcatcactttgaatcggctttgtccctgaagaaattgggtttcagatggggccttgaaagaaagttggtttattttatttttttttagaaagttagttaattttgaaggcaactttaaaatgttgtaaacagcaattctcaagcttcttgacctcaagaacccctctcttaaaagacacttttaaaaatcattagagacccgtgaacttttgtctaccatagtagaaactaataagctctgaggaattttaagttactgatttattcattcattcatttatttttaaaatattttatttatttattcgtgagagacacacagagagagacagagacagagacacaggcagagggagaagcaggccccatgcagggagcccaacataggactcgatcccgggtctccaggatcacgccctgggctgaaggtggtgctaaactgctaagccacccaggctgccctattaattcatttcatgtaataataaacccagtacatttaccacaagtgacctttttaaagaaaaaatagctatttttcaaaataaggttgagagaagtggcattgtttcacatttttggccatcttttaatgtctgctttaatagaagacagttggattctcataactgcttcaatgttcagtctcttaaggtatgttgttgtatttgaaggctatgatgaaaatatggcctcacacagataggtagttgagaaagagaggggtaacagcttttaatagctttggcagataattgtggatattctttggtactataccaaaccctcagcaagtggtagtttctttcttttcttttttctttttttctttttttctttttttgaagattttatttattcataagagacacacagagaaacagagacaaaggcagagggagcaggctctccgcggggagcccaatgtgggacttgatcccaggacctcgggatcacgccctgagccaaaggcagatgctcaaccattgagccacccaggtaccccaacaagtggtagtttcttaaaggttagttggaatgtagagtctgaaaccttaccacaagttttcatactttgtgacattaaaatccattggtccatcttgtactttgcatagatcttttactttaagttggtcatcagaaccgctaaatgttaacatatttcattttacaatatcattaagtcataggaatactactgacctcaacagcaaagcattcaagtattgggaggctgtcaagctcagagtggggatacaagttttccataatttggattttctcttgaaagcttgatttttatcactggtaacacactgtcagggtttttgtttgatttttttgtttaagtattttatttatttcagagagagagtgagagcatatgcttgtgcatgtgtggggagaggggtaaagggagagggaaagagaacctcaagcagactccccactgagcatagagcccgacacagggctcaatcccatgaccccaagatatgacctgagccaaaaccacaagtagggtgcataactgactgagctgcccagatgcccccatactgttaggtttttttttaatggagtctccgtttttttttttttttttttttaagattttatttatttattcatgagagacacagagagataggcagagacataggcagaggaagcagcaggttccctgtgggggagcccaatgcaggactcaatctcagcaccccgggatcacaccctgagccaaaggcagccattcaaccattgagccacccaggcatccttgaatctccatttttaagaaaaagtctgtcaaatactcaaaacctaaataattataattttttttttttaatttttatttatttatgatagtcacacagagagagagagagaggcagagacacaggcagagggagaagcaggctccatgcaccgggagcctgacgtgggattcgatcccgggtctccaggatcgtgccctgggccaaaggcaggcgctaaaccgctgcgccacccagggatccctaaataattataatttgttactcttttctttcaagtaaaagtgttgtttcatgaaaaaaaaaaaaaaaaaaaaagactagcttgcaacgcaatctcaaatttttcctgagacagacaatgactcttattttgttacaagagtatttaaaagacatatatttcaaggtcattatttaataacgtcaatttttatcatcttatctaggacattttttaaaaaagattaatttatttatcttagcacacaaggagagggagaatacctcaagctggctctgactccccactgagcatgcagggccaactccaccatcctgaggccatgacctgagctgaaatcttggccagctgcccaacctactgagccacccaggtgcccctcatctaggacattcttaagtgaaattggaactttattatctttcctggttctttaggttgactgggctcatctgggcagttctcagttgaggtatattgctttagtcagatggaggttggagcaggaatcatgtggaggctcagctgggctggacatccacactggctaactcacatggctggctcttggtactggctgttgagtagagtacctacatatggcctcttcatgtgccttgagcttctgacagcatgatggctggattctgagcagaagcatcccaagagtgagtataatgagagttctaagcaatgaagggcaaggtttcctaaaacctagcctgggaagtgacactgtcaatttctttgtcttttcttggtcacagaaccagttcagatgcagaggactatacagggtatgaataccaagaggcatggttcattgggaaggagagagagctccttggaaaccagctactactgcttttgagtatcccttatatgagatagcctggcctgcgatggagggagagggagaagcaggccccccactgagcagggagcctgacttggggctcaatcccaggaccctgggaccatgatcctagccaaaggcagacacttaactgactgagcaacccaggcgccccaccactgatggttttggagtaagaaatcattgttaatattgcacaaaagtggattaaatagaggaagaatggaggtagagagtttaggtaggagactactgcatagtctgaatgtaaggaaattcttcatcatattaaatctgagttcctctggttgctgttaaaattattgattttgatctatcagccacacagattaagtacccagagcgggactagagaaacccctctccacccttatttaggaatgctgatacccaggagagatcaaaagcttcacagtgtggggacccctgggtggtttagtggtcgaacgtctgccttcagcgcagggcatgatcccggggtcctgggatcaagtcctacatcaggctccctgcgaggagcctgcttatccctctgcctatatctctgcttgctctctatgtctctcatgaataaataaataaataaaatctttaaaaaataaaatcttaaaaaaaagcttcacagaaagtagaaggcaactaagttaggctttatcgtctgggtccaataggaggttaatccttctttatttatttaaaatttttttattcatttattctaagcgtaggtgagctggggggagggggcagaggcagagggggagagagaacctcaagcagactccccactgagcacagagccttgatgcggggctcgatctccagaccgagatcacgaccctgagttgaaaccaagagtcagatacttaaccaactgagccactctagtgttcctaatcataatttgttaaaagaaaaagcagaagaaagctaaaggtttacataactgcacagacagtatttcagatactcttcagtttcgccctcgtagaccactaggaggcaagagaagagtgagaggaagaaagatggacaaattcgggaatggtagggagagggaggaagaagggggtcaaggggagagaacagcaaaagaagtttgaaggaggtcgagatgggaggaactgctcaaggctgaccttccagggagatgctggctggagggagggctggcttccctgggggcctggcctctggcattcagcacctcttgtcctcatcctgtctctggcttttctcttggtgaagaggccatgagaagagctggggtagatttgctgttatttttttgagagggggtggggacctgggagaccaagagtcacctggaggtgactctcagctttcatgtgtggagtcctgacttgatgatcaaaataaaccttgggcagtgcttgttcatcccctctcttctgaggcggggagctcaggaagaaatgcctttctgagacagttccttccctaatttaccagctgtggccctgggagcccaacctcagtatggggagtctgcggattctgtttcacagtcggtgttctgggcagtgcaccttgacgccgcttgtttttccttttccaagtccaggcttcaaagcctacctcccacagccttgtcgtcatcccagcagctgtctggagaccattgctgaattcttcacagctcatggtgacacacctgtgaaagagttctctcacgaggaggatcatgaatggagaggctccccagtgttgtgaggaaaccacttcatgcttaagttcatttctgtactttgtatcttctataacccctttgatctttgtcttattattttggcacttccctcatccaggagttataacctcagaggcacacagtcatttggctactactccagtggaagtacaggccaactctgctctcccaatggcagcctttagccaccctacacacacagtctgcaggaccactctctcctcaaaaacagccgtccttcagtttgccagacgccagagttttacctatctcatcccctcttccaaacaagcaaacaagatgtgttttcctcaattcttcttgtttccaacgttgtcttaagagaactttactttcttcacctccagttcgatttcctttagcaccaggtttctatagcactgtccccagtcctatagacgttttggggtggggaatttgttattgagtgggcctcagtaacacaggcagagggagaagtagactccctgtggggagcccgatgtgggactcaatccccagaccccgggatcatgacctgagctgaaggcagatgctcagccactgagccacccaggcgccccagcatgcagtttttacaatggaaatgttttctcctcagtcacctctctgggctcttgaggactttggggaggagtgaaataattcacaatgaggtagcatgttgcaactaagaagccttatgatttctatgcaacagaggcacggtgtccaagacaaatcagtgtcctggaatggttgggtttgccatgtcttgcttttacaagtatttcagtgtctagaccaaaaccaccttcctgtaactcccagaggtgctgtgtagaatggagttggtaatacgtagcaggtagactgttattaacgtgtctgttcctggtgtcagatgttaccagctgatctggtgctctgatcacagcagtcttcctctccaaagccacatgggttctcagaaccctctacccatggcagctctcctaagaggaggcttacctgccatccctggtcatgagcttgtttgtctgatggcagaccatttctttccagcttccccttctgcaaaagccttcaggacagtccagagatcctggtaaattccccctggccctcagcacttgcttcttgggatgaactcctgtgtggtccattggaagctccaggttggagactacccttctcctctaaggaggccctccaaaggctagaatgcttttgggaattaatgaaatgaattctccaccctttagataatagcaagcagtgatagcaaaagaaagaccctggcccaggacactgccaagattcctgctctgacccttctttcacgtggaccaaagatatgaactcttccacagtcttggactctgtctactgtggtggtagactgggtaatagcccctgaagctatcccggccgtaacccctgggacctgtggatgctaccttataaggcaaaatggactttgtagatgcgattaatttaaggatctcgagacgcagagattatccaggattatccgagtgggccctaagtgcagtcacgagtgtcctgttaagagggaggcaaagggagatttgatatagaagacaaatgtgactgctgcagccagagctaccccattggctctgaagatgaaggaagaggccagggagcacaaggaacacagttctagaagctggaaaaggcaagcaagcaaatactcctctggagcctctgggaggaagtatagccttgccagtaccttgattttggagtaaaaccaattttgaactttgacctccagaactcttaggagaataaatatgttttaagtgttaagcttgtagtaatttgtaacagtgacagcagaagactgccccagggctcatttgcctccaggcccaggcggtgactcggctaggtctcattcttatttcaaggcagtcatagagcacctcttttatggcagtttaagatcctatgcaacagaggcacggtgtccaagacaaatcagtgtcctggaatggttgggtttgccatgtcttgcttttacaagtaaaatttgtaagcagattacctttacccagattaaaatttgaagcaatacactctttggagaaaccttttaaggagtttttggggataaaagagaaggcctcaggtagtgtctgattcttgcttttggaagttaccccacaccttcagaatcagatcagtaagaaggggtttctttcagactgttgaggatccaggattagtttaaatctgactccacttccgtctttctcccactcatgcggttactgggttcctcctatatgctaggcattgggggtgaggaagtgaacaaagcagataaaaaaagtctcgtgttcttatggtggttgtggtggagaaagagaagagagccagaattacgtagctagcatgtcaggtggtggtaaatgctatatcaaaaaataaagcagagggcaccaggatggctcattggttaagtggctgacttttggtttcagctcaggtcatagtctcaggtttgtgagattgtgtcagaatctacactccatgtggagtctgcttcagattctttccttctttctcccgccttcccctgctcgcacgtgcacatgcacacatgctccctctctcaagtaaataaataaaatcttaaaaaaaaaaataaagcaagaaagcagtagtggcacttttaaatggagggcttaaggaaggcctcactgagaaggtaatattttaagctcaagagaagaatgagccatgtgtgggaagaaccttatcagcagagggaaagtaaatgcaaaggccctgaggtaggaacatggctggtgtgttgaggactagtcaggaagccactgtggctagagttaagggaggggaagggaggtcggagatgtgactgggcctgatcactctggaccgtgaagtactgtaaaatctcttacttcacctgacctttagcctcttccctcctttccccctcttcacactgcctctcaggcttcatgcctgtgttcctcagttcctttctgtagaatgtgcatcatgtcatacctagggcacatcagtaggtaaatatagtccagtgaaaatattagaagaggaggaaaaaagcaactccttctttctgaataataaaagcagctccactgttagtgctgatatggagccacgttcctagaaatggaatgagaagagagccagaattatgtagctaatggcatgtatgagagtggaagagatggaatgagaagagagccaaaattatgtagccagtggcaggttggctgctctgctctccgcaggcagttctggggtggttcttgggggtcctcacttcagtcaccctccaggcccccatgcctgctacttcttttcattctgctcttcctgggctacttagaggggctcctacagttgcccacctgaaattctttcttaacagcccccttacttccctgcccttcctcctaggaggcctgccatctccccagctgcccaaccaggtgtctgaggactgccagaagagagcaaaacacataagtgcatgtgctgccactgtgtatttctggttatcacttagattctcagcacccacaggcctgcgtctgccatgtctcagaacccctgactcttccattcctgggagtggctgcctcaaacctcaagactctgcctcctccaggtcctcatggtgttgcttgggtttctaagaatcagatccccaaaggtcaagtaagccagcctgaaaagtcacactcttcctggataatgacctcatgacagttctggtgctttggcaactttccagaatgacagtctgtcagtagttgatggtaagcttcactgtcatctaggggtcagttagaaattgtgtccatagattaaatcctccatgcctgtgtccctgattttatagtcctaggtgactcttctcagaacctgctttaaataatggcatctaattgattactatttagtaataaacaaatggaccaataataatttctatctcctaagtgaaaatcactaggtgaataaattctcaaactgccaaatacatccagtcgaaattgtatttttccaattttgtttagattctattacagtgcacgatttctgtgacatttctatttttggcatcttaacgcccccgtgtatttataacgtctatttacaatttgcctttcatatcctcacagcgtgtcaccttgcagaaaaatattttatccattttttagcccattcttgacccagaagacataaggcattcttgactcaggctaaggcctgtctctttcccctgcaagctaaggcctgtctctttcccctgcaagcactgtagccttgtcttctcacatactaccagtaccatccgtattgttttgtttttgtttttaaaaagattttatttatttatctgaggagagggagcatgagtcgggtgggggtggggggcagagggagaaggagaagcaggttgcctgatgagcagggagccagatgtaaggcttgattccaggacactgagatcatgacctgagccaaaggcagatgcttaactgactgagccacccaggtgccccaagaccatctgttttttttttttttttttaaagatttatttattcatgagagacacagagatagtggcagaaacatgggcagggcagagggagaagtaggctccctgcagggagtccgatgcgcaactcgatcccagatcttgggatcacatcctgagccaaaggcagatgctcaaccgctaagccacccaggtgtcccagaccatctgtctttgattcacttttgtacccccaccctgggcacattgcagacaaccaggaatacctctcatgagctggttccagcgctcccagggcttctgcccttactctgctttctctctctggactgctgcagcctgaaccttgccctcctttctgccttctgcttccatcatgagaaagaactggtccatccatctgatgttctccatgagtcagagaccttgttcagtcgcaaaggggcagcttacaatgcacagtcatgttctccgtccctatgggtgttcattagccatgatcaaagatcatcccccccacccccgctcccgaaacttgcttcttgatagataagtgcctggtgcagaggtactctccgagcacttgttaaacagaacagtgtctggctggccagcctaaggtggcttgctgccaagagtagccctggcactaacctacaccagagtcctgtctggggcagcagtcagacatctgtagaagaaaaccctttcctggttgttactcttctctttggttgaagcttcgtggagacaactgaggttttcagttttggcggtttttcccatatgcctccttctctccacttcctccactgggagtctagtaaggctcctttctcctccttctggctcagcccctactgtggtatatgatggtggagttatttcctccattctaggttcagattgtgagttcttttgagagctgagctcagctgtgtctaatccccctcccgttccaagcagaagtccatagctgcccaggaggcaagtaagctgtagctctcatgtgggctgaatgcaccgtgctgattacttcatatgcatcaccttgcttaatccacacaaccctgagaggtaggaatcatcatcctccttttacagatgaagatgctgaggctcagattggctaggaaagctgcctaaaagctgcacaattcgtaagtggcagagttgtgtaaagctgtgtccttgattataccacacagcagggcctttctagggaggatggctggttgaatctcattcttccagtttggaaagtacctgcttgactggccagactggtgttggcttccaagaacactctctgctttcgagcacagcagaatgtcttggtcactgagcagaaccaaacgttggcagattttggagccccttgcagcatcttgtcccaggtcagtgggaagaggaggtcctgagaatggctgtacttagtgtctccctgaatctgcttcaaggtagtgagcagccctgctagaaccagaagagacaaccagccaactggtgggcaaggcatgtagagtggaagggacttagaggaaaaagctaatctctgatccaagtagttaatcagtgttttcagtgtggtgaaaggagagaaggaagagaaggtggccgagatgtgcacagatggagagaagaaaggaagggagattgcctttattcagcttctcccttgggccagacatcctgctgtgaatgagctcactgtcctttacgctagcctgtgagaggcaggggttggtatacccacttaacagatgagggggtgtaggatcacagaggttaagtggcctactcgggtcacgtacctgataaatgacagagtgaagggttaggccctttggaccacagcacccccccacccacccccatgcttctctgttcaaggactgcttctctggctcctgtcaccttagcctgggctttgcaggaacttaccaatgtgtgcatgtgtgtgtcttcaggccatgagcagaggctgaggggaatcagggctctgggtacctgtcctgctcagcaacatgggccctacctagtccagcaggacactgggctctgaccagcagtggccttatattttccccctttcttgtaccttggcatccctggtttatttttagagagctatttttatttttgctcccacttcctagctggaggcaggggttggggtgcagggaaggcattgggaatcagaagaggcagaggcaggcctaggtggcatcttagcagtgcccttggctgggctctggggactgtgctcacctgtttgccttgatgcccccctgcctcgggtcagtagcaggcccaggggatatggacagaaggacagttgcactccttgtttctttggcttctcagaaaggaatgagttctaccccagagcagaacaggaagtagcatgtggcactctttatatttttagctcactggctgtttttgaggataagaactttgagggaatatggagtactggttaagagccaggatacatgtgactaggttctggctctgctagtagctttgggcaagtcactttataccttgatggcttcctcatctgtaatgtgggggagataactatagaccctacccctcagggatgacttgaggattaaaagggctcataggtgaaaaggcactgtggcacttattaggtgttgttttattgttagcatatctcgccacctcgaaccacagggtagatgccagtaaatactggttggactgaataaaacttcaagactgttggttgccctgtttccatctgaatattggctggagtgggtgttgactccagtcagcgattgcctgcaggaccccatagagtaattcccatggcagctgcccatagtccaccccctccagcccttacctgggccttgggaagaggcagccaggtggaatgaggagtcttttagcccgaggatgtcagtagtccccgacccactttttgcttttgcacctttgtgaggctctggctttgggttgtgagcgttagaggggttggggcctgtgttccatgggtgcagacactacctggtggttctgagtgcttgagcccaaggttttgaagtacaggcttgccactggcatgtgctgtttagctagtaacagtgaaagacttctttggaaacttgtacttggggcttagaaattaatcagatctcaccagtgactggtattatgggtatttgggagaccatctttcttagggttggagctagcacttgggcacaagtgtttccatgtgtgtggtttttaatttatcttaaaatgtcttaatcatataaacagtgcttattcataagagacaattagaaaatacttacgtcatgggaatagtatggatagcttgcagtatagtcaataatgtatgacaaatttgaaagttggtaaggaagtgaatcttaaaagttctcatcaccagaggaaaaaaatatttgtaactttgtatggtgacagatggcaactagacttattgtggagattgttttgcagtggatacaaatgtcgaatcattatgttgtacacctgaaactaatgttgtatgtcagttatacttcaataaaaaaagaaaatacagggatggcttggtcggttgtgcatctgccttcagctcaggtcatgatcctgcggtcctgggatcaagccccatgttgggctctctgctcaacagagaacctgcttctcctccttctgcccccaacttgtgcttgctctctctgtcaagtaaataaaaaaaatattttttttaaaaaagaaagaaaccccaaggagacagctttaaaaaaagaaagaaaaagaaaatacagctgagcactgagaaggaactaaaagtcatacatacatagtcacaccatccgtaagtgactgctataagttttagtttagtctgtgttctttcaggttttactatgtgtgtacttatttggttttctttcaaaagtgggatattacttaacattcagttttgtgacttgccttaccctatttttcgggtggtttcttctgtctctgctttctaatctcccctaccctttgtgagtgagcaaggaaaggcatcttgcccaaagagaggaatttgggaaggagtgtatgactgttcattgctgtcattgtttaaagggtacagggcaaaaaaaaagggggggtgcctgtttctccctgcctccctccctcccccccccccgtctcctctccctccccacctctctgccttttttttttttttttttttctgtacaaaacccagaaaggataccacctccagtctgaaggtttcttttcatggcttttagggagaaacctctcatgatgccagaaaagaaggtacacaaaggagatgagaaggatcatgcttctgggctggggtggtgggtggtaggggagtcttgggaagcatgatggacagaaggacctggatccctggctcagtcctgaaacaagcagaaggaattagataataggttgggggggtcagggtaggcttcaaatggcagtggggactccttgctgagagggcaagcaggatgaccaggcaaaagcctagagaataaggagtccagatatgagtcagaaataaggagaaggaaatatgtctcaatgggacatgctcttccatctaaggcctgctcctttcatgaacttgcacctagtctgctttccccagctggcagtacccaggccaagtggtttgacaggtctggtaggcctagccctgaggacacctgtgtgctagcagctgctccatggcacctgggcggtaggcagggatctgagcatagtagtcaggcaaagggaatatgtcgtgcccagcatcatcaacagctcagattccattctagaaaaatagctcagagccagggagatggagtattctgggaggaataagctttgcctcccctttatttcttacaaagtaaaatgggatccctggcagtaggtgagccttgagggtgagtgagacttggcatcttagcttttttctagaccactctggtctacacacaggctggtgttgcgtggcgggccaggaattcatgatcatgaacagaatgatttccataagttgtgtgtgtgtccctgtgggcctgactggtccatactggtttttctgtagatcccagtcctggtgcaatctggcagatacagtctgggccacagagcagggtagcttcctgtgcgtccccttgagcttgcactactactctcccttcctccactcctgagctataattaagttcctccgtgaaaccaaatccctcagctgatacacgcctgtaactgcagtcctggtcattgggcagttcgtgtggggtgactcttggggctggtgtctcagcctccagacggtcctgggtaggtctgtgtaggaagtggaaacgcgccaggaaaggggtggatctagtgaggcagaggcaggccttgcccaagactcagaaagtgggaagttgtggagacaatgaagggctgatgtgcagacagagagggccaaggaaagcagaggtggaggagacagacaggctgccttacagggcaggagggcatgggtggggacaggctttccagtcactgagccacgaggcagaatgtgagcggtttattttatgttacattctgtgtctttctctagcattttaaaattgagacagacttcacaaaacataaaattcactactttaaagtgtacaacttcagtggtttttagtatacttaccatgtagcagcattgctaatgccaaaacattcccatcaccccccaaacaaacgctgtacctattagtagttagtcccagtaccaccctctaccccagccatcacctggctgccaccaatctgtccttctctatggatttatttatttcggacatttcatataaatggaatcatacaacgtgtggccttttgtgtctgtctgctttcactcagcataacgttgtcaaggttcatctgggtacttactaagtagcatgtaatggtactttattcctttttgtggctgaataacattttacttgatggaaaatactatgttttgtttatgcattcagcatttgggttgctttcattttttggctactgtgaacattcatttacaggcttttgtttggacataagctttaagttttttcgggaatatacctaggggtgggattgccgggtcatgtgataataactctgtttgacttctttttttttcaagattttatttatttattcatcagagacacagagagagagagagagagagaggcagagacacaggcagagggagatgcaggcttcatgcagggagccggacgtgggacccgatcccccgtcttcaggatcaggccctggactgaagatggtgctaaaccgctgagccacctgggctgcccctgtctttgacattttgaggaactaccgaagtggctgcgcagtgctctcactcacttatttatttgtttattatgtttaaagcctatatacttttcaccataaaatatacatcatttaaatttactattgggcagcctgggtggctcagtggtttagcaccgccttcggcccagggcctgatcctggagaccggggatcgggtcccacgtccagctccctgcatggagcctgcttctccctctgcctgtgtctctgcccctctctctctctccctctctctctctctctctcggtgtgtctctcatgaataaataaaatatatttttttaaataaaaaataataaaatttactattttaaccatttttaaaatggacagttcagtggcataaagtatattcacacatattgtacagccatcgccactatctccataacttttttcatcttgcaaaaatgaaactttgtaaataatgctccactctccccttggcccccatcccctggcaaccactgttctactttttgtctctatgcatctgactaccctcagtaggtcatgagtggaatcatccaatagtttttctcttgtgactggcttatctcattcatccatgttgttggttatgttaatttccatacctttcaagactgaataacattccattgtatgtagatacaggtataccttgttgtattgcacatcactttattgtgctttagatatgctgctttttttttttttttaacaaagtgaaggtttgtggcaaccttgcatagagcaaatcttggcaccatttttccaacagcatttgttcctttcatgtctttgtgtcccattgcgatattttaaactttttcatttttattatatttgttgtggtgatctatgtgatcagtgattatgacttgctgaaaacttagctgatggttaacattttttagcaataaaataattttgtaattaaggtatgtacatttttaaagacgtaatgctcttgcacacttaataggctatagtatagctgaagcataatttatttgctcttggaaaccaaaaaacactgttatgtgctttattgcagtgttctgaaactgaacctgcagtatccataaggtgtgtctgtagcacattttgtttatccatttatctgttgatgatctgttcatctgtagctttcaccttttggctatgtgaatgtgctgctataaatacggatgtaaaagtatctgttcatgtccctgctttcagtgttttaggttatatatacccagaagtagaattgctggatcatgtgctaatattatttttaattttttaaggaaccaccatactgttttccacagtggctatgctatttgatgttcccaacagtggtgtacaagagttcccatgccctcactcttgattgatagcttgattgagtgtagaatccttggaattttgaagtcactgctccatgtttcaatattacgagtaatgaagttaattggattcagggtactttgtaagtaattaatctgttttttttttttttaactctctgaaagacataaggattttctttattctttggagttcagacatatcaccaagatctagctaggtatttgtcttctttccttaattcctggaggtccctaattgctgaaatgtcctttggaaattttctactatgtttctttctatgtctctatcatcttcttttaggactgtctttttttttttttaagattttatttacccttttgacagagcacatgcacacaagcagggggagaagcaggctgtccactgagcagagagctggattcagggctccatcccaggaccctgggatcacaacttgagctgaaagcagacagctgactgagtgcccctatttctaggactcttatatggacttttggatttctgggttcattgcaagtgtgtaggagtatgattgatttttttaaaaaatgataattgacatgcaatattgtgttagtttcaagtgtacaacaaagtgatttaatacataccttataaaatagtcaccatagtaagtctagttaccatctggcaccatgcaaatattataatattattgactatattccctatgcaatacatgatacatatttgcatcttgtttattttataactggatgtttgtgcctcttttttttttttttttaaagattttatttatttattcatgatagtcacacagagagagacagagaggcagagacacaggcagagggagaagcaggctccatgcagggagcccgacatgggattcgatcccgggtctccaggatcgcgccccgggccaaaggcaggcgccaaaccgctgcaccacccagggatccctgtttgtgcctcttaatctccttcacctacttcgtctacctcccacccccgcccctctggcaatcatcagtttgttttttgtatctatgaatccctttctgttttgtttttttgtttgtttttatttgtatttttttggtgggcagcaaagtaaactattgggtgatagtacaaatctcgcaaagagggaggggaccctggagggttgccctctgttttgtttgttagactgtttgctttttagattccacgtgtaagtgaaattatatgatatctgtcttcctctgtctggcatagttcacttagcacaataccctgtaggtccattcatgttatcacacatggcaagattccattcttttttatggctgaattatactcctttgtgtggaacatttatgttgtttccaaatcttggctattgtaaataatactgcagtaaacataagggtgcatatgtcttttcaaattagtgttttcatttttatttatttgagagagagagcaagtgagagagctcaagtggcgggggggcagagaaaagagaaaagcagattcccagggagcccaagccccaagcagggcttgatcttaggaccttggatcatgacctgagccaaaagcagatgcttaaccaactgagccacccaggtgccccattttttttttttttaagtaggctccacactggatgtgaagcccagtgtagatcttgaacccacaaccctgagatcaagacctgtgctgagatcaagagttggacacttaactgactgaactaccaggtgcctcagtgttttaatattcttcagataaatacctagaggtagaattgctggatcatatagtagttttagttttaatttcttgaggaacctccatactggttttcatggtgattgcaccaatttacatttccaccgacagtgcacttgagttcccttttctccatacccttgccaacacttatttcttgtcttttcgataatagccagtttaactgttctttttttttttttttttttttcagtttaactgttctaagtgtaaggtgctatctcatagttttgatttgcatttccctaatggttaatgatgttgagtatcttttcatgtgcctgttggccgtttgtatatctttggaaaaatgtctattcaggtcttctgctcagttctttttttttaatattttatttatttatgatagacacacacagagagaggcagagacacaggcagagggagaagcaggctccatgcagaaagcccgacatgggactcgatcccgggtctccaggatcacaccccaggctgaaggtggcgctaaaccgctgggccacccgggctgcccttctgctcagtttttaatcagattggtatttgttagtttttgctattgagttgtaggagttctttaaatactttggatgttaacctcttatcagatatatcatttgtgtctatcttttcccattcagtatgttgccttttgttttattgtttcctttgctgtgcaaaagctttatagtttgaggtagtcccattgatttatttttgcttttattgtccttgcctaaggagacatccaaaaaaaagattactgagaccaatgccaaagagctttacagcctgtgttttcttctaggagttttatggtttcacatcttacgtttgaatctttaatgcgttttgactttatttctatatgtaaaaaggtagtccagtttcattcttttgcatgtttctgtctagttttcccattcccagttattgaagagatttgttcattatatattcttgcccttttttgctataaaatagttggccatataagtgtgggtttatttctgggctctctgttctattccattgatttgtgtgtctgtttctgtgccaataagtaccataccattttgattactgtagctttgtagtgtagtttgaattctgggagcatgatacctccagctttgttcttctttctcaagattgttttagctattcagggtcttttgtggtactatacacattttaggattatttgttttctgtgaaaaatgccatcaatattttgatagggattgcattgaatctgtaaagtgtttggggcagtatggacattttaacaatattaattcttccaatccatgaacaggacatatttttccatttatttgtgttgtcttcagttttttccagcaatgtcttatagttatagtacaagtttttcacttccttggctaaatttattcctaggtatttttttctttttgatataattgtaaattttcttaatttctccttctgatagttcactattagtgtatagaaatgcaacagatttctgcatattgattttgtatccagaaactttactgaattcatttattagttgcatggtgtaggctttagggttttctatgtatagtatcatgtcatttgcaaagagtgacagttttacttgttcttttccaatttggttgccttttctttttcttgcctaattgctatggctaggacttgcagtactatgttgaataagagtgggaagagtggcatccttgtcctgtttatgatcttagagaaaaagctgtcagcttttcatcattgagtatgatgttaactgtgagcttgtcatatatggtctttattatgttgagatatgtctcctctatacccaccttgttgagtttttatgatacatggatgttaaattttgttaaatgctttttctgcatctattgagttgattatgtgattttgttcttcattttgttaatgtaatatactatgttgattgacttgtgggtattgaaccatccttgcacccgtggaacaaatccgacttgatcatggtatctgatccttttaatgtattgttgcattcagtttgctaatattttattgaggatcttatgattgatttatatatatcaatcttctatcatcgaacctttctgaacttatttattagttctaatagtttttttagtggatttcttaggattttcttatgtaaatcatgtcatctgctaatagagatagttttactttttcctttccaatccagatagcttttattttttttcccctttcctaattcccttggctagaatctccagtttagtattgaatagccatggtggagatggatgtccttgtcttattcctgatctcaggaggaaagctttcagtttctggagctgtttatttttgaataggtaattattgacatcctacaaaattcataaggtatttcctgtccctcttctgtctctcagctgcccagtaccccctcatggaggcagccctcttggttgcttcatttatgaccatgtacctatatattttttagtattacattatttccaggcaaatggctgttgtgttcactagtctgcctcttgcttcatgtattgtatgttgtccctcctggcaaaccagtatactgtggagcttcctcattcttgttcactgctccctcatttgttgtatggatgtgccattctctattcatggaagcacaggtgatttccagtcttctgcagtgaataaccttgccatatgtcattttgcacacacataaacaaacagattgataatacagtgtgacagatgcaaagatggagacatgtgcccagaacagtgtggtaggagagggaaaggcttctggaagaggctggttgatggcgctttaagaaagcttcaggtgagcactggcatatgaggtggtccttgcaggctggaaagaattgtagtaggctgagatgtgggaagggcaagtgtgcctaaaggagcaacagctcagatatgttcaggaaaatcaagagtattagttatctgttgtctcataacaaattttttttttaaagattttatttattcatgagagacacagagagagagacagagannnnnnnnnnnnnnnnnncagcaggtagtctgcttgtgcctctgcatctgctagcccttcctatggagtaaattctggccgattgtctctctggagaataaatggataagctcctactacaacatgtagagagttccagagattcgcggatgtgtttcgaatcgagcgctgtgcatggagcacggttctccctctgcactgtgtctctgcctctctctctctctctctcggtgactatcataaataaattaaaaaatttaaaaaaaaacaaaaacaaaaaacaaattaccctgaaacatagtagcttaaaacgatatttgtgatcttgcaggttttgtgggtcaggaggaaggtattattgtgagccattttagaaggttgtagtgatgatgggattggctggagcaggccagcatgacagtatggcagccattattgtagataatctgacacagttggttgagaagccaagattgagattgatgtaagaacagcgggaaccagtggaaggcccttgagtgagagaataatgtggtagctgtcatctgggacaatgaatatgctagcattatactagaggggtcaaaatggagagagatacacagcaagagaattagatgaggagatgtctgtattaacttaggtgaaaagctggtctgtagttacagttgctttgcattgagcaccttctctgtactatgtattttggctctagtttttcttatctttgaaataaccacaaatttagttcgcagctgaggagactaagcctcaaagtgataagctgtgtgtggtccacagctagtaagttgctgagcagtgcttagatctccctggccttcaagactgccttttgggggtcatgggaatgtcttggctgttcctggatgctgaagagagacagaggcatctgagaggggatgctagtgtggtgggggaaggtgagtcatccttggaacttgggcacttgttggcagggtcctttcccaattggagggggattgtaaatagttcctgtactttgtgtatgaagaggcacccttggccaaaaagagctccaagagtgggagcttattgatgaaagggtacttactgtagggatgttgtttatttgaacactaggtttacacattctctcagcagcctatacgctctgtggtggggcctctgccaaagtctgctggtcaaagcagtcattggccagctcagattcaagaagggaactagactccacatcttgatgggaggaatagcaaaaggatcatagccatctttaatccacagatagctagtattggagaacagggatttgaactcaaatctgtgtgactcggacccagagctctttctgccataccacaccatgtctctttctgcttctgattccttgggggctgcaaagcttactaattggtgtttgtgttgttggagggcaatgattcttttagtttcccagggaagatgttgcactgtttacccctttttcccaggtgagcatccacgatccaccggcctgagtgaatcttctaaaataggctttttcatagagatttgctagctgcctccctaggctccagcactcattgctagacatgtatggaatttccccatggagtttacctttctgcacttagtagccttttgatccccagcgctagccctgtaggatccttgtggctttgccgccagatgtgcaggctggccttgttgctagttgtcgcagatagtatctagtccagtgattcccaggcatggctcagctggcatattcgccagggaattttgggaaaagaaatgtagattcctgggccttgcttcaggcctcttgaattagaattccaggaatgatgtccagaaatctccatttttaaagctccccgttgtcttgaggctgcaagcctgattgggggaaccactgacttctcagaaaagtgcccttgaggtctctgatcagaggagtcagtggggcctgacagcgattgtcctgggggcctcatgcttcacaaccaggaaatgactcccaaacatgtccaggagatttctgactgcatctgctcaaatctttcatatttatttgcatttgttgatagtatctgaactttatggtgacaactggttttctcattttttctctctttcgagaggtggggggtggagaggggcagagggaaagagagagggggataaacagattccacacccagcatggagccaggtgcaggactctgtcccaggaccccgagatcataacctgagccaaaaacaaggttgtatgcttaaccgacttgagcaacctaggcacctccctggttttcttttaaagcatttgcagtgggaaataagctctgccagcagttggcaacccttcttaactggtacctatttggtctgatttatctggaatacaaaatttgtttgcttagctctctggttatctttggtgtaaagactgtgactgaccatcctcgatacatccaagtggagacaatagtcagacctttctagttctgtgtcttggatctacgtaaggtcctcttgtagcctttaaaaccctagctgattggtcagttaaacaactaacatcattttagaatatttggaaaatacagagaaatataaagaagaaaataaaagctaccttagaatcttcctcccaggaaactacccggttaatattttgatggatattcattcatttgtaactctctctctctctctctctctctcatgctctcacgctctcacgttcacatacaccttcctataccctatttttgaaagccacattaaagtcatattgtgggggatccctgggtggctcagcggtttcgtgcctgcctttggcccagggcgcgatcctggagtcccaggatggaatcctgcatcgggctcccggcatggagcctgcttctccctctgcctgtgtctctgcctctctctctctctctctctctctatgtctatcataaataaataaaaataaatcttttaaaaaaaaagtcaaaaaataaaaaaataaaaaaaataaaaaaataaaaaaaagtcatattgtgatactattatttagcaggtgtgctgagatataattgagataccataaagttcactagtttttttttttttttttttttttttaaagcttttatttattcatgagagacacagagagagagaggcagggacacaggcagagggagaagcaggctctctgcagggagcccaatgcaggactccatcctgggactccaggaccacaccctgggccgaaggcaggcaccaaaccactgagccactcaggtgtccccaagttcactagtttaaatgtataatttcatggttttgagtatatttgcagagttgtgaaaactttggtataatttaattttagaaccttttcatcatcccagaaggcattcttttatccattagcattcattccccattatctcctcccctgcccccagcctgaggcaaccattcatctactttctgtttccacagatttgccttctctggacatttcatagaaatgaggttatataatatgtggtcttttgtgatttttctctttcacggaacataattgtgatactgttttttgttttgttttgttttgtttaagattttatccaattattcatgagaaacacagagaaagaggcagagacacaagcagagggagaagcaggctctacgcagggagcccaatgtgggactggatcccaggactccaggatcatgccctaggccgaaggcagacgccaaaccgctgagccacccagggatcccctgtgatactgttttttaacctacattaaacatttatatcactagtaatttgaacacagttttcaagaatttatttttaacaaagcagagcagtattcatcttatgagggtatctgaacttaattatttaaccggtcctcctgatggttatttatcatcttatgctgttatatctaatgcttcctgtactcagaaatcatcttgtttgttaatttattgcttaactgttggggcgcctgagaggctcagttggttgagtatctgactcttgttttctgcttgggtcatgatcttggggtcatgggattgagccacagcagggagtctgcttgagactcttctcccttccctatctccccactctgctcctcccctcacttgcacacacatgctctctttctctaaaataaataaatagataaatctttaatttttttttttttttttttttttattgcttaactgtctgaattcctgactagaacagaagtcctttgagggcctctactttgtcttgtgaacattgtttccccactactcggcatccttcctggctacttggtaggtattcggttttaagagtgtatgtgtgtttatatagttttgaatgaaccaaaatgttaagactcttggtaaactttaccaaactgccacattccagagagttatactaatttaccctctctctgcagtctatgagagttcttgactttataaagttaatttttaaaggaagctctgtgatcttttgtaatacagcactctctgacctgtgaaccagttagttgcagagtccgtgctcacatgcccccttctgtaggccatagaagtcctgtctgttgggtaaggtggtggctctgacctcctgggtactcagggactgtgagactgcactattccctgttgcccttagagaggccataaggcattttctggccacttcccttgtcgcgggtagacttgttggggtgtgagcagagttgtgtgtgtatacacacacacacacacacacatatacaagtatgtataggatgttggttctggctgctgatcgaaaggcctttcaaagtctttaggagaactgtcactctgtaagttgtgtcttcaaaaatagaactgaggaaaggaagtgtgacatagtcagcccagtctgccccctctgaggctggtgggcactgagagggctggcaaacatggcctgagtcacccgctggtagcagtccctgctctccacacagctcctgtctgggagagcctgctatctgccctccccaccgagggctgccaggggtgcaggcgggtcttcccaggccagggcggcagcctctgactcaggggttcacagcccccctatttttcacagatgagctgtggcatctgtgtatcttctgtggagaagcatatggaacatacatggggtttgaaagcagagcccaatggccagggttgtgcttgtgtgtggcagagagtgcatgtgaccttgtgtgggagtcacttggagccctagaaattcaccttctccagggcaactggctgctcatccttttagtcatcccccacagctttcatctccatagtccatgtacaatgtgcactaagccttcttccactcgcctgtatctctctcctgggatgctgccccttggaaccacggacatcacaagctctacagatgccataacttcttttctttgcgtctctgaaatctcttctacttggtttctcactcagttgttcactgtttgattcttactttagccctctctatgcccactgccatagtagcctgcagctgcagaaacacgaagcagaaagagattggccctgcccgctccaaggtgaactggctcatcttgcttggcctgggtttccttcctccctgtgcctttgctgcccttcttcctcttctgctctcctctgcttccacacagtgtgctttgacttctgccctttctctgctcctctcacagcttcttcccttataggcacaaatactgaacgacttgccacagatcctcttctgctgagtgccagacccacatgtccgcctggctcctggaatgctcagttttcaaggcagagctcgcccttctccccttttcccacgcctctgttcctattcataatacgccattcagttagttcctgggagccgcgggacagcttgaacccttctttcctctccatccagaggttttccctccctcattctctccatatatgtctccattcttctgattccacctctaatgggttggatagtggctgcccaagcgataggtccacgtcctaatctctagaacctgtggatgtgatcttatttggaaaaaggctctttataggattcttgcctacactgcggctgtgtacaaacctgtggtcattgacctcctctctaggccttcctttggcctgaaacagggtcagtgttcccatgttcactactgcatttggtcttcttaagtccacaggcagggttctctgccttcctcttccccctcacttctaggtctagagatgttcaaggctatttgtaccgcagctacaaattcagcccttggaggtaggtctgggttcgaatcctggttctctcactcattagctgagggcctttgacagattatgaacccttctgagctttggtttcctcttctggaaaatgggattgatggattgttgtgtggattagattatgtagtattgtctatcattgtgcctgacactgtttgctttataattggagagattcactcaacctccacagggagcactcaagctgggacaagcccaggagctctgactcaaatccagctcctccctctgtcatcctgctacagctgtgtactgtgtttggtgctcgtcatggcagggagctatgatgacatgatcgtccaggagggtaagcagagcatgtagtatgtgacatggtatgacaaagcagttaaaatgtgggctctggaggggtgcctgggtggctcagttggttgagcttccgactcttggtttcagctcaggtcatgatctcggggtcacgggatcgagccccatgtagagcctgcttgaggttctctctcctcctctctccccctctgccccctccctactcatgcacgcgtgctctctctttctctcaaataaatacataaaatcttaaaaaaaaaaaaaaaaaaaaaaaagaatgtaggctcttgagattgacctgggttcaactggccctgtgactgtacctcagtgaccttgggaaagtttcctttgcctttttaagcctcggtttcctcttctgtgaactgggaggcacaccttagaaggtaattgagaggattaaatgaaagaatgctcataaaacattcagcacgtgcctgcctctttgtaagcacttaataaacattgttagaaatgaccagcttccactgtggaaagcagtaagtgcattgaaggcctgagttgggaggcacacttgcagaaattctggtgcccctggaatgatataacagggggacatagggatccctgggtggcgcagcggtttggcgcctgcctttggcccagggcgcgatcctgaagacccaggatcgaatcccacgtcgggctcccggtgcatggagcctgcttctccctctgcctgtgtctctgcctctctctctctctctgtgactatcataaataaataaaaattaaaaaaaaaaaaaaaacagggggacatagagaaaaaaatttccaatgtcacctcttccatgaattcatgactcttcccctgaactgcacagggggacttgtcattcttcaaagccagagctcttggcatttctcttacgggagttgttatggtctttcttgtattatggctatcctttataccaccacacaccccctgggaatgggattgggcactaggtagttatttgatactggaattgaaccttggaattcagcagtggaagtagtcaacctactggtaacaaaccatagggatcctctggctcctgacccccacttctagcaagtctttttctcatggctgtgagatgcagggttccttcttccaaagatctttctactctgcacttgggacttgtgtctccagaagccctgggtaccaccactcttggagtctgtcactgcctctctttccattcaacagaggcattgtttggatgggccaggtatcaaaaggagatgcaggttactgccaaggtcattgtaagtctcaggactggtacttggggtttggttgttttttggatttttttttttttaagattccatttatttactcagagagaggggcagagacataggaagagggagaagcaggcttcctgcagggagccccatgtgggattcatcccaggaccccgagatcatgccctgagccaaaggcagatgctcaactgagctacccagatgcccctggatttctttctcttttttttttttttttttttttaagattttatttatttattcatgagagccacagagcgagaggcagagacagaggcagagagaagcaggccccaagcagggagcccgacatgggaccccaggatcacaccctgggccgaaagcaggagctaaaccgctgagccacccagggatccctcctggatttcttttttaagaaagaaacaagaattatgtacattcttcttcttcttgtttgttttttgagggttttttatttgtttgcttttttgttttttgagagggagggagtggggagaggcagagagagggagagaagccgactccatgccaagtgcagagcctgatgcaaggctagatctcacaactctgagatcatgacctgagctgaaatcaggagttggatgcctaaccaactgagccaaccaagtgccccaggaattatgtacattcttcatactgagtgttaagaatcttctctggaaaacttcagtttgtgactgtatctgtaactgttcatgggacattgtcaccggggagcctctaaagttcctgaaactcaacatgccccaaaatgacccctatattttttgtcagacctcctcttcccagagtccctgccttattgggagtgtccccattcctctggtcacctgatgatggcccttcattttttttcctccttccaatgcctcttttattcagtcaccaagtcttgttaattcttccttctaaatttcttttctgctttttgccttaaagtcagatgatgctagcgctacctcagtgtggggctgttatttgcattgaattttcaacctctgtgtcttcatgttcaggagttttctttcataaatagaatatggctgcatttaaatttctttttttttattttaaagattttatttatttattcatagagacagagagagagggagaggcagagacacaggcatagggagaagcaggcatcatacagagagcctgatgtgggacttgatcccgggtctccaggatcacaccttgggctgcaggcggcgctaaactgctgcgccaccagggctgccctgcatttaaatttctaagtcaaatctgaaaatctgtcttaaatcagtataatttatttacatttttggtatttgacttatatatatcatgtttttgcatactttccatataccttccttttttgccaatttttctcctttcctgccctctgttacattgcttgagttttctttattcactttactggtttgaaaattagacatcttggggtgcctgactgatttagttggaagaacatgcggctcttgaagtccaggatacttaacatcttattgtttatttatttatttatttttaagattttatttattattttagagcgagcacatgtaagcataggagagggggcagagggagaaagagaagcgtactcctgctgctcagacaccctgactggacccagggctcaatcccaggaccctgagatcatgacctgagctgaaggttgatgcttaactgagtcacccaggcaccccttaacatctttcatttaattctgttttaaattctgggaaattctcagcacccggctggctcagtcagtagagcatataactcttgagatcttagggtcatgaattcaagccccacattgggtgtggaacctacttaaaattaaaaaaataaataaaaataagataaattctaggaaattctcagtcatttagctcttttgttctctcattttctctatgctggccttctagaattcctcttagatatatgttgggtgttctaccatccaagcctctgtatctgtttttttctttgctgtttatctcttcagtgatctaaatgttcttgtttcttagtcttagattattatttctgattttggggatgatactcttttttggggggggtggggggtctgttcctgttagtggagtatttccttgtgtggtttataactttggttcatgagctcatctttagaaaggactattttatgggtaaatgttgtgtcttaggtggtgaaaggaaagtatccctaagagcaatttgcttctggtggggccattggtgttgtggtagtcttggatcagttttcatgttcatttcttagtttggtacctcttcaccattctgttagtggtcagatcagtcatttccatgggtggggctaacttagtagtttagcttattagaggtgatctcctaccctccatcaggcctcagagaagttgccagcttcttgtcgctttcctaaaccaggcagccctctgaagctcttgtcttggtattggggctcaaagccatagccagccattagaaccacttcagatgtgggttcagaagtccatgggtcattgtggtgtcagttccacttaccattcatgtttccgtttttcttgtcatttctggcacatggggtatctctctctctttcaaatttggctgtatgtttaaggatatgtattgttttatctaatatttctgtgtaactgtagtggaaaggggaagctctcataataattcattattcgctgcactgctgaaagttcaagtccacattcttagcattgtgtatgaaacccttcatgatatccagtctctacctgtcctgtgtaaactcaactctttaatttgtgtttttgcttttgtttgtttttggagagagagtgcgcgcacacatgtagagggaggggcagagaatcttaagcagtcttcacgatgtggggctcaatctcacaacccttagatcagacctgagccaaagtcaagagtcagacacccaggcgtctctgcataaatttagctcttaaattttgtatttcagcaagttgaactctttgcatactatataatgtaacatttgaaagcttaagttttaaagctcaactatttgttttgcaacctgtcttcatccttttgtaaatgtgattttggtcaagttacttaccctctctgtgcctcaagttttctcatctaaaatggcagtatctggcatatagtaagctaatccctattaactcccaccatggttgtgctctccagtaggccacactctcagacttctgcacttttgcacatgcttgttcctcccaaggagtgcatgtctcccctcaacttccttccttgatcccccttgacagagtggccattggtctttctgtgcttggggtctctttctatagtaattatcactctgtaagtggctgcttgtttatgtgtctctgtaccagtctctgagccccttgggaacagggtcttgtttttcctggtgcgtgaagctcctgttcagtattgcctgtggagttgaactgcattaaatttctctggttgaatagaagaaactggatgtggcaggagacacaaatgcagagagagaatgagcaggagagcaggacgttggtctttctggcacgttttatgccaggttgccagaagtgtggtggggacacaaagtagtagtgtcagtctagctgatggtgccagaaacttaaagcaagacagcagccagaaaaagccacaaaatcatgcaaaataaagtggtttccggccttgaggatacatgcccatgttccatccgcaaacttggctcctctgggtgccaggcagagtagcacaaacttataatccttagtggaccctaagaatctttaactttagaaaattttttttaaatttttatttatttatgatagtcacacagagagagagagagaggcagagacacaggcagagggagaagcaggctccatacactgggagcccgatgtggcattcgatcccgggtctccaggattgcgccctgggccaaaggcaggcgccaaaccgctgcgccacccagggatccctgaatctttaactttagaataaggctgcacctctgaaagggtcagttgctttaggaatggatttttctgtgctggggactccaaggagaccacagatgtgatagctctggtgttcagagttacgtgtcacctatgcccatggtttacacccagttaagatttctaccccttagaaagggtgttaaataggcctggggcagagctaaaccaggcctgtgctggctctctttagctttgcctgaattctcaggactcctggactccaaaacaggaatagcttcagaagagaagggaacttggtctttgaagatccctggagggtgtctgacagacagtagtctggtgggaatggtgaaccgtgacaacactgactctcagtccccttggctggggtttcaggaatcaacctcaactctggtaggcacagggctaggggttggtggacggtgtggccaatacccacaattcccttagttcttttctgatgactctttgtagctgtggatcaagcatttatgtgctcactactatgctaggccctcttgctgaagacactgaaacagtgaaacacagcccctctcttgagagactagttggagaaaatttctaacacacaggaagctgcagccagctgtgaaagaccaattcccagtaatgctctctatgcaaatctgtctctcacaacagcttggttctttttttttttttttttttttagattttatttattcataagagacacagagagagagaggcagagacacaggcagagggggacgcaggctccatgcacaaagcccgacgcaggactcaatcctaggaccccaggatcacgccctgggcggaaggcagacactcaactgctgagccacccagacgtctctgacagcctggttcttttgttcaaaaggagctattctccttaagagttttggaccagcagtttacttttttcttgggtgatctgctagcaccattacaaagtgatctgaggtcatgagggccactttttatatttctgaggaatggcccaaatgtgtttttatgaacttttccttccttctgtttctttaaataatgacaggttagtttaacagtggcacttgttggtttcctggggcagatcaccaaccaacatttgctgcttttgaggcatcaggttttttcctgtggactctcagattgtttctttgttttttatagactgactctatttttctagggtagtacatcccaaagtgattgctgaatcgggatctctgggagtgggccttggaatctgttattgagaattagaggaaaattgagcaagttgagatctaaaaccattacaagtggatttatggatagggattccaagtaagttagacgatctcaggtagttgtggaagctccactaggttataaaggacccaagctccctccagttccttgctgtgtcattcttagggtgtggctgttctcatttgtacaacatggctgccatggattgagctatcacatctgcattccaggcagtaaggcacagaaagaaagagggaaggatgatatctccctccctcgctccctcccttttaaggctacttcaggaaagtcttctgcctctaccactttttgtgactgaggggaaattatttaatatctcagagccacagttacttcatttgtaaaatgggtgtgatagcacttacctcagggggatgaggactagagaggatcatccagtgtctggcataatgcctgggccacagagagtgctctctaaatggtgactgctgcttcacgtcttgacaccatcaccttccccttccctccatgggaaggcctttactgtcctttactattctctgacacactttgccctctgttccccttgtctgccccccacatccctctcttctctgcccctcacgtgcctgccctctctccctactctcccaccttgtacaacctcatccttgtattgtttccgtccctctgtcttcctgatgtcctggattaatggcaaatcattgttgtatgcaaggaccagagaggtcagagttggtgactggcctttgaactgcaagtcagcaacgagtaagttagcatgtttaattggctcattcatgaatcaattaattgcatctggcagctggtaagcagagatcagaaggagcagtggcttaaaacagtacaagtttattctctgttaggtttttaaaagaaatctggggaaggcagcctagggccaacttctctgttctgtcattcttcctgtggggcttccaagcccagggctgtgtcatggtggctgcgggagctccagccatcaagacaggtttccaggaagcgccaggcaggggagtgggtgggtaggggggtgggggggcctgggcagacagaaaagacctacaccaagctgtctttctccctcttcaggagctttcttggaagtcccacccagtagcttccactgtcccctcctgtagctacaggtgaggctgagaagtctttcaactggacatgttaccacctgaaataaaattgggactctataactagggtggaaggggaagagtagatactgggttaacaacttgtatggaaggtctgccacaattcattcagtatgaatttagcacctgtggtctgctggttattagaccagcaagggagtccccattccagaagggaggcatggatacataaaggagtacagcaccgagtgagggtgatagaaaaaggggggtggagtggaagaaggcacgagaaagcgcactctccaacctcacacacatcagggccatccaggcaatctcctgagtttgtcacaccaacattattctctgctgctccgttcttctctgtcctctctgttctctctcccttgtactgccatcatcatcattgctaggtttattttgccccttcattctggccccagcaatagcccctaggacccaaggaagtagaaacctctgggctgaggccacatgtctggagatcctcaggccctggggcaattagaggttagtggcaggaacatatcctactctggtacaagctgtggcactgccaggagacatcgctccaggaacagggtcgtcatcaggaggagtgttccttaccaggcacctggcttcggctaggtgtgaatattttatctgtattaagtaatcaggagtccctttgacctgtggtctctttgatttttgatctcagaaacaccacttgccctccctcctcctctagcccttgcccaattccctgtgggatgtcaaggaggcaacaggaagcttgttgcaaagattatttttaaaggtgtatcgtggccttcaaggatgtaatctgtcaggaaacactaatgggttaaaaggttgtcatttatgatcctgtacactcatcttatgagcttggctgtgaccctgggtgagtgacttaaccctctgtccttggtttcctcatctgccaaattgtaatcctggttgttacagagattaggaggcacatggaaagcacccggtacatgccagttcttaggactgctcttacccactgtggttggagcaatagattggggccagagtgtgggaggccttggatgccacacgaagtagttggattctgttctttcagcacagcaagctgcaggagatttgtgggcagggttgtgacaaatcatgtctgggcttaagaaatatcaccagcgagagaagggaggctggactggagcaggggagtgcctagaagcagttccagtgggggtgcacagggccgggcctgagctcgcaaagttggggcgtggggacaacagatggttaaaaagtcaggagtgagggaggacctgatagtatttcagcccgtgtggcacagggaatggcatcccaccaacagctaccagaagcatcagaggagttgcaggtagaggtggcaggagaggaaactgagtacctgccatctgctgggcatgaggggcagcgctgcctggggcctgacatgaggatcactgggtttgggaggcgtgatggagctctgcatggcgtttaggcagtcagtaggtgagaagcctgggacagagatacgggatgtggtcacagtgtgtgaaaacagcagtgatggtttgtgctacgagtagaggagccagccagggatgaaaccagggaggagtgtgtgcgagggagagttatcgttttaaaggctggtgaaggaagaacaagcagcagagtggacagtccctaggaaggctggagagaggggggcagagcccaaatcaagaagggcctcatatggcacagccagaagcttgggtgtgttcttggaggagcagaaagtttttgaggagttctaagcacagaagtagatatgattcaatttgtgatttcagcggtcattctggctgcagcccagggacggggggcaaagaatggaggcaggggaccctcttagacattgttgaagtaattcagctgaggtgaaccagggaggtgtttggcacttggatgaatagtacgtggttcattgggtacttgggactgtttggatcttggggtctcattagggggtaaggggatggcttcaaggagtctaacttcaaggtcaaccaaagagcccatccaaatataaaccaggatggtgagaacagaatctacctcactgctaacttggcagctggaattggttggttgaccctgaaggtggtcctgtaactcctcaaggtcaagggtgaggcttcaacatggcagtcctacagatgagagaggagaaacagagatagacgtggccttgcagaaacgttgctgtactgtttctccccacacccactgggaagccctgcctgtgccttgtggagcactcagagcttcgaagttcagcaggcccctgggagctggggtccttctgcccttctcccttgggtggcttctcccaaccattagatgtccatgattgtcaggaagtggggaagccaggccccgcccagccccacatcaatttgagctaaggggcagggtgggtgacatttggccccttgtggccccagaccccttgatacctctggccctaggctctcagctcccagctcttggctgctaagcaaaaggtacaattgcatcagatgttgctctttacaaggccccaggggttgctctaagtgagctcacaggctgttgtcatctctctgacttgtgccagattccgtctccaggtctgttgcagggtctgcctggctgctggggcctgagtccaggtgtctggaggctgccctcagtttatcctaagggtgaattttagtcattttaccttatttttatgttaaaatgcctattaacataaaaatactccctggactgatgagacagttctatggccaaaaggcgactgactggaggcctgcagccccactccccaggggtcctggtgcgggtgatcagtttcctgtgtgttcttcaaaactccccccttccccagactcaagtgtgaatgtacgtttccttttcctcctcctatgccctgtggcagcagggagcacactaaattgtttggacacctagctcttcacttaagtatatgtttgaaatctttccacattagcacacacagatcttctgcattcttcttcttcttcttttttttaatcttttttgttgtgcatatgatgcatgtatagtttagccaataattttccagcaaacactcatataactagacattacagtgcctttgatttgtcaagtgaacgaactgtggcttataaaacatcctcaccattgttccctggtattaacctcctagccctatgaggaagacaggccagaagaaattttttgcagctcaggatattctgtgaacagtgaggagatgagaagttgactctcatttcatgaagagtaaaacagcatctttcctttgagagactccgattgtttggggaacaagattaaaaggcatacacacatctacctagaaaggatgtatgaagtagcgtctgtggaatgaatgcagcgggataggatgctgtggggccagcttccccaaggggcatggaacttgagccacacctctctaataaaagagggggggtgggatgagactgataaaaaggagggcatttcaggcaggacagtgcaggagcagaggtgggcagagatgcaaacagggccaggactcagggccccaggcactctggcttccccctctagcctggtctcctcattcagttagcagacgttcacatgcctgctccatgctcgggccttttgggatccagagagtagcaggaacaactccatgggctttcagacaggagacactgtgtgcatgacaggcaaaactagttgatgttggtagagatagacactggtggttacctcttattggtagagcactgagtgggaaggggcatgaagaaccttctggggtgctggaaacctttgatatcttgagtggggtgatgatgctgtggtagtatgtaaatagataagacttgatggagctacacactgaaggttaatgcagaccgtaccctgtaaccgtgggtatgttatactcctcttataaagcaaggacacaggcaaataaataaatagcacatccccagaataaatcaatgagtaaaatgcagtagcaaagtgtggcaaagggctgtgcttgaggaaatatagggactttaggaacatgttgcaggaggcttatctgaggaagtgttctatttgctgagatttaaaggatgaggaggtgttagattaagaagggggtgaagtgtcccaggtggaaggaacagcctgtgtggagggccagaggcagagagcctgatgtgctggaaagttccaggtgaacatagtgtagcgtttggaagggatttgagatgagatttcagaacctctccctctatcactgtgttgttccagaaggcccctggtgagagtctcagcctctctctggtcttacaggctttggaaccaaagcaccattcggattctgcccttctcctcacctcagaactaaatcccacttagtaagtaggaagttcaggctggctgtatcggggctccttagctgtccatgggagaggtggactccccagccagggaagctctccattcccagacgtgctctgttttcagctgccttgcatggcacaccttggccttccctgggagtgcctttcccaactttctggctctgttagaagaagggctataacaactactcccaaactatccctgcttttcccgagccggaaatatttcttcctcgaagtgtccacctcccatcacacaactctgtgtgctcactgtcttcacgggcagtttctgacttactccttttggcatctctctctataggagtgtaggtcagtgctagtgcacatagttcccaaatcagtcccataaattattttttaactgaagggcttttggctagaggtgagtggaagtttacaatgggggtcagagcgaaggttgcctgggaagatgttaagactctggtacttccaaattcccaggcagctactacgtattcaggacttgagaacaagaaattgaacttccggggaattcctcaaatcacaggctactctttatctttcataacacttcatttaaagctttgtattaaaaaaaaaaaaaaaaaaaagctttgtattattttttagaattttattaagtttttcattttaattccagtatagctaacatacagtgttatattagtttcaggtatacaatacaatcattcagcaaccctatactttgtgctcatcatgataagtgcactgtttaatccccttcacttatttcacccatccccccctctggtaaccaccagattattctctagagttaagaatctgtttcataaaaaaaaaaaaaaaaaaaaaaaaagaatctgtttcatggtttgcctttctctcttttttccccatttgttcttttgttttgtttcttaaattccacacatgaatgagatcatatggtacttgtctttctctgatttatttcacttagcattatattctttagctccatccatgttgcaaatggtaggaggacattcttttttatggctgaataatattccattgtgtatatataccacatctcttttatccattcatcagtcagtggacacgggctgcttccataacttggctattgtagataatgctgctataaacatatggtgtatatatccttttgaattaccatttttgtattctttggataaatacccggttgtagaattactggattgtagggtagttctatttttaactctgaggaacctccatttcatgctggtttccactgtggctgcaccagctaacattctctccagcagtgcaagaggattcccttttctccatatcctcaccaacacttactgtttcttgcatttatgagggtttctttttttttaagatttatttatttatttatttatttatttatttatttatttatttatttatttatttatgatagagagagagaggcagagacacaggcagagggaaaagcaggctccatgcagggagcctgacttgggactcaatcccaggtctccaggatcacgccctgggctgatggcagcgccaaaccgctgagccacccagactgcccctgcatttatgagtttttaaataagaatgagagaccataataaactgaattatttttctgtggcaaaagtttcagaggtttttttgtaaaagaagaaaaaagatatagtaaatgcatgatttattattattattaggaacactgtattgtgacaaaattatatattttattaacatgtaaaaatgatctctacctgatgcagatatttgataatagaaaatgttaaaggatgaaaacagtaacacagaatgaatgccaaatagaaatcattgaatgatttaaggataataccacagttaatgttttaaaaattaaatatttaataactatttaatattcttaaataactatacatttttatatttatatttccagacactaaaattcccctgttttggtgtgcagttctgtgagttttggcaaatttatagtcataaaccaccactacgatccagataaagaactgtgctatcatcccccaaaacaatgccattcccttgggctactcctttgtagtcagacctccccatatcaattaacctcgctgtacctatcctttcctgtagttctgcctcttgcagaatgtcatatgaatggaatcataatgtacgtagaacttttaaatctctcattgagcataatgttttgaaatttatctgtttttattgcatgggtttgttcctttttattgattagttgtccattgttttggtttcttaaagatttatttatttattcatgagagacacaacacagagaggcagagacaccagcagaggtagaggcaggctcccagtaaggagcctgatatgggactctatcctggaccctaggatcacgccctgagccaaaggcagatgctcaaccactgagccacccaggcgtcctgaatagtggtccattgtagggatggaccacagtttgcttatccattcttcagttgaggaatgtttgggttgttttcagttcctgacaattttgagttaagcatttatatgttgctttgaacaaagattttcatttcacttaggtaaatacctaggagtggattgctggatctatggtaagaatatgtttaactgccaatttcctttccaaagtggctgtgccattttgaatcccttgccaataatgagagtttcagtttctctacaacctttattgtcactttttgtttcattttggccattctaataggtatgtaatggtatctcactagttttaatttgcttttccctaatgactaaggatgttgagcatcttttgtgtgtgctcatttgtcatctgttctgtcttctttggtgaagtatctgttcaatattttgcccatttcttaattgaggttttttctttttaattttttaaaagatttcatttttaagtaatccctacacccaatgtggggctcgaactcacaaccctgagatcaagagtcatgctctccacagactgagccagccaggtgccctgagatatttgtttacttattgctgagtttggggagtctttaatatattttgggtagggatccctgggtggcgcagcagtttagcgcctgcctttggcccagggcgcgatcctggagacccgtgatcgagtcccacgtcgggctcccggtgcatggaggagcctgcttctccctctgctagtgtctctgcctctctctctcactctgtgcctatcataaaaaaattaaaaaaaaaaaatatatatatatagggtataagtcctttgtgagatatgtgatttgcaaatattttctctcagttagtggccatcttgtcattctctcactggtgtctttcaaagagcataggttcttaattttatttatttaattttattttaagattttatttatttactcattagagatagagagagagggagaggcagagggagaagcaggcttcatgcagggagcatgatgtgggacttgatcccgggtctccaggatcatgacctgagccgaaggcagacactcaacctctgagccaccgaggcgtcccggttcttaattttaatgaagtccagtttatcagtttgtttaatgagttgttcttttgaagtcctacctaaggactttttgcctaaccaaaggtcacaaagatttttctcctgtattttcttctatagttgatagctttttattttacatttagatttaggattcatttctagttaagttttatgagagttatgtaaagtgtaggtcatgagcatgcacttgagcggggaggggagtgagcagagggagagggagacaagcaacaagcactccatattgagcggtgagcttgacaaggggctctatccaaggaccctgagatcatgacctgaattgaaatcaagagtcagacactcaaccgaccgagccacctaagcactctgccagtgaacattattgagtagtatttgaaaaacctaacaggtggatgaaattaagaacactacacaaaatcatgtgtcaaaattgccaatttagggacttatttagctatccaaacttatttcttagaatagtacttgtaggatttgtgcatagtatgtatataaatatataaatacatatttgcaagaatgactcacccttagtgacaaacaggttaatgtaacacacacttagggcatggcagtggctataagcaagacttgattagattttgactgctctccttcacacgcctgtcttggttctgagatgccagccttaaccttcaattctgtgtgttagcttcttgctcttgctttgacttgaagtcagtggattccttcgaaccaataacatccctagattgattgttaagctttaattctcaccagaggattatcatactttttcccattttcccaacttctcgattggtgtttcccgggtttggggattaaataaaacagataaatttcccaagagatgttgggaaggaagtcttgtattgctgtacagtcaagagatatcacaaggcagggaggacctaggtggctcagtcagttaagcatccaacttttgatctcagggttgtgagttcaagccccgcactaggctacacgctgggtgtagagcctactttaaaagagagagagagagagagagagaaagatcataaggcaagactgctattgtgccaactaccatagggttccctggcaggtaagctccacagggcagccactgagtctcatccattacaatgtctctggggcccggcttggtgccttacccaaggtgggtgcatgacccatgaagagtactccatgaaagttgttgcctcaacaaacgagtttccaactaatggctgtttggaagcagtgtgtaaacagctgtggctgatgaaggtggttcaggttgtagagttttatggaaagatgcacttagaaaactgagatccctcttgtgccaagcttgagtgacaaacagagaagctttttatattctggacactggatagagaagcaaacatgatgcagctgagtctttgttgagagctacggagtgagctgaaagagaatagcccttttcctctcttttttgtttaataaaaggcccaagctataggcaagttgaaagaatagtgtggtgaacatctgtatttccttcactaagattcaccagttgctaacagttgacagtgtgtcatcgattgtccacattccatctttgttccatcatttccttgtcattagattctggttatcatttttttggtgggaatccgcataggtaacaaatgctccctgttgctccacatcgggaagcataatggtcccagctggccgcagtaaaggtgatgataactttaatcacctgtttaaactggtgtctgggaaggctactttggtttaaaggcagagaactttggaaggaacctttcgctgatttgtttctctgtcagttgtacttgctattgagaagcatcttggtgtagtcgagaaggccctggaagccaaggaactgggataggggaccaggctctacaaccgtctctccccaaaaccgtagacaagttacatcatctctctgggctgcgtagttatacataaaaggaaatagaaactcagagaggtgaagcaatttgcccagggccactcagctagtgagtggcagagctaggaatcataagctgttcttttggggcccttgcccttatgtcagtctgcctcctctgaactgacccatcatccttatggtggcaccaagctctggggactaatgctcagaatcaagcagaacattagcccttgtaggatctgaagtgagaagcaagagagaggtgcctctcctgcccaggttcctctcctgcatgtggcaggctgtattgtaggaaggcctgggcacctcaggtaagcttgtaggcgggctgttggactctcctcagccacctttggaataaatgcttttgtgtggatgttacaaagttgagctactggccccgttccagcctccacctccccagacagggaagttcaggtttcgcgtacctgggcttggctcaggctagggttagtgcccaggatccccagattggcccatgaattccaagggcagtctagatagatggagagggtactgcctcagcctgcctgagttcctgggggggagggaggaagacaggaagtattaatgggggaaaggtgtgcagaaccttgccaagcaggtcattgtgggtggggagacactgtgtgcatgctctggatgccctaggatttgggtggaggttctcaaggaggcaaccagaaagaaaggctacagcagtgactctggaatattccaggactactctgctggccctctgtttgggcggctcaccagcccaccaaactgacatcttcccagttagcagctctctccaaagcaagtagcagcactttaagtacttggtgagtaatgtctgttcctcatgcccttcttcggagtgttgttttgaggaaaactgtagctctggctcagtcaggatttggtttgtcagggccacattgtcctgttgctgtggaacttagagtccaggagagtcagccttcctaagttcccattggttctccctgaattgctcaccttcacaggcctcccaggaagtggccaaattcagggcagggccaaagtggcctgaccaggagcatgctgtgcctcgtaggcccagaggttagttctggggaacacttcttccctggttgatggcttccctaggccctgcatcttagagacatccccagggtcctggcttccaggtcggcagagacagagggggcccctggagagaacctcaggaacagcggtgtttatagacaagactccccattgtcactggttgtgatacttggggaacggtggcagtgctttacttcattctttagagggaaccccttcttcctcctgctgatagggcagaaatccatactaggagcctgacgtgacctgcatgtgaggccttctgctcgctgaatgaattccccaggtgtcatccctaagtcactccaggcctggtatttccccatctcattctgcacatccctcatcctggctctgcgttctgagaagtaagtgacagatttttgactagctttctcacagagctctcgaaggctgtctgtcatgcaggcgtaaaagctagaatctgtgtcaaaatgatatgtgaattcgaaggtgagggcaggggccagttttctgactctcatggtgctttgatgtttaaaaatcaggtattcctgagatttaaatactcttgttcgatttgtcctttcatttcttcacctctggttctcccttccccattttgggggacttcatgctttttgaatatttgttaatgaggccttatctgggacatgagagagcagccacataggtgtgtgcttgaaaaggaaagccagggagaggggcccctgggtggctcagtccgttcagcgtccaacccttggtttcagctcaggtcaggatctccaggtcatgagacccagccctgtgttgggctccacgctccgggtgagtctttctctgtccctcctctactctcctcctctctcctcccccccgcccccctcagataaatagatcttaaaagaaaaaaaaaaaaaaaaaggaaaggaaaggaaaggaagaacataatgcaagttctgaaaatgtcttttgagatccaacaccaggcaagcttggctttctccagtgtccaccttcacccttagtgcccaaactggtttcactcaagtgagattcagagcttttgtaagggagaaagcaagaagtttttttttttttttttaattaattaatttatttatttatgatagtcacagagagagagagagagagagagaggcgcagagacacaggcagagggagaagcaggctccatgcaccaggagcccgatgtgggattcgatcccgagtctccaggatcgcgccctgggccaaaggcaggcgccaaaccgctgcgccacccagggatccccagcaagaagtttttgaaggaggctcctggctcttctcctcagcttcatagcaaaaaacattgttgcctgttttaaaaacaattacaactacacacaggtaaaaactagtaatctctccaccacctttctctctcccattccagactattttctctctgcagttgttgtgttactgggcaaacgtgtgtcggctctgttccactgtcttaaacaaaatgtttgtgaggcagatgtgcagtgtgactcctcgcccttccctcccagcagcatatccaggccatcctgccgtggcaccacatgtgttccacctgctgctctggagagtctgcagagagttccatggcaggaatgtgccagaatgttgcatcatgagatgactccttcggcttcttctgcttcatcttctgcttagacatctaaaataatgatgtctcatgtttgtatcaggccttttaaacttctttttctttttgcttgctaaatacagcgcatgttcattatagaaaatttagaaaaattggataagcaataagagaagaaataaatatcaccttaagagataaccaccattgatattttggtgtgtaaattgtataatacaaatgttttttcacatttaatatctcacctgagccttgcttcctccgttaggagaggcatatggatactaatcccatctcacagatgggaaaactgaaccacagggtggttagaaggttgtccagaggaacccagcaacatgttaaagaccgacctgggagtacatatagcccagcattaacactctccatcgtatccgctctcctctcacctccagacaaagaagagtcatgccggggatctggatttcagcaggacccaggcagtcaccgttgtttgtagaaattaccttatccaaaggttaataaacagcacctaaaggaaagcatctcatgacactttggccccttactgacttaggagaaaagatagattttaaagaattgcccacctcaacattccagcttcatcttgaccattgggggttttaggagccacgcattaggagggcatgataaacagaggaggaggagggtcgggaatggggccagtgacaattggtgtggcacctgaaaggtctaacctggacaggatgacctgatgggggagaggtgcaggtcgggacctggtgaccagacatcaggcagggacaggatcaagaatggaggttcgtcggagtgggtccacttgccagatgcaggagactttttagcattagaggggaggcaagaagcagtggagaggttgagagctcccaccctgaaggcagcctggttcacggctctgcatcctggctcagtgggacgtggaaattatgtaaccttccctggctccgttttctcattagtaaatgggaatgataatagtacctgcttcacagttctcacttgtgaagccccagtgagtcaccacatgtaaggagcttacagtaatgcccagcacatagaaacacttcttacgatgtgattcacggagaagttgggtaggctccttgtgagagttataagaggttctctctgtgatctccttccccagcctcttctggtccctgcccccctcctgggcctaagaccctgcatttccccaacctagaacaccctacccctcagtctgtatttaaaaagcaatctccccactccttgattttattttcttctctaaattcttaaatgttttcactgatgaacatattttacttttaagatcatttctggacagcccagctctccttagccttgaaccttccccaaggcctctggcctgaagccatttcctcttcctccagacttagcccctctccccccaccgcttctgcttcctggtttccctgacggggttgttgtagtgacggcttatcttcctctttgattggagtataaacacttacagggcacccaaggacgtgtcaccacctccccacccctactctgagaggagctgaggcctgtgagacacctaggcctttttccattgactactaccctcggggtctgctcagtgagaggattttagaatcaaaaggaaggtggggatagatgcacccaacactcccttcctgtggggaaaattaagccaaggaaaaagaaccacctcctcctaaatcacctgacagattagcaaaaagagctgggctggatgtcaactaagtaccttcagccagctgtttctggactcgatgtctcccctatgctgcatttctgccagtttattgtaatcctgatgagctactcttttgactggagtggtctctccactcctagaaaacagaatccaaggacaaatgatctgtgtggggctgtttcaggctgggccatgaatggaagtctttttttttttttttccaattataaaaagttattcattcagtacatatttattgagcagtgactatctgccagtcgctgctctaaaagttgaagatcactgtgaatctaacaggtgaaaatttttgcccatgtggggtttttattcttggggagagacaatcagtaaacaaaggcattttaaaaaatacttacttatatccatatatgcacgcatgcagacatgcaattccagatagtggcaagagctgtggagaaaattgaagcaggaagggaaatggaagtacctgaaggtgagctgggctggttttaaattgaatggtcaggtgtcacttggagaagagagcagacaagagaccaaagaggccactccaggttagcaggtggcagttttaataaagggagcttacatatatggcttatattgggtggcagcgagacaaatggatccccacacccacccaacaaatcttaaaagcttacaaagaagccttccctggactcagtcatgtataccacgcaggtgttttcagtaccaccttgctatctcaaggctgtgtccttggaacagcctctggggagcgagaaaggaagcagaacccatattccatagactggggagagtgtgaggagctttcagttacctgggtccagttcatgggccaattgctggttatagcatatcatttctgatgaccctccccaacatcaagttgacggtcatatgggaccaaagccctgaggaagtacattttcggctgaagggaaaaagctgcaaaggctctgcagcaagatatgcctgctgtgttcaagaccagcaaggacaccatgtgcctgtgcacagtatgccaggaagggagcggtaggcagggcacctgtgccggaaggccccacaggccactctagagatgggcaggaagctcctggagcgatttggtcacaggaaggacagaatctgacttaaaaggatcactctgctgtgtagagagtagggggcaaagccaaaagcagagaaggcagttgggaggctgttggaataatccaggcaagagaggatgttgacttgggccaggatcatagcagtggaggtggtgagaagtgattagattctgggtatttgttaaagggagagcccacaggattcacggactccagtgctgtggcctgaccaactagaaggttggagatgccatttactgagatggaaaagacctgggtcggggggaaggtcagggactccatttggataccattaggcatccacgtggagatgtcagagaagctggaactgaagaaataaatatgggagtcaaaagcatatttattgaaggtattgaaagccacagccagtttcagatcatgcagggagcgagtgtagctggagaatgaaagagaccttcagactgggagttgactgggaccagattgcgtgggaacagccaggaagcctggaagccaagtaagaaaaggtgggagggaggaggaggatccagcaataatatcacatactctaatgggtcaagtaagatgaagataatacctgtttggaacatcaagttcaataagtgcagcaacataaaagcagtaaatcgcctaccaccctattcatacaaggaaacttccttccattctttctgtagccatttttatgggaattatgctatgtagttctgaatgttactattttttcactttaaaaagctatgaaatattatacagaaacatagtacaccattttccaggggctgcctaatttattgaaccattccttcactgggcatggaattatttctgttctcttccgttattataaatatttctcattctaaaaagttgatttcattattgtaaataacactgcactgaacagcccagtgcattttcctgtgaggtaattaccagggtcaaaggacatgaatgctgttaaaggtaaagcttatacttgggagtcacagtttgtcctgggcaggactgaccaaccctggcttagccagatggtgctcccatgcctcccctccgcttggggaggttcagaagtcactgggcccctctgacccccaattctgcctccctttccaggtgtgagtcccatttctcccagcctggtgagttttattccctctcactaggcctggccacccccctcagtgcgctgtcccccacttgctgccagcctctgttcgctcacctaatttgttaacatggccagcaggagctagagcttccctcagagggtcatcgtggtgttcaaaggaaataatccattctagcgcttaacacatgagtcctgtgtgccctcctccctctgggttgatccagtggagttgcagacatgaagactctttgtgaactttttttttctttttatgattttatttatttattcaggagagacacagagacacaggcagagggagaaggaggctccatgcaggaagcctgacatgggactcgataccgggtttccaggatcaggccccgggctgaaggcagcactaaaccgctgagtcacccaggccaccctctttgtgaactttaaaggacagaccaatgtcctggtcttagttgtttaaaaaggaaagggtataggatccctgggtggctcagtggtttagcccttgccttcggcccaggttgtgatcctagagtcctgggattgagtcccgcgtcgggcttcctgcgtggagcctgcttctccctctgcctgtgtctctgcctatctctctgtttctttcatgaataaataaataaagtctttaaaaaataaaaaggaaagggtagagcagcttgggtggctcagggatttaagcgcctgcctttggcccagggcgtggtcctggggttccgggatcgagttccacgtcgggctccctgcatggagcctgctccttctgtgtctctgcctctctttctctctctcgctgtcattaattaattaattaattaaaaatatttaataaataaaaataaaaaggaaagagtatgtgtagtggcatctagtctgtgtcccataaccacatagctctcagagcagggccactggtccccagtttggtgccctggctacgagagctgtgtcaggaatttggggtgcttgtatggagttgacaggcccaggaacgtgtcagtcagcctcctgccaggcattgctaagtgccacatctgttccccagatctgtgtgtatgtcacagctgggaatcactaagcgaggacagtgctaggaggctggagccaaggaggccagagcaggaagggggccttggaggccatctaaccttgctctgatgtttactccgagagcacaagtggcgcaactggagaagcatacagctctgtaagggcctctcccctccactcttgagcgcgggtcttccctggaatgaatgtgggtgcttcccatgcccagccttccagggctctgggaggtggccttccccttccgtgagtgccccagctagggtttgctggaaccctggcttctccgagccctgctgaaatcatctccaacctgtccacagcagccagagaagtttagctttaagtgtggctctgatccctgcccatcctcttcataaccctctctgctgctctgtggataaacacccacatcctcagcttgccctttgaagccccaagtgatctctagcctcagctagaccaggcttcctgtgctatgctctcagaggggccatgccatcttcctctctctgtgaggccttttcacatccctgtttccggtggtcccaggaccccataggcccacctctcagtcagaggcctcccctggccaccccactaggctagcatactctgagtatgcccccactgtgcttggcctttgtcttttagagccctggttgtggttcctagttacatatttgtgttggttagttgcctgatgtagactggcacatgatagtaggtacttaacaaatatttgttgaatgagtgaatgcaagcagctggcaacagctggcagggcctagaagaagagtggaggggcattgacagcctcagcagccatagcacctgaggtcctcaggtgagaagtgttctggaaaggtccccagcgtggccctctgcccgctggcacaaacacccttacctcaggagccttctctgagcaatgatgggtcttccttccttcctcaggcttgcagtagaaaggaaagatctgggtctcttctgagcaggcctttcttttacctcagcagtatctgagcatattattcagttttctttgttcatgacacttctgtaaaatcttcctccctcctcccatcattaaggtaacctatgctcatggtgaagaaattggagaacacagaaaaagataggaaaacaagaattccccataactggagccctcagagaaaagtaccattcagagtttgagccatgtctccagttttgtttgtgtgccttatgtacatggttaaacattgctgagattctattgtttatgaaaactggagattgtttttatttttttatttattttttatttttattttttttaatttttatgatagtcacagagagagagagagaggcgcagagacacaggcagagggagaagcaggcttcatgcaccgggagcccgacgtaggattcgatcccgggtctccaggatcgcgccctgggccaaaggcaggcgccaaaccgctgcgccacccagggatccctggagattgtttttaaagatattatttatttatttgagagagagagagcatgatggtgggggggtgggggagaagcaggtcccttgctgagcagggagcccaacacaactcggggctcgatcccaggatcctggggtcacgaccagagccacaggcagacatttaacggactgagcccccaggtacccccagactggagagttttgctgtctcttcagtcttcagtggctccagtccaaggcagctagggcagtgatcagtgtgttaaccttgcaggagtggtgatggcgggcatctgagccccactgatcccgggtaaagagccctctttttcccactcacgtctcttccctgttacgctctcggtagcttcctgaggcagcttttcctttttttttttagttcagctccgctccacagggcttagggactgacccttgatggaactagaaaaattacataatatgcaggacaagagtgacctgcctgccttttctctggttcaagatctctctgaataaaaccagcccccaggctacttctggagattggcttctggtggcttccaacaagaaggccacaaaggcctctcctgtactctgagaggagtggggtgacctggattggcaaatggggagcaaagagccctgtggagttgctggtctggaaaaccagggcactgggtcagtacccagataaatgattgatttggaagctcaggacagagtcaagcaggctcattctcgcatggcctctctcactgctgaccctgaaagcgcttgccagggaaatggggcaacctctgccctttctctggagactgctgaccctcatccccctgcagtggcatgagggaggagagggcagcagctgggtcatctgcatcgaggcaaaggagcccaagaagtggaggaagagttgggcccggttctctgaaggagaagcatgtgcccagagcagggagctccttgtcagttctcttctacccagttgatgatgaggcagggaactgggaaattctgggtctgtttgggtctctggaattctaataggctggcacatttctagacctggaatgtcacttgctccgtataatatcttaagatgaacccatggcgacaatcgtagcagtggccacagtccctgtttgttggacatggactatatactcagcactacttggcactggctatttggttatttaacctttatgacgtctgttcataaagacgttatgttcacataaagatgtggactgaggaactctgaagagttagtgtcacagagagggtggcgcagagccaccctgacacagaagcccctggaattcacttctacggagtattgcatctcaggagttaatacatgaaaactgatacagcagcaatgctgagactgaaaacactgtgcctgaggctaatatctgtgtcttcattcagcaagtgtgtgcagagtgcccactatgtaccagacactatgccagatgctggggacctaccttggcaagcgagagggcatcgtctgggaaactgatagtggcctggtgaggccagacccgttgcctgactttgcagtttgctgcagtgatcgcagatctgagggcctggctcacatttgccttaggaaggaacagaatgaggctggtcagccagaacttcctaagggaggaggtacaggagagcccgctcttgaaggagaggagtggaaggggcaacatttcaggctgaggccagtacgagcctctagggtcagagggtgatgctggaacacagggtaagtgggatggggctggagaaggagacagggaccagagcctgtggctgtcttcggcatatagcagtcattttctggcagggagtatccaaaaggaccttgacccagggtattcttgatggaaaaacagttggggattggcagctagaccaagaattcagcagtaatggctccagaccaaggctaagagcagcttctaaatccaacaggtcagggacataccaccttctagacatagcagtcttacatatccccatatgcaaggcacgcagtacagagactaacacttgaatcaatctgtgtgggcgccaatcctgctgttccaattactgtgcaaccttgagtcagttacttcccctctctgtgtgcaagttcctcatcagttagttggaaatcattaatagtacctgactcttagggttgtttttttgtggtttttttttttttgttttgtttttttcttagggttgttttgaggattatatgtccatccacacggagcctggtatgtaagccctgggagaatggaagccagaaccattgcaatggggctggtgagctggaggcttatagctatgacccagcttgggctctggttcagggagaagcctctcaggctgcaccacacctttgagagatgcatggggctccagcacactgcctggggtgggtggcaggggtgctctacctcttgaggatgtctagaccttgtgggatggatgagggctccaggtggcttggttgattgcttgggtcccagaccagacctgtctagagcttaggatcatttggattaagctcctagctacctcttcccatgaaacagacttgtccaatggcaaatggagtgtggccctcccccacctccactcccagaaggcctgccattcatctgtgacaagagagtgggtgctggagaggcgcctgggtggctcagtcaagcacccaacttttgatttctgttcaggtcatgatctcagggtcgtgggatcgagtgcctcatcaggctccatactctgtgggggatctgcttagattctctctccctcctctgcccctccccctgctcactcacattctctccctctaaaataaataaataaatagtcttaacaaaaaagagagtgggtactggagtgggagcacggggcttgcttgcacagcaggcttgtgtgagcatgtatccatacaatagacacatgtgcgtgctagaatcagggctgtcagggcatttgttttataagaaattcctttgctcgagactccattttttgtccaagcacagcagagcggcacctcctcgttctggctacaggacctgtgttctgtatgatgacagtaccgacctcttaagtggggggaaactgggacacaatcagaaggtttctggctctggcacagtattgagggtggcaatagcaaaaaccgggcttctcagccacataaaagttataccttgtgccagggtgtgctactcttagtgctagagctgaagaaaggaaaggaaataaggtccattgcagggctagtggtaatggggaggcagccccctgtgaaatgtccagcctgcgggcctgggcccagtggggtgagggcagggccctggggatcagagtatctcctgacccagcaggccgagagtggtggaggtggggcggcgttggtttctggaagatggtcaggcttcagctgtaaatggaacagccagggctgtgtgaaaatggatggtttctggcaaaatgcagggatgggctgcagcacagcagttacatctaaatatgaaacagcccaagggatgtgtgtgggttttagacagccaaactgatgctcccctcccccctccgctggtcacagccagaagagacaactccagtctggggaggaacatctgcctggaatccaaggatcctggtctggccccaaattcagaactccagccagagcccagagccacatctgtttctaaaggcatctacttgcaccctctgcaactgctgactgttcctctggtcatgtgaaagaaccttctaccagttagtatatagaaacagaagctgaggctccaggtgtcagagatgcataaggtggcccagtccatgcagctcctcagaagcctggccagccccacaccccatcgtgtctgaacccctctgtcttctgctttatcctttgtgtcttctccgagagacaccctgtcaggctcccgaggccagagctttttgtcaccttccctcgtctccccaggggagctcacaaggctcacctgtgggagctctggaggattgaacagatatgatgtgtagggggagctcagtcagctcccacccctccttccagaactcagtactgacaatgaaccccgtcccatccccccagagtcactcagaggatcagagggtacgagggaatgggcgagaaaatattttgttagtatctctacgaggcagtgctgtggttttctctcctctgattccagctgctaagggggaccccagatcttcatgcccctctcatcaccacagtctggtgtgcattaccccgtgtccactgacagccaagctccacagagccagaaacagtttgttctgatcagcctcacatcgcttaccatgtggtcgtggccaccgctgtgcttggagctcttggaagtcatgctgtctgagccttctgtcaccatgctccccatactcttgatgctactctgcagaagcctcctatagccccttcagccacaggcctggctaagggtttctcactcctcacctgccccagacttttcagtcctgtggagcacaaagcatcagggtatctggtctcggttattcagagaataactacttttttcagagagtgtacttcttgctacaactgtcacagactgtttctggtaatcaccaaggtcctttccccagtgttgtcgccaaccccctctccacaaccccgttctcctatttaggtaggtgtcctatatattgtgttgtttcttcttttttttaagatttatttgtgtgtgtgtgtgtgagagagagagagagagcgcgcgcacccacacacgcggggacagagggagaaggagaagcagactccccagtaagcggggagcccaatacagggcttgatcccaggaccccgggaccatgacctgagccaaaggcagatgcttcaccaactgagccacccaggtgccccgtgttgtttcagttaggattgtattcagcagcctgcagctgaagtgtggcaaacaaggcctcataaaacaggcatttcgttgtcacccgtagccagtagtctggagacaggtgttccagggctagttcagcaactgcttgggcccccttcttgcttttcgccccaccctcttaacctgtcctgctccaaaggaagctgttccacctccgggcccagtattcctagcccagggaggaagaggagagggcaaacatctcttttgatcaaggaaactattttcagaaggcttttccaatagatgtctatttacgtattagtcagcattgtatcacatgaacacagtagctgcaggagagcttgggaaatggagtgtttagctaagcacgtggctgatccaaagaaactgggcctccgtcagtaaggggtagagtagagttaggtaaacaatgagaagtgactgccccaggctgccacttgtaatcagagccacatgacgggaactgccttgctctgggtctagtctttgtcaggttggaagatcagggattgttccttgaggaactgaggtctgctaacccaactcagattcccacaggaggggacacctcatgacgtgccacatgagtgaagcagcctagggaatgacagcagggagtagccaagatgatgggtgccagtggtgaacacctgtccgggtaaagggtggtgtcaggggcacgcaggcacccagtggccaggtctgcccaaattttcaaaagaagccagaaatccagaatttttttttttttttttagctttaaagaacaaaaaacatggggatccctgggtggctcagcggtttggcgcctgcctttagcccagggtgcaatcctggagtcccaggatcgagtcctgcatcgggctcccggcatggagcctgcttctccttctgcctatgtctctgcctctctctctctctctctctctcatgaaaaaataaataaataaatcttaaaaaaaaaaaaaaaaaaaaaaacagggacgcctgagtggctcagcagttaaaaatctgcctttggctcagagcatgatcctgaactcccgggatcgaatcccgcattgggctccctgcatggaacctgcttctccctctgcctgtgtctctgtgtctctcatgaataaataaaatcttttaaaaaacaaaaacaagaactctattttgaaaaaaactgagaggttacagaaatctcacaagatagtacggagtccccaaatgccctttatccagtttgccctactgggtatatcttacataaacgctagacacttagccatactaagaaatgaacactggttcagtactacaaactaagcagattttattcagatcctaccagttctaccagttcttccaccgctgtcctctttctgttccaggatccagtccatcctacgtcacatcatagtttttatgtctccatcgtctccccatctgtgagactttctcagaaagttagacttttacatgacttctaagttcttctgttctactgaaataatttggaaatcatacgtgctatccatggtaccttagtggttatcccagacatttttccatgtgtatttgcctgagcacctccagctgtctccctctcatcttctacattatcgtttgtaggttttgcctctttattttattccagtttaaattatttttagaacagacaaatgtctgtagttcagagtttaaaaggcacgaaaggaggcacctgggtggctcagttagttaagtatctgccttttggggatgaagccccacatctggcttcctgctcagcagggagcctgcttctccctctgtctctgccactccccctacttgtgttctctctcttgctcactggctctctgtcaaataaataaataaaatctttttaaaaaaataaaaaacggggatccctgggtggcgcagcggtttggcgcctgcctttggcccagggcgtgatcctggagacccgggatcgaatcccacatcaggctcccggtgcatggagcctgcttctccctctgcctgtgtctctgcctctctctctctctgtgactatcataaataaaaaaaaaataataataaaataaaaaaaaataaaaaacacaaaaggtaccatgaaaaaaacctctcctctttagtgacctggaggcaaccaacattcccagttcttctgtagccttcctgtcttaaacacacacacacacacacacacacacacacacacacacacagcttcagtttatctttttttgcacgaagtgtagcctttcacttcattctgcaagttcttctcttccattgttaatatattttagagagtcctatctataaacatgattcttgtttgtggccacatagaattcctgttcccatgtcataatttatttactaaagcccctgttaatagacattctgcttatcccctgcctcttactagtcaaataatactgtaatgaataaccttgtactaatacttcttgtcattttactgaagttgaaacatagctggtggatacaactcaaaagtggcatttctagggccaccttggtggctcttcggttgagcgtctgcctttgcggtcagggtgtgatcccagtcttggtatcaagttccgcatcaggctccctgtgaggagcctacttctccctctgcctatgtctctgcctctcattctgtgtttctcatgaataaataaataaaatcttaaaaaaaaaaaagtggcatttctaggtcaaagggaatgtgtacctgtaatttaggtaaatgtaggcaaattactctcttcagaggttgtgccagtttacctctccaccagggatgtgtgagattatgtttagcaatatgttaatatcgtaaaaactgtatttcagtattgttttactttgtattttttttctgagtgtttagcagcttttcaaatgggtgccttttctgtatacatgtttcatatcccaagcctgtttctcttttagattgccggccttttccttatttaggggaatgttttagagaaattagcccttggataagagttgcaaatatttttcccagtttattatattttttgttatgattttttctaccatgaaggaggtatgtgtgtgcgtgtgtgtgtgtataaatttttttcagtagtccttatgcccaacacggggctcaaacccatgaccctgagatcaagagttgcatgctccacagactgagccagcaggtgcctgataatgtatatatttttaactttaaaaaaatgttttttatttatctggatctcatcttgatataaggtttgagggacgcctgagtggttcagcggttgggcggctgcctttggctcaggttgtgatcccaggatccaggattgaatcctgcattgggttcctgtaaggagcctgcttctccctcttcttttgtctctgcctctctctctctctgtgtctctcatgaataaataagtaaatctttaaaaaaaaaaatgatataaggtttgaggtaggggtccatccagatttttccagatggctactcagttgtccccattacttaccatttattgaagaatctattttttttctctttgaagtactgtctttataacgtaatatagttccatatgtgtttgcatctatttatatagactctttgtattctctttcattgattgtctattcatgtgtcattacacttttaatttttgttgtggctttgctctaattctttttattcctttccagctgattccctgtcgtggttgccaaagtgcctccatccagcctctttgcttttactctcagttgacttttctccctgctttattaatgaaaagagtgaggccagcctgtgtgagctttaaccaccccctccccagctgccacgatagttcatattttcctcatcctgtgcccttgaattattcgcctcctgtctctcattctgccccagcttctccttgagtcttcagaccgtctttctctgtagacctgtcctctgtccatggcttacttgagtctctctagtcgaaaaccctttctggctttgctactttctctaggtagtacattggcatttaccgaaaaactagtctctattcactgtcctgccttccttactaccaaatttcttcttcagagcacgtttccatcctaaccacttgactgaaacttgtctcccaagtcactgatgacctggcgatcactgactccaggggtcatgtaccagtttatcacccttcaccctgcagcatttgagacggttgagccatctcctgtgaaacggcccttcccatgactctgaggtgtctgtcccatgtctctcttgcctctggccagtgccctgttgtctgctctgatgcctattcttttttttttttttttttaagattccattcatttattaagatggagagagagaggcagagagagagagagagagggagggaggcagagagacagagagagagagggagggaggcagagagagaaagagagagagggaggcagagacacaggcagagggagaagcaggctccatgcagggagcctgacatgggactcaatcctgggtctccaggatcacaccccgggctgcaggtggcgctaaaccgctgcaccaccggggctgccctctgatgcctattcttttgaccttccttgatgtgttgctttctcctttggtgaattgaatcccttcctgtggctgtcaaatcaacaaggatgttcggatgttccccacatctacagattgcccccacatctccatatccctaactccccagctcttagacactagagttgagtttccaaactgcctttcgttgacacttggagaagttgttgtcagtccaaacaagggaaaatgaaagcctgctggaaaagaatgatgagagggaagatttactgtccattggaagtggctttgctctggaacagtgattctcaagcgtggctgcacattataataatcaccaggagaattaaaaataaagatcccagtgcccaagcagctccccagactatcagatgagaatctctggggacaggctcagacatccatatttttaaaaactccccagccgttctagcatacagccaactttttaagtgtagaacagcatgggggagggaaaaatctcagttgactcctgccttgtggctttgataagtgggtagatgagcatgcaagtcactaagtaggaattaccagaggaagaacgggtttgggggcagacagtgggttctgtttggataggttgagtttgagctgcctgtggcacatccagaagtcccacaaacgcttgaatttccctaaagcaggttttctctgctctcgatcctcccacagcctgtactgcctaaggatagagtcagtcgtgcctatatgcctggatgcaacccaccttcccagccatccttccaaatcctctatcctacagcactcactccattggccaccaggactcctcactgctccccactgtgctgcctctgagtcttttctcatgctgtgtccccaagacaagtcccatgccatctctaatcaaaatccaccccactctcaaggtgtctccctactgttccctgacaggatgacgcccccacaacacttcatgatgttaccaccactgactgtggtgtttgtgggcaatatatgacttgccaagggttggaactgcctcttccacatgggagtcagcacccaggaaccccctttggaaaaattcctagacagaatgcatctccgcttgcctgatggctatgcggttgagggtctagttgcagatctgctgtcaactgtcagcctagcacagcagaggcttgtatctttttgtttccccacacccagacacagaaaggataggacctactcccttcaagaattgcagcctaggagagcctgagtgctggaggggatggggtgggggttcggaggtacgatgcctatcagaatctccaggaggaacacagagttggaaaaagaccctgaagtcattttgatctggctcaaagaggaggaaggggccgaggagccagagaaaggtgatacagtggtgtgtcaccctatctggatcgtggatactgctctgaaccccacagactggccttaggaaccaagtagacaaagggcaggaggaaaagtgacttgtggtacaaggagcagagaccgtgggatagcactccagggaggaggcattcctgccatgaagaagcaggaacaggggaattccctccatcctgtccccgaggtgatagccccctggcatgtcctgctctctcaccctctcatcctcttcctgtctgccccttggttcaggctgatgggaactgccctgtagaggtccagctgcattcagacccagatgatgccagagctatgaccgggcctgcaggcgtggcgccgaggggaaatcagccatggagcagccaccgggggaagccgctgaggtccgggaagaggaggagaaaaaggaagtggcagaggcagaaggagccccagagctcaatggaggaccagagcgctcgcttccttccagcagctatacaggtgaggagggggcggcggcgggggacacagggtagaggaagcagagcaggcctaaccgaaaacctgccctctgcagccagcagcatggggtgcagaggggcagaatggttaagaactggagccggaaaaaaaaaaaaaaaaaagaactggagccgatagtcacacccctcttctgttgctcatcagtgctgcgggaccttgggcaagttgcacttcttctttctgtgaaacagacagggcttgaaggggatgtggactggggcttttgtgaaaattaaatgagttagcatttgtaatacatgtcgtcatcagtattattcccactgctgccgcccaaggaatctggagccaatctgcatgaacagcacacgggaaagatcaactgtacctgtgattgtaatgatcagtcacaacacccagctccattgatctggtgctaattatacacatcatcgagctgtgctgtaattaggtataaatgctaagcggttagtctgaatgactgtaattaagactaattttgtgcattcaggcagtttctagcttctcttatatcactgtcagttccccatttgtttatccactgttagtagcagtgtagacattcttctctgggaccctgtactattctctctccatcttctttagcatcatgttatgtccatcttaggggcacccagaatccactccttagcccctggttttccctgctgctgctgccccttccctgttcccaaccctttcctcaccagcttctctctttccccctcaagtgccaatgttcagctgattcttgctcccttacccacagaagggacttaggatcacaagaggatgtatttctggcaggggacaccctgatcttgctgctggtttcagctggaggaaatcctggccacaggtgattaagggcaggggagcagacccaccccacgggatgatctctgaagccctgtgtctgcatggggaggaggtaaatggtatcagagttaaggtagggcaggggctgctgagtagaacagattcctgcctggcctatatttaagaaaggcccaaatcctcaagccacactaatttgaacctgcaaaacaagtttctggattttgcagagttttttcttcggggcatgtggtggataggataaggggaaggtcatcatcccatccctctgatcccactcatatacccaggaatgaccaaaatgggcttggtgtgatttcaggactcaagagaaagtatctcccaacccccagcgtaaccattccctatgtgttggtgactgggatgaattcagagacccagcctttctcagaagaggaatggctgaccaaaggtgattggtcactcagagctaataacacatactgttctaaaattgagatggaaaaaaaaataataaaataaaataaaattgagatgggcgggggcgggggcggttaggcagcagaaggaaaacaccagggattaagaatgagcaaggtctgtcactgaggaagagtgaaaagggaagagaaggtgatggaatttgtggcctcaccacctggcctggcccaccctatccccacatctgggtcagccacacagaaattacctggagagtaatgacctgttctggagttttctacacacccttgtggggacacacccctacatgatactcctgttcacatgcagaccagggtgcagtgctgggtgtacaggtggggtgaggtggacatggtgatggcatcttggggagctttatcagcgagatttagggcacacagggagatgtctgggaagaaatttgcccaactacccttgcagtggtatgtgtgatatgatatttaatggattccatttaccaataaattgatgaagtagaggtagaaagacttcaattgttgaacaattgagactagggaacgcctgcgtggctcagtggtttagcacctgccttccacccagggtatgatcctgtagtcctgggactgggtcccacatcggcctccctgcgtggagcctgcttcttcctctgcctatacctctgcctctctcttcatgtctcttttttttaagattttaataaaaatatttaagattttaataaaaatctttttttttttttagattttaataaaaatcttttaaaaaaagaatcgagaataaccattatgtgttaaagccaaagtatataaaaagttcccacaaactctgcaagataagcaacagaaaaatagaaacagtgagtttgtggtaggacaaatacaaatggctggaaaacaaaatgttttccagtctactcactaatcaaagaagccatcttcaagatgagatgtcatttagcctgtcagattagcaaagagaactgttttggccagagggggaagacatggccctccagccacaaaagtggaagggcagctgggctatgcaggctgtcacttctttcattcctttgaccctgcagctcccctcctaggaatgtgtcccatgtaaatactcgctcagagcgcacagagatttccacacttatttactgcagcactgctcagagaagcaaagaattggcaagcacccatctgtgaggaattggttatgtaaactgtggtagagccacactgtggaatgctgtgtagtcattagtaaggatagggtaggtctgaacacactgacgggaaaaagagctcctgccaagttgggggtcccattgcttaaaaatctttcagtatcatggaaggcgctgaagagtatacacacaaaggactgtgccattaactcagaggagtaggatcgtggcagagaggatgccttataagatggtgcatgccattatgtattatcctcaatctatggtactctcatcatttaagaagcaaacgcgtcgctttagaaagttaatgcaattttgtttcccaaaaaaaaggccagtaggtgaggagccctggagacagagctcatcctgtattggggatcacatcaaccagggcagaaatctcaagtctgtgactctgagctgtggcttttgctggtgccttcatttctctaatctcagtctctacctttagtctgcccacctcaaaggctggctgggtgaggttctctcccctaccgcatgagcctctggagtcccctcaggaattcaggaggatgagacccagtctcaaaccctgaaacggcaggaagatcacacagtttgtttccctctgaccttctaaggttctgcatctctgtaccgagctcaagacctgacaaaagaggcaggcaggacaggcctcactattagcacacagcagcgaggcaactcacatgcccggggtcccccagctggggagggatcggggcagctgtcccctcctgctttggtgatgggcatcccatccacacccaaggaagaggtcagggatctgtggggctggggctgaggagaataaagtgccattcctcctggccttggtacctcctctcctagcaagcactcagtgggtgtccaggcaggggctggctgttcagttgaggacaagactgcatgccagccctgagaagcccactgtgcaagtgaataggacaacagaagtaaggagggtgctcagtaacccagatccagagtcccacagaattgaccctgacttcagaagctatttgctggctctgccagcaaagtaaataatgttgacccctcctggccaccctcccagccaggacaacagtatactgccagcaatggagcctagatatacaagagaactctcatctatacataaatgatgtaaatgaggtcaatagtgtctgtttgctgaacttgtaatccaagatggtgcaacagatggtttgctctctgggtgttggggttagtgtttactctgagtctaaacatttgagtaatggcatggtgtcatcctcagcaatgacatgtctcatcattcatcatattcatgaattattgattagtggtaatgaatatatacatacatatggaaagttatagagtacagtaagagctcagccccaggggttgggtggttctaggttagaattcttactctgcactgtattagtcagggttctctagagaaacagaaccaataggttgtgtgcatacatagagtgtgtctgtctttaaggactggctcacacaactgtgagggctggcaagttgaaatttctcaggacaggccaccagactggagacccagggaagctgatgctgtagctcgagtctgaaggcagtctggaggcggaattcctccttccttcaactgattagctgaggcctactcatgttatggagagtaacgatttcagtgttaatcacatctaaaaaattatcttcacggcaacatctagactgatatttgaccaaaaactggtcagtatggatacgatggcctggccaagatgacacataaaattaacaatctggttaatgccactgtcagcatgttacttaacctcacctataaaagggtcagaagacctgctcaaagggttattttaaggttcacatgagattaatggtatacagtatccagcagagcccctggcacacagtaggcatgcacaaaaaagatattatttgtatagacacacagtctttacagggaaatcaggtttaggttcaagtcccagtcccaccaagtatgagacagatgactttgggcaggttccttaacctcaccaagcttcaggttcctcatcctttttttttttttttttttttttttaaagattttattcattcatgagaggcgcacacacacacacacacacacacacacagagagagagagagagagagagagaggcagagacacaggcagagggagaagcaggctccatgctgggaacccgacctgggactcgatcccgggtctccaggaacatgccctggttcaagttcctcatcttaaatggtgcaagttactatcctccaaggtgatatagaatgatactgacaagctcttgggggggtggggtggctgataaatgctggttctttcccccttcctgagggagagctagaggtgggcccttaggagatgcctggggagtcaggcagggcgtggctggagtagaagttcagaggcagagctcagtgccagatgatggccatcaggtgagcaagtatatttcctgagagcagaggaggaactggggggaggacggcactgggctggctcagaagagcagctgtgcaggcagctggccctcaaactggcatggcctgtgtctccagccagcatatctgaggggcaccaaggcagagactcttgataagggggagggcctctcgaaaccctagtctcccaccaggaggtcatggacaaggtggtaggaccttcagaacctggtccccagaatgggggagcattctgctatcattgcttttgggtaggatggtggttcaaaggtaaatccttgagccatttggtcagccaggaagaaacagaacctttatctttagaaaactgactcccaaaccaccaccacctcagtatccccgctgcacatgcacatgcacgaagcctacccctggaggatgcatacacttctgcccaccctagcacctcatcccctctgcctctctgccgtgtgtctcagttacttttgttctcttattccaaatgggcagggggaggggtgcccttgtcctattagcctgccactaccaagcattgacaactgcttttgggttctgcagcttgtgtctgtttaccacccaggggcaggacggtgtgatccaacaccctgacactgccctgagtctgtttctccacagtcccatttgcagcacttccctctgagacactcgtcctgggtctgtccccaggattctgagctcagactgctttgggggctggtgaggcttgaacatctcagcttctcccagggttcccagtgatcctgaggcccctgagccaggggccagtggcaggtcaggggaagtgaaaggaggcttggtctggttctaggggttctctgggcctcataagcagagacaccgccaccccccttagatttatgtgaagctgtaggggaagggatacaaccagccagaaagaggacaagtcacagtccctgcctgcgtggggtacacagcttggagtatgcagaattatggctttctgataggcacagccctaattcacactgatattcacatgcacttccaagttctaggacttctctctatagtaactgtgttacttttcaccatgactttcattttagagaaggaaactggggcccagagggcaaaactgggtgttgagcccaaaacaccagtttgaactcagtcacattcttaaccttcatgcctgctctttctgagcatctggaagccaacctggaagtcttccaaagctctcaccttggagcccagagagagcagcagtcgccttccctgacagcctcattcttgagtggtggctccttcgaagtcctgcaccatctgcctgcccctcggccggtgttgccactcgccgtgttgtctcagttttcttacctcgttcttacttcagctagtcgagggcagggcctggatcctgccttgcatgcagcaggtgctcatcagatgcctgttgaatgaaaagagaggatggtattgcctcctgtggtgcaaatgaccagacacctgcccagcatccagggccaggagggagaagaaggcgggcactgcgagaggttggtttactgcagctgagattcggtggtggaggtgggctttgagatccaaaggcaatgtgattagagatgtcccatgtctaacagaggaggcagacatgtaagccacaaaaacaaaactgcttgaaagaagtgacacaaagtgaacctgcacacagaccacacagattggagaaggaagtgccggaaaccctcctgctcagcatctacacaggtgtctacaaaggggttttatgtgtgatctcattttcttccagcagctcataacatgagctctgtggcccccatcactgtgcccccaggatctgcccggcccctacagccaggtggtgccaagtgcaggacgcccagggagcctgagaaccccttatgtcacagtcactgctcagagcctgctccctatgcagaagcggcaccctgggggcagagttcctgcccaagggccctcacaccctggtggaggacatccaacactgggtcagcacatacagactgtcatgttgtggctgaggctttggaggaaaccatagtggctctgccctcccacaggagcactgtgccctcccaggcagcccactctccctcatctgtggaatggctgaaggttgggagctaaggccctggaacaggacaggccaattttaggaatcagggacttgtggctcccctgcccttgccagcccagggcggggggcaggctgcctgatcctctccgctgtggtctggtctggtgttcgtgctcccctctctgtggctgagatagggcttggctgaaggctttcttcctgtcactccgagtaccacagggggggagctgaggaaggtgtgagaagggtggggtacactctggggagggtgggttacgccttaggagggaactcaagataatttgtggagtgacctttatctggattatagaaagggaggaacggcagcctgggaaatgttaagtccgggcgcggctccatggcatgggtctgcctaaggtaccgtcctactctgagccactgattctctggtctggggacttaacccctgcccctgaggaggttgctcgagcatcaggacagagcagagaagggcagatgggcaggccagcatcgctgaggcaggacacacacacacccatacccctctcctccccaatggtgagtacagcccaggcaggctctgacttcccccaatactgataagctgccatttcccaaacacctgctgtatgtcaggtctagggaaaagccctgggttctagatgaaggaactgatcctcagaaaggttgactacttgaggcacatagctcttaatgagctgagtgagagctgtgtgattcagaaacatgggctcttcctaccatctgctctgcccccgtgggccccagtcacttccttgggcccccatcatggcagaaggtgaagccacccccatgttgtgtgttcgcagacctctcccggagctcctcgccaccatcactgctggaccagttacagatgggcggtgatggggcatcgtgtggcagcctcaacatggagtgccgtgtgtgcggggacaaggcatcgggcttccactacggtgtccatgcgtgtgaggggtgcaaggtgaggccgtggcgagtggtggctggcagtcggggctgtatttacatggtgagatgacctgccagagaggccaggccctgacagaacctactatacttcccacctgggaggcagccaggtcctggggaccattccaggcctcagccctggtccctctggtccctccctgcagggcatcaccccagtcactctcctgggctgtctggctgccagcaccccctggggatgtagctctcgaacaccggcagcacccagtgagggtcttgggctgaaccatcaccctgacctcagtgtttcctgcacctgaaagagtctctctgagggaaaaaaggaaacttaacattcctatttccagggctgctttggggctcatcctcccaactgcacacccatcaaaattttatatattattttactaaaccactgtctagaaaatgccaagaaccagatacatttatgaagaaatcaggttagccatgatacaattttatgttaccaaactaacaagcatttaaaggatgtatgtaactctcaaaggttttagaattgtttactctcctcctcctctccaaaggaaatttccctgcattacttccaaatttcaggaatttctacatcttcacatagaactggggcccctgacttaacataacccattgggcagaacaggattctccacattttgtggcttcttctcacctcttcactgtccctcagggcttcttccgtcggacgatccgcatgaagctggaatatgagaagtgcgagcggatctgcaagatccagaagaagaaccgcaacaagtgccagtactgccgcttccagaaatgcgtggcactgggcatgtcgcataatggtgagagccaccccgagccagacacaggagatgctggctccacacagcctgagaccagaatcaggggagcccaggaagggagagccctcagagcagtgcctggcacacaggcgcagagtaaaggtcaactctggagccttggagccagcatcagccgtccttccccagatctgccttccccagactgctcagcatccgctgtgggtctggggcctggggcagtcacctcctcccagtacctgaggcttaccctcgctggcccagacgggaactgggaattgaccccagctccagtagcattggaaacaccactcccagaacctcaagcctgtctcagctgacctgacacggtgtcaggagccactgctaaagcctgggatcaccttggcccttcttagttattgaaggcaggcaggagccagtaagtgactgcacgtgtcagctgccgggagccagacaggaatttcctggaggccagccactcccaggagacacagcctgccctgaactcgggcctcctacagagtcttcagaccccatacagtaggattttgagaaacctcacctgccccctctttgcctgtctgggtcagacactgcccccccactgtccccaccgagggctggggagagcctcttatttaaatgtctccaccctgtcttgcattttagatggtggcaggacccaagccctccattggaagattttcctaggtgatgggggctggcgggtctggggtttggtccctcccttcagtgtgtatctgcccaggctccattccttgggtaggctgaggggatttcctaggagatctcagggccagctcatttctcactttttctcttaagagaaaccagacttggatcctgctccatttctaatgactaattttttagtgcttactctgtgaatattcttatttaattgttcagacagtccagtgagatttaagtattagcccatttttcttaccaataaaggtgaaatagcctgccttaagtcacacggccagtaagctgccaagctagagctcgagcaccagcctttgacaccacaggctgtcttcccgcctgtcacactgccccactgccttccagccacagtggctcagtcagctccctgagttagggttccttgtatgccaggcactgtgaacaagacagaagccctatccccctggagcttacattctagcggggttccccaacattccagtgtgctggctgtagagcttctgagggtcctgggctcaaaaagtgtgtctccatttctggcccacgtacctgtagtgagacaaggaggtcaggggtgccagctcctgcccgggctcctcgatgacccatccccctcaatacagccatccgctttggccggatgccagaggccgagaagaggaagctggtggcagggctgacagcaaacgaggggactcagcacaacccacaggtggctgacctgaaggccttctccaagcatatctacaacgcctacctgaaaaacttcaacatgaccaaaaagaaggcccgtggcatccttacgggcaaggccagccacacggcggtgagtgtcactgcttgccccagcagtcccaggctccaggctctgtgctgcctgcctaacttctgggggaaccgggccttctccctccccttgcgccgtggcccaggcaggggttcggggagtgtatgggtgggtctccccaaggcccggcctctaacagggcctggtttgcagccctttgtcatccacgacatcgagacgttgtggcaagcagagaagggcctggtgtggaagcagctggtgaacggcctgccaccctacaaggagatcagcgtgcacgtcttctaccgctgccagtgcaccacagtcgagactgtgcgtgagcttacggagtttgccaagagcatccccagcttcagcaacctcttcctcaacgaccaggtgacccttctcaagtatggtgtacacgaggccatattcgccatgctggcctccatcgtcaacaaggacggcttactggtggccaatggcaccggttttgtcacccgtgagttcttgcgaagcctccgaaaacccttcagtgacatcatcgagcccaagtttgagtttgctgtcaagttcaatgccctggaacttaaagacagtgacttggctctcttcattgcagccatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacccagcccttccggggcttgggccctcactgtggggcaccaggctggagcccgaacagcatggggaggtgcccatgtgaggatggcagtgcaacctccgaggcaccaaccacatggaggaccagatccctcttatagatggagaggagacagaaaaaagactgaaaagaaatatgccagcatgttaatggggatgatttctgatggtggagaagttctccatattttacccgcgtttttcagattctggtacaataaatagaataatcatcatgctgacagtgccatagagcttacttcacaccaggcactgttctggttccttttcctagattataactcatttgatcccactcaacacagtggatgcatcaccccattttacagatgcacaaactgaggtcagagaggctgagtggcctacccacagccttgtcactggtctgtcgtagggatgggaattggatctaggcagtgagtctcttaaccatgaggtcatactgcctttctcagcaggaaaaacaaaacgaaggagacaggccaggaccaggggtggagggactagaatactctgtggaacagtcactgacgggacagggcttggtctgtcacatcagtagggctgctgctccctgggccaggtcacccacacggggtagaggtagagataggggagctcccctgctccctcccacaacctctaccctgtgtccccacagaccgaccaggcctcataaacgtgccccaggtggaggccatccaggacaccatcctgcgtgccctcgagttccacctgcaggccaaccacccctacgcccagtacctcttccccaagctgctgcagaagatggccgacctgcggcagttggtcaccgagcacgcgcagatgatgcagcgcatcaagaagaccgagacggagacctcgctgcaccccctgctccaggagatctacaaggacatgtactaagggtgtgcgcccggggcctccaggggtgaacggacagagccaggactttctgtggaataacccccgagccatgggatcagtcctgtgcgcagacacacggccacttgttccctgccttcccctacccccaccttttccatccgcctctttctcagaccctctttcttttctcatttctttgcgcgctctctctctccctttctatgggtttccaccttccttcctccctcgccttctctcaccttccctctgtgtctccccatccctttgtgtgcccctctttctctctgtgagacagtttgtgttacttcaccagcagcatgaaacgggtcctctgctttcgtccgcctcatcccctgtcccccaggagcagggggggaatgggccttccctctgtatgaacattttacctgcaagggtaggggccttgcttctgtcttcacagcaaaggacttgggccagccaaagaaacactaagctctctgggcccggcttcctggggctgactgcagtcacagccccccaagtcaccggggccctgccttgagggccggaacacctcccccacactgttgccaccctcccctctgcaacccctctccagcagcacgccccagccccaccaataccaacaccctctctgttcttttaccagtcttccaggccagtgtcattaatggtcccctgcgctggccgctgggggacacctccagcctggaaggaggtgggcttccctcctggggccccccaccgaagaggagcaagcctcaagagaggcagaggctggcaggaaagacagcaagcagcatacttaattctgaccccaggtgttggggtcgtcggcagcccctctcccaccaccctgcagcagccaccaaccacagctcctatttcttcacccagtgccagggcttggcctcggctccaaacaggagcacagccaaaagctcatgcacacacacacacccccacacacaccccacccaacactccctggagctgccactccagcacaagcaagcactgaatcactttacctgttcctctcccctcaccctcaccctcctttccctgaggtagatgggccagccgggcctacaggtgagcgagcgggcaggggtgccctgttgaaccagcccagaacctgctcatggagggcatgccaggaataaactgatcccacccggtgtgacatccctttgtccccgcagttctgtgctcccctcccctgtattcagccccgccaaccacctggaactcaccccacacagcttctggtgaccgaggatcttgccaggcccagaggatcttgccaggcccaggacggctcctctggcccttgcctctacccttcccctcctcccaggtgaagtacccggcctcagaggagggaccaaagcccaacttggatgctgtgtctgagcaggaaggcagagagcccccccacagcctgcttctccaggaaggaaactggcctggagggatgagggactggggagggtctctgagaaaggtggggaagacctgaggttagagcccaggcttcctgggtcctgtccatctccccccaccttccgtgccctgggatcattctctatggacgagactcttccctcacctgcccccaccctcagctgaccaaggattggggttggggtgctccctctgagccagcgctgtgaagggaaagatgctgtgcctgacccccccacaccccctcccgcacccaggcctggtgctgaggatctagctcttttcagtgtctgaacacaatctccaaaactgaaatgtatatttttgctaggagtcccagcttcctgtgtttttaatataaatagtgtacacagactgacagaactttaaataaatgggaattaaatatttaagactcgattgaggctgcctcggtttcctgcatgttcttcctgggggctgatgggacttgtccccctgcccctatagtgcacgaagggggaaacggggccgcgcgaaggagactttggggcacaggccaggagggttgatcgggctcccccgccacctggctgctcagcacttctcagtcagcgagggtggaggaccgagaagacactgccctaccccgcgcggagcatctgtggcacgagggggagaacaggtacgcgtgcccttggtgccgtggcacaaaccaggccggggtgaggagggccctggaggaagcagtccctgcacgtgagacccagcctttccttggccaacaccccggttttctcctctgcttccaggggggccatgctcgtagaggctccccgagagcccagccctcggcagctggtgaggcaacctcaagatgggtttcagtgctcgtccagccaggaaaacagacaccccaacacatttcaaaatgggggatttagtatgggaaatagtgacaaaaggattgaaaggcctgaaagaacaaaaagggggaaactgaggtcatccagacattagtaactgggcagacaccgtcactcccagggccgtgtgggcaatgggatcatctagcagccataggatacccacggacactgcagaaaccaggagcccaaagccactgtccggcgtgaccgtagaaccggagtccttgcacacgacacctagggctgctgggtggcctggaccaccaccgccgctctgccctggggacctcctccctcctgtcttccagtcggctgcctggacctcccgttgaaaaaaagcacctcaagggaggctagggaatgtagtttgcagacttccagcccccaaggtacagaggagcgcgagggggagtgggaatggagcccagatgagagcccagagccagtgattaactagccgccagctggagggggcggccccaggagacgcaagcttaaggccatggtcaagtctggctctagcctccctcttgtctcttgctggccagagcgatgtgaactccatcaagtcccatagggttcatctcagccaggagagtgacagtcccaggtgaataagaggatggaggaggaggaagaggaatgcttggaacaggggcatctctgaaactaatagccttgcttatgatggaaacttgtggtttgcttggtgtatttggctcaccaagtatccttcactcacatcaagtcgaagactggctcagctgttaatggctagtcctcttcccagcactaaagagttaagaatatgggatgccaaataactagctggcgcttagttcagggaggagaaagtaagtctgtttttgttgttacctggcttctggtgctgcaaacagcatcactttgctccagtaccttattattagtatcactaagtgatattctttattaagcacctattctgttgtcaggtatcctgcatgcatcatctcttaattctcaaccactaccctaaaggtaaatattatcacctgccatttcaccagtgaggatgcacaatgagagacattagcgagtgtgcctggtcactcagcttggaaaaggcatattcattcagggccctaggacctctgctgttttacccatgaggaaaacttggggagcaagtcgatctcttttcaatgttgctcaggacaaatgaatcaaatatttaaaagagaagaaagcaaccttaagagaatgagaagttactatctttgtaatagctctttaaaaccaatgcaataagggcacctgggtggctcagttggttaagtgactgccttcagctcaggtcagggattgagccctgcatcgggctcctccatcagcggtgagcctccttgtacctctccctctacctggctctctccctgcttgtttgggcactctctcttcctctctctctgtcaaattaatttttaaactcttttaaaaaataaaattaaaacttctgcaataactttattttaaaaagatggggcatgggatcctggggtggctcagtggtttagcgtctgccttcggctcaagtcatgatcccggagccctgggatccagcactgcatccagctccctgctcggtgggggagcctgcttctccctcttcctcgccctctccctcgccccctccctctgtctgtgctctctctcctgctcgctctctctcaaataaatgaaatctttttttttttaaatattttatttatttatttaggatagtcacagagagagagagagagaggcagagacataggcagagggagaagcaggctccatgcacgggagcccgacgtgggattcgatcccgggtctccaggatcgcgccctgggccaaaggcaggcgccaaaccgctgcgccacccagggatcccaaataaatgaaatcttaaaaaaaataagatgactaatattttcagcataggtggccacagaactggcattgtcacatgagcagagaggctgatggggaatgtgaacaggttgagtgtggggtttgtaggctgtctaatgggcaggtcctcactgacgcgaggttcgggtaaataggaggaggaggaagagaaagggctggtcatttagagggattcccagacttccagcttggtggatcagtgggatcctgcattcacactgggattccaggaagagggcgagactcaaagatgttgagcaggcagtgataatgcagagaaaaggctattaacactgtatccttttctttctccctctcatccatctttctctgcaagaaggaagctggtcctatgtaagctgatcacaggttgcccacaaacctctcctgtacctgacctttcacagagtgaaaagctgaaatttcggttgtggagaacttcctaatttcattagctagaaattagcaaatcctaaaccctctcttcagaactggacattgttctaacttggttatagagacacattttgggattatctcctttgctggtattattaaaacttagttcacaggcacctgggtggctcagtggttgagcgtctgcctttggttcaggtcctaggattcctgggatggggtcccgcatcaggctcccctcagggagcctgcttctccctttacctatgtctctgcctctctctgtctctcatgaataaaatctttaaaactaaaactaaagcaaaaaaaaaaaaactcagttcaaagaaggaaacagattcccagggtcactctgctggccaaagtagaccttgtgggacttagagaaaggcatccctaagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgtgttatgtacatcctatcaaccctacatgccagctttgagttttcctgttctaggagcaccggggctgaagggcatgggtcttctctccttctgccctctcatagccagatccgatgctgattcttcaagcaagggaatggctgctgccccttcaagtctgattgtatttatctgcaccagctaccagataaagccctcacctctgatcctcgctggactgagagtacgcagctgacctctgggagtgaggtggtaacagcaggcatatgggacagggaggctgctggtcatgtttatcataaatgtctgtgataaatgtaaaacccatacatgatgtccataatgataatggtgtctgctaagatgcggcatctttgtgctatgtacaacctgcccgaccttacgtgtcagccttgactctcttgttcctggggtaatggggatgaagctgatggattttcattgatttctttctctactcccagggcccaacagtgttcctaggaggcacagaacagcaggaagacgaagtgttcttcatggactgtgccctggccatggccttctggagttcagaactcttactaggtcccagttattctttttttttttttttttaagattctatttatttattcatgagagacacagagagagagagacagagacataggcagagggagaagcaggctccacgcagggagcccgacgtgggactcgaccccaggtctccaggatcagaccctagctaccttaaaattattttggggaaaaaaaaatttggctgcaatggaaatcagatccagctcaaaacattcctatgacttatcatactgttcaggggcgcctggctggctcagttggtagagcatgcaactcttgatctcagggtcatgagttcaagccccacattggatgtagagattacttaaaaacgaacaagatattcctttggcttacatactatttagagtgaaaaccaaagtattgcatcaaggtttcacaagagctggcccagttacctctctgacctcttctctgattactccccaggaagtacattctgctccagccacacttatgtctcagggcctttgcatgtgctctttcctctgcctgaaatgacctccccacagatgtctatctgttttgcctccttatcttcttcagttcatctcgcctgactacctacttaaagattacctcactgtgtctcgcttccttgctgtattcttcttgaaagcactaataacaatcaaacattctatcgttaacttattagttgtctctcctctctagagcgtcagcaacaatgaggagggtcactttgttttgctccctgagtccccaaccctaggtgatcagtaaaaatttattgaatgaatgaatgtgtgtagctgcagaagttgggagaatggtaaatgcagactggaacccaaagtagggttgatggatcctgggggggggctcttctcccctctctatatattcttatcttctgcagtgattcctcttctccccccacttcactagaagcttgccttctccagcagatttctttacactgaaaccttgggaggtagagtcctcctgggcccttataaacaacacaagacaagttggcttcttggacttggggaggaagttctcagcaaagcctttggccatagagtgttttaccaacctattctcaggcatagtgtatcaaatatttctggagaggactgaaacctggtgatgacagttgatggcctgtggaagaggtgatgtcaatgtggggtggtaaactgtgactaaatcttattgcaagggggcatgtggatggctcagtggttgagcatctgtctttggctcaggtcgtgatcctggagttctgggatcgagtcccacgtcagaataaacgtctccctctgcctatgtctctgcctctctctgggtctctcaagaataaatacattaaaaaaatattatcttctggagggtattatgctgagtgaagtaagtcagtcgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtccgtcgtgcctttctgaggccgcgcgggaatccggctggctctcggccgcggagccctcaggcccgcaggtggcaggtgccggaagaggatcgtcgccgcgtcagggcaggcgctggcgtcctgcgccctttcccgggtcctcgagaccgaggtcaggaaccagagcggcggcggctccgggcatggcggtctcgggggcggcacccgctccggcggagggcgcagactcggcgccctgggcacagctggaggcccccgcccagctcctgctgcgggcgctgcaggcggggccggacggagcgcggcgcggcctggggctgctgcgggcgctggccagtcgcggcggggagcccttcggttggggccgcatcctcgaggcgctgtgccgggaggagcccgtcgtggagggcccggactgtcgcctggagctgtaagtcgcctgctcgcggagcgccgcgttccggccgtgaggcggggggtggcgccacccactttctagatgaggagatcgaggcccgcagcccggcatccctgccgcgcaccccgggaggaggagcgcatcccacgggccttggtggaggaccgcctgggtgcggcgggagccgccagcctgcagcctgcgcgtggatgaggagctggaagccggtggactctaaggatctgaccgcatgcttcccgctccaaggcaatcgcactcatacctctagtgtacacgggagtaaaaatacgtacgttgtaaagtatacaaaagtagaaattgatttttaaaaatattttatttatttattcataagagtcacagacaggcagagacgcaggcagagggagaagcaggctccatacagggagcacgatgcgggactcgatcccgggtctccaggatcacgccctgagccgaaggcaggcgctaaaccactgagccacccaggtgtcccaaaaagaagaaatttaagctgtggtgacagaaggagtggctgaaggagtctgaaggagtggctttatgatgtcaaattttcaaagcgcagtatacattttagggcaaaatcacttttcttaaggatggtgttcttgataatttacagtttttgaggtgactttgaacttaacttttcttttctttctttctttctttttctttcttttttttcttttctttctttcttctttcctgtttctttcctgtttcttttttgcctctatgtgactgaatttctgctaggagcagaagggtcagctctgccattttcttatttgatgggcttcccttactggtattcagttccttttcggtcatctttataagctgtgtgtccatttagtgaggttggttttgttagagaacataattcagtatccataaattcatttaattatcctaagtaaccaaaatactggaagtagaaaaagtgacagaagtgtccccttcagcctctagggggctgaagagccgtctttgcactcagatgctcctctcagaattaggctggagactggactatgaagggccattccatacattaaatatttgtaatacttaatttctcatgttttagataagtagaagtggaaattctaatattgtcttcacacaccctactttgaatttgttttgagaaatgggtcaggagaggggcccctgggtggctagtcagttgagcttagggctcttgatctctgctcaggtcttgatctcagggtctccatctcagcgtcctgagtttaagtcccacagtgaactccaggctgggcatggagcctacttaaaaaaaaaaaaaaaaaaaagggggatccctgggtggctcagcggtttagcgcctgccttcagcccagggcatgatcctggggacccgggatccagtcccacgttgggctccctgcatggaacctgtttctccctctgcctctctctctctctctctctctctgtgtctctcatgaataaataaataaataaatctttaaaaaaagaaagaaagaaagaaagaaagaaagaaagaaagaaagaaaggaaagaaagaaagaaagaaagaaagaaagaaagaaagaaagaaagaaagaaagaaagaagaaagaaaagaaagaaaagaaagaaagaaagaaagaaagaaagaaagaaagaaagaaagaaagaaagaaaaagaaagaaagaaagaaagaaagaaagaaagaaagaagaaagaaagaaagaaagaaagaaagaaagaaagaaagaaagaaagaagaaagaaagaaagaaagaaagaaagaaagaaatgggtcaggggagctttctgcatccccaaattggaggccataaacatattcagctgtctggctttttctggacagaataagaggaggggaacttaatttggggtccctggttagaactttatttcagtataattggtttctttcataatcccgtgtattttattttctgcatttaacactctgataaggggattcatgcacacaaaaagttaagagcctttgaagtagggttttcccccagctctgtgcttctaaatatcctctaccagaaattgaccatcttttgaacttttaccttagttttctctctcacttagtgtttttcacgaagaaatcaaagtcaaatatttttttctctttcatacatcccagatgccccttgtatgtaatgacaagcagccctgaggaatcacatagagaggagcagaggtgtgatgccaggtgggcttggtgtacccatgacttgcttgccacaccagtaagcctcaggtcacacagcatctggatttgtgcatgacagacagctacattgctctgtccaaagtagcccttgcttatctctggacttatcctcagagagttaattcattcagtaaatgtgtacccgttgcctgctatggactgacgctgtgctgggtactgggacatggaggaaggagactgcctctgcctctcaggaactcaggtgacaggaatgtcagagctagatgtgaccttgtaagttccaggggattgctaaggggagtacagggctgcagagtaagcgctgcatcacatcctggaatattactatttttattttgggccttaatctatctttttttttttttttaagattttagttatttattcatgagagacacacagagagagagaggcagagacacaggcagagggagaagcagcccccatgcagggagcccgacgtgggactcgatcccgagtctccaggatcaggccctggactgaaggcaacgctaaacctctgagccacccagactgccccttttttttttttaaaaatttttatttatttatgatagtcacagagagagagagagagagagaggcaaagacacaggcagagggagaagcaggctccatgcaccgggagcctgatgtgggattctttttttttttttttttcttttttttatttatttatttattcatgaaagactgagagacatagagagagagagcgccagagacaaaggcagagggagaagcaggctccatgtaccgggagcccgatgtgggattcgattccgagtctccaggatcgcgccctgggccaaaggcaggcgctaaaccgctgcgccacccagggatcccgactgccccttttttaatctttttaagtaagcttccacccccccccccccccctggggaggttgaactcctgaccttgaaatcccgagtcccatactcccgggttgcctgggtgggtcaatccggggagtgggggattcataatctccggggcctgagtttgagccctggattgggtgtagagtttactttaaataaataattaaactcttaaacacacacacatacacacacacacaaaacagagtcacatactgaaccaaccaggcgcccctgaaggattttttttttaaagatttatttattatttatgatagacatagaaagagaggcagagacacaggaggagggagaagcaggctccatgcccggattcaatcccgggtctccagaatcatgccctgggccaaagtcaggcgctaaaccgctgagccacccagggatccctgaaggattatttttatgcaaagtttgggaagggagttttttttatgtaaaacaagcatggatcttttatagagtaggtttcaatgtggattttttttttaagattttatttattcatgagagacagagagagaggcagagacctaggcagagggagatgcaggttccctgggaggagcctgatatgggactttatccaggaccccaggatcactacctgagttgaaggcagctgctcaaccactgagccacccaggtacccctcaatgtggatttttttgagccaaaataggacacgtcaaaaaacagaacctagcccaaaatatatgaatacatgctcaattaaaaaaagaattgttaaaaaaaatttgaattgttcagagaacttttggctgtttaggaatagtaaaatgaactcaaactggcttaaccaccacaacaaaaaatacatgctcgatgaatgccttttgaatgactctcctgggcagccctggtggctcggcggtttagtgccaccttcaacccagggcctgatcctggagacctgggattgagtcccacgtcgggctccctgcatggagcctgcttctccctctgcctgtgtctctgcctctctctctctctctctctctctctctctgtctctcatgaataaataaataaaatcttaaaaaaaataaaaatgaatggctctcctgctgaccccttccatccaccctgacctaagggtactgcctcctagccaccctgtctgtccattgccacccagctttacccagtcttccctgtgctccttccagcaagatattcttaactgcttgtccttctgcccaggaagccactgctgctgcgcttgcccccgttatgccagaggaatctgatgtccctgctgatggctgttcggccattgttgcctgaaaatggactactccctgtgctgcagattgcacaacaaaaccaaagccctgaccctgatgcctggctctgggtcctgggggaattgctgcggagggatttgaacggtggggtatcgactgagggcgtgtctgtgctgtctaagagctgccagggacggctccaaggcctgtgtaggcggctgggccagggaggcaggaggctgaagttgctccaggttccagagcctgaagaggaagaagaggaggacaaggaggacagggacgctcagcaacctgggaaacgcagaaaggggcgagaggaaggacctaccagtcctgagggcgagtgtgcccccaaaaagttccgatgtttggaaggggaagaggaagaaggtcaggaggaggagagatgtgaacctgaatctttggaacccctggcagatggaggagatgccctacccattaagaaccagagtgtcagggccaagcccagtgaggctggtcagagtctggaggctgctaaggacctacctgagtgtttggagttgcccaaacctgtccaggtactagaatggggaggctgggtttagagtgatcctccaggagtggggggtttatccaggtgagggctcggtgggagactatttcccaactggggtaacaagtctatggagcaggggtaggggtgtggggttcagggaatatagtttctgctccatggactcccaagcaggaggtgggaagagttagtggagggggaaacctttggccctaatctacaacatgaggttaaaggatgccaggcaagaagagaagctcctctgcacagagggtgtggaatcatgccagcatccagcctgtcttcccaacctaagccctgggtctacccccattaggatgagtgcagaggggacaagtctagacagctgggttaccacgggccttgtctactatactttgagttcttaagctcctctcaaggtttaggcttcgctttcttgactctcttgaatcatccttgcccattagctcccactgatctggagccttctcgggggagggggctaggactgggccccgggaccacactgtgttgacagggacttggcagtgactgggcttttctctgcaggaccaggttcccagactgcagcagctgctcaagacgttgggggaggtaactggcccctgctcaccatcgcccttccactttctgtctagaccttagccaggcccagggaagcacaggctgtttggacaatgggggtcagagtgaaggtctgaagacaatcactgcaagggcttctcttggcccaaggacagatatgtcatctaaccccagacaagtccttctcctctggtagtgtccaggctcctcaccccccactctgccagaccaaggggtggtctctgacttgtcagagccgggacatgagatttgccttttccaggggttggagggtgccctgccggttgagctacagcttctccatgaatgcagtcccagccaggtgagtccaggaagactgcctggccctgagggtacatcccctctccccagccttgttccatttaggtctgtgtttccttgccttgtgtgggaatttggggagcggattttgttgggttctgtggtctcttgggtaaaggtcatcctttgtgctttagaccttggatcctcctcatagggcagctctccctgccttacgttaccttgggagtgtccttgccttactcattctgcttcccagttggcttgagacagcctagcagaggcagactgagtgtgtctgtggcctctcctgcttggtaggtggacctgctgtgtgcccagctgcagctcccacagctctccgatccagctctcctgcagctctgcacctggcttctgtccctttccccagatctcagcctcagcaatgctactgttctgaccaagagcctctttcttagacgggtaggtggcattgtgatacacctggcatggtagggactatggggaagagcatctgagccctcagaagggtggtgcttgggagagggggttccccaccttgtaaggcatctggactctcagaggcagcctggggcaggcggagggcatggacctccaggccatctatccacatgccatctaattcctctctcttgagctccagatccttccaggagctgaagggatttgggagctctgtgtcatttccaatgggtgaatccatgtgagttctagataaaagaacttttgtatgggacacctgggtggctcagcagttgagcatctgcctttggcttagggcatgatcccggagtccgaggatcgattcccatgcccggctccctgcatggagactgcttctccttccacctgtgtctctgcctctctctgtgtgtctcatgaataaataaataaataaaatctttaaaaacaaaacacaaaagttctttttttttttttttaagattttatttatttattcatgagagacacacagagagaggcagagacacaggcagagggagaagcaggctccacgcagggagccgaacgtgggacttgatcctgggactctgggatcagatcccgagccgaaggcagatgctcaactgctgagccacccaggggtcccgaacttttgtgttttctttgtaacatgtatcaccgtctgaaatatgtgtctgacaaacattcattcaaggaaggaagaaatgaattaattaatatttccttccccattggctgtagattctctccctgacttcctcagcctcccgcctgctcatgactgcgctgaccgccttctgtgccaagtatgcctatcctgtctgcagagccctccttggccctgtgctccaggccccgggaacaggtaattctggaaccagccctgggcccagtagctctgccctttctcttcccaccacccttcactcctggggggccctggcagttgtgtattcagtcaataaggctgccttgcttccctgactatgctcccctgtaatgagccaggcattgtgttctatcctctcctgccatttttccccagacttcccgccctgttgtccccttcccaggtccagctcaaacagagttactgtgttgccttatgaaggaagaggccctggagccagacgcacaggttctgatgctggggtgagtgtacacgcctccatgctgtccccgcccctaccccctcccactggccaagcctgctcttggcattctggagttggagctgcctggataccaggccctgtacctgaaagacaggtggcggcacagcggaggcccctctcgctgttgcctgagccgggctttgtgcctccccgccacagttgccactctgtgaccctgcccaagccccaggttcttccagcattccaggccagatgcctggggggacacagagaaggggctggtggtccacacttgagctgttcacagcgtagctggaacatggcacagtggttaaggcactggctgtggatccgggaagacaggattttaaatcccagccttgccttgtgtgaattcagacaggtttctccatctctctgagtcttctgtttcctcatatgaaaaatgggcataatattcactctaggatttttctagatgttaaatgtgataatgcatatagacatcagcacagtaagtgctcaaaaattgttattaaatttgtgttaaatttgggtattaaaactggggagtcaagatccagccatgtagaaacaaatgagtagctaagacccaattgacactaacatgaaatataaatgctaactctctggggcacctgggtggctcaataggttaagcatctgccttctactcaggtcatgatcctagggtcctgggatcaggtcccatgtcaggctccctgatcagtggggagcctgcttctccctctccctctgcctactgctccccctctctgtcaaataaataaaatattttttttaaaaataaaataaacactaactctcacacgagaagggaacagttgtttaaatgtcagccaccacttaccgagtcctttctctgtgctttatttattttttaaagaatgtatttattcatgagagacacagagagagagagagagagagaggcagagggagaagcaggctccatgcagggagcctgatgtgggacttgatcctgggtccccaggatcacaccctgggccaaaggcaggctaaacctctgagccacccaggctgctcccttctctgtgctttagattcattttctcaggaagtgctcatgcagtgctgtcaggtgggtgctattagagacagaaaacctaaagctcagagctgctaagggacatgggacaaaggtcacacagccagcaagtattaaagcctgggatcagattcaaggcccagcacccaagaagccacacttcttctgtgtgacacactgcctctccacacaagtggaagatggcgctgtagcttgggaagcactgctggagtgggcctccccgtggattgggctctgcagggaaggctgccctttctggaaagccttgtagatatctcactgcaccatcatcctcttccctgggtcaccctcaccttttgtactcaagaggcactcttcactcctgctcattttttagggaaccttatacacttcacatcagatcctctgttatcctctccaggagtcttgtattgtagccttcctagcaccgagtagtggctggctgctgccagcatcagggggctctgactatttcctctgttggctggggatctaggctgtccccagggccttgccctgccttaaggtaggaacagtaggtacccaggcgtgcactgttctcagcggggcctgtgctttttgcagacagatcttagagctgccctggaaggaggagactttcttggtgttgcagtcactcctggaacggcaggtgagcagactgccttgaagggtagtccaatgctatggacaggcatgggcctcccgggttgctgatccctccaggggtggcgagcagagcagctgccccacagcaaggtatgttacacggtgggtgagtcctggggcttaaaaagctgagagcagaaagctgaccacactgtacatcctggctctgctacctactagctgcgtggccttggggagggaccttttgatgtgtgtgtgtgaattttcttttattgttgagtacatcatagattcctatgttcacaagttttcaagctcaaaggatacagtgaaccatccatctaggttcccctctccagggctcatcactgttactagtttcaggggaaccctcccagaggtgcttttatgtacaaggacacatgtttaagtttactttttccctgcttttttttttaagatttatttcttttctttatttttaaaaatatttaattaatttatttgagagagagagagagcagaagaaggggaaatggcagaaggagaaacagactcctcactgagcggggagcctgatgtggagcttgatcccaggaccctgagatcattacccgacccaaaggcagacacttaactgactgagccacccaggtgccccaacatttatttattttagagacagcatggggcagtagcagggggtggggagtcagaggtaaagagaaactccaagcaaactctgctgagtgtgggagcctgacttggggctcaatctcctgaccctaagatcataactgagccgaaaccaagagtcggatgctcaaccaactgtgccagccacatgcccctactttttctctacttttttcatggatggcaacataccaagctcagtgctctgtactttgcttttttaacctagcagtatattttggcaatgtttccatatcactacctaaagttttgcctcatttgtttataacttaggtggttgacctaacctttttatgcctcagtctccccatctgcaaaaggagaatgatgatcatacctgccacacaaggccagggtgatgttgaaatggataattagtgtaagtgctcagaacagtgccctgtgcatgataagtatttattaaattattaaggacaactattgttatgctggcagtaccccctgggactccaaacagggctgagatgtatatgccaggctttatgtgcattatctcatttaatatttttcatcatctttagcgttagatgtcatgagccccattttacagatgcagaaactgaggcttcagtttggttatgtgacctgcctggggttacctaggctggaagtggtagagtttgaaattgaatctggagccctttcttactctgttgtcccgtcttccaatgtgtgcaggtggagataactcccgagaagttcagtgtgttgatggagaagctctgtagagaggggccagcagccaccacttccatggcctatgccaagctcatgctgacagtgatgaccaagtatcaggccagtgtgagtactggaagggccatgagggctggtcctgctgctctgagtgtgcccacgagggtgtacatctagatgttggccagggaagacaccctgaatgttagccagggaaactacaagttcaagcttcagagtggggaatgagactgctaggaggtcgttaatgcaggcaacactgccgtgggccagatggtgagtgaggcactggggaatcgacagtgaccatagcacagttcctgtccttgacttgacattctccaccagtgccaggctagtgaggtaggagagatgataaccagatcggcatcacatctggaaagatgagaggtgggggcggagggtgcttttggtggtggtggtggtggtggaggaagcaactaaaccttgtttgtggttgggacaggcttctcaattctgaaagggtgagtagtggtcaagggccaagactgaggaaaggacatttcaggcaaaggaaatagtataaactgtgagcatccagggggatctacagatggtagcttcggcctgaaaacatgagagtggatgatggtaggggtgaggttctaggtcagagttaaaacaccgcgaggtaatattgcagagcctctgctatgtcttaggcactgtttattttttttttttttttaatttttatttatttatgatagtcacagagagagagagaggcacagagacacaggcagagggagaagcaggctccatgcaccgggagcctgatgtgggattcgatcccgggtctccaggatcgcgccctgggccaaaggcaggcgccaaaccgctgcgccacccagggatcccttaggcactgtttaaagccctttgcttatgtggccttgctagtttatttcaggtgttagcccaatgagaagatactattaacagctccattttatagatgaggaaattgagatccagagaggttaaagtgacctgcctaggatgacgtggccaggccgtgccatcatcatatggaagaccctctaggttatgaggaggatcgtggactttatcttgaaggtcaagtgtccctacctttttgggggagtcacaggcccatttgatgatttaatgaaagctatagatcctccaagaaaaatgaaaaatctgaacacatgttatgcacaatttcaggagaatcctggatcctctggagaccctgtagatcctggaggaagggcatccaatatgagacatttatagttaccccagggcccagctgaagctggggtgacttggtcagatttgcattttagaaagaagcctctggcatctgtaaggagtgggaatcggagagaagatatagggcagagacctgtcaggaggctgtagcaaaaggtcagggaagatatagtgtggccccgaagaaatgtggcagccacagtagagtatctctgtccctcagttttctcatctctaaaatgggagggttgtgcagattacatgaagttatgtttataaagtgttgctacatagtaagcacccaatcattgtcaagtgttattaatgttattaatgcagctgacttagtaagttagtatagttgtatagttcatatttggtcccaggtccacttgaatacaaagaccttgcataatcatgaagtaatgcatttagatatctcctccattgtccttgtgtcctggattcctctctccttcctaaacagggacatgggcagaggggaaaggggaaggatcagctgctggagtcctgatatgattcttccttctccccagatcactgagatccagaggctgggcctggccacagccctagagctcaataccactttcctgaggaagtccctgcaggccgccctgagacatctgggcccctgaccatccaccaagagaccacactcctggagctcccccaccagctgcctgaagaatacttttgccctcagcaccatcccctgaccccttgtctggggataaaggctgaggctggccatcccaagtgtcaggtgccttcctgctccaggatgcagagaggccacttggggggtgcttcctgggctgagggggctggatgagctttatttcccagggctgctgacctttgggctcactctttgtcactttttcatcaggtgatggggacagaaactttctgaaaggcctcagtagggtcagagcagaccaagagtagatgaatgatgcttctggagccctgagatgacctgtgtgctcagcatgaatatcttgcacaggggcgcctggatggctcagttggttaagtgtttgcctttggctcaagtcatgatctcagggtcctgggattgagccctgcatctggctctttgctcagcaaggaatctgcttctccctttccctctgtgcttgtgcactcgctctctctcaaataaataatcattaaaaaaatatattttgcactcaagtatatgttacaaccctctgtgttctgacttggatgataatttattaaaaagcaggggtttggggcacctgggtggctcagttggctaagtgtctgccttagactcaggtcattatcccagggtcctgggatagagcccccagtctgggcttcctgctcagtggggagtccgcttctccccctccccatccttctgcttgtgtgcacttactttctctcaaataaaatcttaaaaaacaaaacaaaacaggtatgccttcctattaactctgggtatttgtggaaaaccaacagacaccaccaccactcaccctacttggtgacagggggcatctttcctggtgaaccattctgcaaggggaaggtgccagagttgtccagttcatttattcatgttctgtgcggcattgtgtgacaccactcacttctgccctatcagggctgttttttgagtaggggaagtgtgcccgggacagaactttcatgacatttcccttcttaacgatttgctctgaaagcatgagccccagagcaagatgagggagaggttagggggaaagcctgcttttgagacgaagcaggcgcgcgaaggcgtgaagggacaaataggcgggagctacatgctctcagtggccatcccggtgaggtacccagggcaagcctcttacgttcctggcagcagcgggcgccactgggtacagtctcccggtgccacggggcgcacaggacccccgccccgccccgccccgcctcgcctcggagccagcctagctgtgctacgcgcggcagcgccctccagcggccatggacggcggcgcgacccgagattgagcggcctggccgcgctccggagggaaaccacgggcaaaggcatctcgcgagaacaagagccttatttgagcgcacgcgcgagttgaagcactctcttttccggttactgcggcgcgagctaccatgaggtgagtggcgcttggggagccatccaccgtcatccgcggttactggcaccttggtagggagggaggcttgcgggccgaatctgggggtccgtgcccctgcttcgccgagaggcatttctggtaaggtgtctcttgctcggagcctgcatcggtcgcacctaggtcgccggacgtggtgcccggattccccgtggggggcgttccggccacgccgagggtgttgatgcgggccgcccaggtgctgagcgctcgcctggcttctgtctcgcagcagcaaagtctcccgcgacaccctgtacgaggcggtgcgggaggtcctgcacgggaaccagcgcaagcgccggaagtaagccgggcctcggcggggtgggggtggggctcgggtggaggggcggcggcctgattctgttgcgttccctaaggtttctggagacggtggagctgcagatcagcctgaagaactatgaccctcagaaggacaaacgcttctcgggcaccgtcaggttggcaccgttctgcccccacccggccctccgggccctcccgcctgggcctcctgttgagcttgaggcgggcgggcacggacgcgcccgggcagttcagaccccctgccccgggcagccgtggctggacggacccccaccctgggtcttaaaataagaggggaggcgtggggaggccttggccaagcccgccggctagtttgagaagccagactagctgttggtgaaagtggacgtgctgggtaaggctctgtaactgcagcggccccggaccccttcgcctgcctctggagctccgggctgggcctgaccggtgctgttcccctccccgcaaacgcaggcttaagtccaccccccgccccaagttttctgtgtgtgttttgggggaccagcaacactgtgatgaggccaaggcagtggacattccccacatggacattgaagcgctgaagaaactcaacaagaataaaaaactagtcaaaaagctgggtgagtgtggcttggggtggctttgttttccggcagacagttgtcaccggagtggtagaaaagtgacattgccatttggattttaaaatgattggggggcgggggcagaatcatggaaaggatctgttatgggggggggtcccttgagtgagtgatgcttttatatataatcttttaaggttcctttttattatttgctttgaggagtctttctgaacaggcaagttcccctaagtcgactagtgaggtgctgctatgttctgaattgggatttctagttaaagttctttttttttttttttctccccacgcatctttatcataagtagtctaagcattttacaaaaaggaagtaggtgccccacttttcatgtaatagaaaagttgcaggcattgaaccccaggagtcttaaccagcgtgtgcatctactattggaacgtgaagagagccggtcagcctgggtttccaaagctaggttttctatgaatgtcgggccagtaaaaggccagggggtagggacaagctggaataaggagaggattaaaaagacgttgtacgtggagagagtacagtaattggttagaggctactttggtggttggttgacaaaactccgttcagaggttgcttttgggggccggatcctgagcatccgatggcttctttttaccagccaagaagtatgatgcctttttggcttcagaatctctgatcaagcagattccacgaatcctgggtccaggcctgaataaagctggcaagttcccttccttgctgacccacaatgagaacatggtggccaaagtggatgaagtgaagtccaccatcaaattccagatgaagaaggtaagaaggtctgactgggttgcagagattaagctttggtgatggtggcactaccagtcccaaagttcatccatgttctctgaatgggagtcccaggtcacatttctacagatacataagacatgtgacagtcactgagcagggttgaggctttccacgtgcctgtggttttcctgccctggggtccgggtactgttcactaggtcatcggagtggggagggatgggtcatttggcttctagatgtgcctactctgactcttcggtttggccgccggcctgatttgactggactctctcacaggtgctatgtctggcagtggctgttggccacgtgaagatgacggacgatgagcttgtgtacaacatccacttagctgtcaatttcctggtgtccttgctcaagaagaattggcagaacgtccgggctttgtacatcaagagcaccatgggcaaaccccagcgcctttactgagaccatttaataaatcctagtgctaccgttactatctgcctgtgactggggggggggggggggctctgtgaactgactgaccttccgtagcggtacactgatgaaggaaggttctggcacccagtgtgggtgggcctgttctgcatactgcaaaccaggaagtgcattccatctaccttcagaattgtgtagtctagtaagactctagttcgggtctcttggatacttgatgataacctgctaaccggggttgaagctggtctgaatcctgagaggcagatctgagctagtgctcccaagtcttgtgctcctgctgccgactcctggaaggaggggttggacccacacgtggaggacatagactcagtccttcacagcatgcttaatatatggcctgcttctccttactccatggcttcttgttttgtgctaagttgtgcatttgggctcgtctgtaggaatcacaaagttccaaatggagattgggttcctagattgttcagataggattgatccacaacttgatttgcttgtctggcctcaaatacaccatatcgagggtagtgatttactcatgtttggggaaacacaagtaggagacctgtacgatgctgctgaattcactactgctgttttctaggagcttattagcaaatggggcagaattaggctatggaaatttccaggccctccatcctcctgacctgaggcacttccctgttggtaggtttgtttggtttttaagacttcattttattcccgagagaccagccgagacaagttcatccctccatcttttaatatagttgaaaggctacagacctcacacttggttttggctcaggtcatgaccttaggttgtaagattgagtcccttgtcaggctccaggctgaggtggagtctcctttaaaaaaggctaatccagggcagcctgggtggctcagcggtttagcgttgcctttagcccagggcagcccagggcgtgatcctggagtcctgggatccagtcctaaatcgggctcccaaataaataaataaaaaatattttaaaaaataaataaataaaaaatatttaaaaaaaaaaaaaatccctgggtggcgcagcggtttggcgcctgcctttggcccagggcgcgatcctggagacccgggatcgaatcccacgtcgggctcccggtgcatggagcctgcttctccctctgcctgtgtctctgcctctctctctctctctctctctctctctctctctctctctctctctctctctgtgtgtgtgtgtgactatcgtaaataaataaataaaaaatatttaaaaaaaaataaataaataaatcgggctccctacatggagcctgcttctccttctgtctctgcctccctcctctctcatgaataaaatttttaattttgtttttaaggttctatttattcatgagaaacatcgggagaagcaggctccctgtggagagcccaatgtgggactccatcccaggaccccgggatcacgccctgggcagaaggcggcactaaaccgccgagccactcggggatcccgatgaataaattttaaaaaggctaatccaaagcataaataaaatgtacctcaaaacaagctcgaacaaagaacacaaggcttttgccaaagatcttggggtggttttcttttttctattttagcttttaataatttagtaattttgcttacaggtaaaatagttataacctaatcttgggatgagccctgaatttggtttctcaaggttactgggcatagttgctccttctggtctgttactacagtattaggagtgataaaatatctaggcttgtcaatgttccagatgggtaaggaaagggaaaagttggcgtataagaactagctagggggggcagcccccggtggcacagcggtttagcgccgcctgcagcccagggcgtgatcctggagaccctggatagagtcccatgtggggctccctgcgtggagcctgcttctccctccgcctgtgtctctgcctctgcatttctatgaataagtaaataaaatcctaaaaaaaaaaaaaaaaacaactagatagagggcagcccaggtggctcagcggtttagcgctgccttcagcccagggccagatcttggagactcaggatcgagtcctgcatcgggctccctgcatggagcctgcttctccctctgcctgtgtctctgcctctctctctgtgtctctcaggaataaataaaaaatcttaaaaacaaaaagaactagctaggatctattgcgcctgggtggctttactctgttgagtgtgtctgacttaggctctggcctcaatcccagctttgggctcaggctccgtgctcagtgggagtctgcttctcctccctctgcccctcctccctgcttttgttctctctcaaaatctttttttttttttttttttttaagattttatttattcatgagacagagagagaggcagagacacaggcagagggagaagcaggctccatgcagggagcctgacgtgggactcctggatcccgggatcacgaccagagcccaaggcagataaatgctcaaccactgaaccaccgaggtgcccctcaaaatcttaaaaagaagaaaaacaaaactaattaggacccggtgctattgaaaggaaaaagtttaggcacagtaagagtggaagtttatcagaatgttggccatgcttaattctgggaggaaaaaaaattatctgggattttctgaagttctgtaagattctgagagtgcttgagagcacaagctggggaaagggtagagggagaggctgactctcctgcgaagcagataacctgacacagggctcgattccaggacctcaggatcatgacctgagctgaagacatttaacagcgaaggcacctaatcacaaaacagaagacattactaaagaaaatcaggtattttgatgactggaggcatgtaagcaggttacaaacgtgaatacacctgccagcctcctgctcttaggcactgagtacagcaagagagcaggtctgagagccacggggcggaagcctaaaactgaagtaccccctcaagttggctaagatgggtcctagctgcaccttagctgccaatcctcagggtgtggggggggggcgggggggacagggggcctgagccaagaccagggagacgtttctgttcctgccagaaaccgtgctgtcctgccaatagctggagccaagggtttccggggcggtgtctcctgacctcacgggtacctacagccgactggctgcgaggagaccagccacgtggttgcctgcgggcggggcccctcccgcgcctgagtttgaatcccagttctcccattcaggaggccctggagcctgtggagcccgtctattctctaaacgctgttttctcacctgaaagcgcagatgatgatgcttaaaagaccgtagtaccaaaatcaaaggatgacacgctttgcacggtgccgggcacttcgtactcagacggcagccgtaagcgggcaatcccgcgggctgcgcacgtccggggcggccggcgcacagcgagctgtttgggtgcggatgaacgatgaacggggagaaaaggtggcttcagaactagtcacgccctcccgtttgaaatgagccaaggattaaacatttttaaatagatttggaaactctaggggaaggtagtggatgccttagaaatattcgggaacttgaggggcgcctgggtggctcagtcagttaagcatctgccttggctcctgtcctggtccgaggttgagcctgcccggggctcgcggctccacgtggtctgcccctgccctccccactactgcgcacaggtgcgcgctctcgctcaaataaaatcttaaaaaaaaaaaaaaaaaaaaaaaaaaaagcccaatttgggaacttgagccttcctggatattgacttgaatcacctggctttaaaacccactcattgggaaccctgggtggcgcagcggtttggcgcctgcctttggcccggggcgcgatcctggagacccgggatcgaatcccacgtcgggctcccggtgcatggagcctgcttctccctctgcctgtgtctctgcctctctctctctgtgtgtgactatcataaataaatttaaaaaaaattaaaaataaaacccactcattctatcaagccttacgtactgggtgggggtccttaagaaccaactatattagacaaagctgactcactccttcccgcggggctgtggggcatctggagccctggtgcggctctccagaagcccagcgccggcaggaaggaaggggacgcagaagggcaagcaaacggaagacgtgtgcaggccgactgagcccgcctctaatgaaggccaagctagttcaaccaagccccagtttctggggcaatgagcctaaagctcagtggcacccgagttaggattcaggcttcagctctctgggagcccgtcctcgggcatctgtgatgcggggaaatcaagagcccgtgaaacctcacaacggtgcactcctccctcttccctgggaacatcagaacagaaatggggcagaaagaactacagtcccgatctttggggtccatccatcttggcccctccttacggcaggggagagccacaaccaggagaggatcctgggctttgggctcacaggactcagcttttttttttttttttttttaagattttatttatttattcatgagagacacaagagtgagagcgagacaggcagaggcagagagagaagcaggctccaggcagggaggctgatgtgggactcaatcccgggtctccaggatcacctgagtcaaagggaagcgctcaaccgctgagccacccgggtgtcccaaggctcacctacttatattctggttccttccttactttgggacctcaaaactagttatccctgacctttggtttgttacactgtatggggagggtaggtgaggaggtagcaggatggggttggggggagacaaggaggccagccctatttcacctgcgatttctgcatgagacctacatgattctaaaggaaattatgcgaacactgctgactctgggagtgtgaaggcagtgacacacgtgacgatgcctcaacagcacccagtagatataattaaccattagtctagagatgagattttgcatccagtcccaggcctggtgcatggcgggtcgttcataaaccactttgactccaggaccccacccacctgcctggggctccagcactgtccccatcctgcaagtgacagtctggggtccttccaatgctgtggactaagacaaaagaccacctgattatttaaatagtctaccaggtgcatggacttgggagccaagctaaccagattcaaatcttgggtgtagccagtgactgactgggtgaagagagcgtttaatttcagtctgtttctccatctgcagtcttggaggttggaccagaatgatctataagactctagattctggagtagggctgccagatttagcaaatgaaaatacaggatgctcatttaaatttgaatttcagggacacctgagtggctcagacggttaagccttcggttcaggtcatgatcccggagtcctggggatcctggagtcccggggagtcctgggatcaagccccacatggcgggggtggaggggggtagttgggaggggggtagaggagtgtgtgtgtgtgtgtgtgggggggggggtccctgctcagcggggagtctgcttctccctctgtccctccccttgtttgtgctctatctcaaataaatgatctttaaaaaaattttaaaacatttgaaatttgaatttcaggtaaacaaggcatgtcctgtcaccatccccactctgtggtctctgctataggagcagaggacggctcagaggggagagcagggcttccccaggcggacaagaacaggttggaatctggctctgcctgcaagccagggctcatcctccttgagctctcttttctgctctaaagtgaagacaggacagtgagaaccggaagtagccaccacgaagaccttgggcaagtcccttcactcagagacaatgcaacaacagaacctaggccagcactgggcacatttcagcactcaacttggcgggagggggtgggggaaaggaagtatgcgaagctttcatgggctcttcgaatcctacctattctgaatgggggtttggcatggggtcccccagcacagacggggcagggtggggtgaccgaccaggccctaacctggcagaaacacccacacgcggggaacccgggtggctcagtggtttagtgctgccttcagcccaaggcctgatcctggagacctgggattgagtcccacgtcgggctccccgcatggagcctgcttctccctctgcctgggtctctgcctctctctctctctcatgaatgaataaataaataatctttaaaaaacaaaacaaaacacccacacgaaactaatccaacccagagaggtctggcacacgctggacacactattaacccacaaacaaataactttaatttttttctttttttttttttttttgagcaggagccgggcctggagggcccctaccccagccctgcgccacatttacgatataacccatcacagctggatttaaaaaatacacaaaaaaatataatatacattataaaacctaggttgagtttggaagtggcctgagcgatatgcaaactgtgaagacctgcaggaagctcgggggtgggcagtgcaaggaagggaaggggcacagtacttcatacgacactcatgaatgcccagaggcggccagtggacggacaagccactctggccaaggggcttggtggtcgggaaggggtagcagggaaaggattgaccttcagtcccagaactgggtttggggagctgctgctccaggtctgggagttggaggcggagacagacataagggagtggtgcccaccgaggcttcaccaaacccaggtcttgggcatttgaaaatatcaaatcctgctgctaccccttgtccctgggacactggtcagcccaggggcctcctcctgtcaggacggtgctgaggggctcaggcaccggctctgagccagggcagcttggaggcgttggcacaggtggacaggggacaccgaacaggtgccaggtatctgctgcgcctcttttcctgccaagtcagaagcagctgctcccctgggaggaggcccccaacctgtgctggccctgggccccagaacagaccatctctcccacccccagcggctggcaccccccctacacgccagggaggtagtgtagacctgggctctggggccagatggccctgggtgagaatcccagctctggcccaccccttgcatgggcccctcaacttctcgggatctcagcccatcacaggagacaccaagactcacactccccttggtctgacaatggcaccaggtgcacagggggcctagcaccaggcccagcacacagcaggtgcaagaaagtgggggcccctctctcttcttctcaacctaaccccaactcaaccctctccttcccagggcctctgccctgggacccccttggtctccatcccgtcctcccctgcaggccacacatgccggagcccgaaggggtcctctcactcactggaggccgggcagagccagggggtgttcagtggccagggcaggctgcccccccactgagccctcctctcttctcccacagttaaagcgcagaacagtggcagggagtgtgtgtgctgggggtggggtggaggcctcctgggtcctgggcccgaggcctggccggcgggggagtcctcaatcccagacctccggcagggggccaggcaggtgtgtggaaagctgcttgtcctggatcctggtgctgggggcagaggggagcctagtctttgacgagcttgtagacgtggtgctgagccccgtgctcgctggtggagacttcaaagacgaaagcgatgacgaggagggtctcttgggagtcccggctcgtgaccacctgggggccaggtagggaggattcagggggtcaggaggcacagggccccgcggtgtaggggccgacaaggccctctcctttctggacagccgtctcctcacctgccccccgcccccggcggcgcccccacctgcaggatggtgaagttctccagcacgctgttcatcatgtacttctcgggcaggtgcttcagcttgtggatgaaattgatcatgtactcgcacatgggggagcggtggatgcggtacacaaagcgcccgttctccagcctggcgtactccgtctacgcagggccacggggaaggcgtcacccagagtggctgctcccagccctgccgtgccaccctgggcccccactcacctctaccttctccaccacctgcttgccaaacgagcacaccttggtggagacgctgatggtcatgctgtcggtggagctgtactgggagctgaccccatagaaggctcccgggccctcctggatggtgctgttgaggtcggcctggggggcggcgagcaagggtggtgtcaggtgtgggcagaggcaggcggttgggggtgggagggggcttccactgcacatctgggggatgggactgtcgggagcagagagggccgctcacccagaacttgacgaggaagaaggcattagggggccccttctcatagagttccttcagtccacccttcttctcagggaacttgtcatagatctgacgcacgtccacggcctctagaggcgggtctgagaaggcggggttggtctggccgatgtgcacaaataggtgtttgctgtactgtggggagggcccagtgcggggtcaggagagagcccacgggcacggccggagggccgcacagggatgctgtccctgggctgagggcccgcaccgccgccaaggtctccccaggttgcgcagaccctcacccccagccacaggcacgttaccgtgtcggggtctcgctgcacctccatgaaggcagagtactcgaggagccgcagccgggaggaggcgatggtgcggtcctgccacacgggcgcagaggcagcagctggggggagcggggtcaggggctcgtaacctgggagggcgagacggaccctcatctgcatgggcccaagcgcctgctcacatatggggctgccccagcggcacggagccatcatgtgaactagaaaaacggcgcccttttgggtacaaacacgggctgggttccgaccctctgtcatgtctcctggtacaatgtacaacctgcacgactgtgcatggtggccccagtggtatacatggaggggttccatatgtcactgttaatatgtgttcaaacagaaaatacagacaagtaaaaagggacaaataaaagttatccagaaccccaacacctagccagagtgaaactctgctaagattttggtgtatttccataacaagaattttataaatatatataaatctataggatcttcattggtatgcacttgtgtagcaaagttctggaagcaacatcatgaaaggtaagaggccggttcccggcctgtcccaatcccctgtagacaccacccacttctccctcccagcacaaaagtgtgcgcagccttgggcaccctactcttctgagcagctgtgtggaggagcaggggcggcggtggcagtcttgtgtggaacttactgctgagcgttggcggcaggggcggctggatggggtaggctggctgtgcaaagggcttgatgctgcagataggagcacagcctggttagagggtcatcccctaaccccacctgccacccggccccatcacctggagtaacatctggtttcaacagggagccagccagcctctctgcaaaggcccagaaatgcacgctgacaaagctaactcaccagcttctggttttctccatgtttgagcttttatgaaatcctgctgcatctcacaactgaggtgcacgcttaatgtgctctttcaaccccaccccgagagcggctcattacactgagggtgtgtgtctgaggatgaaagtcctctcagaactgagggaacccagcaccctccactcccccatgtgcagtctcagagaccgaccaggagagcaactgggtgaggagtagctgaaggatgaatgacaagcaggtgagaaggctgatgagtgaacagataggaatgaacggacagatgcactgctggtgctcctccttcctctatttttgaattgagactttgctggaagccagctcccaggggaagtccagtggggccgccagggaccagactgtgagaaggatgtcccacgatactcactcctgagagggtccaggctgctgtcccaggagaggggggctgctccagaactgcagagatgagacaaatcccagtggcccctcagcatccacgacccccaccacagcccagccccgaagtcaccccctcacctcagccccacctcccaggccccctgtacccgtgaggaagtggagaagacggcctggggcagaggggagggcgggctgaacttgttctgtaggacactggcagagacgatctgggcggatgacatggatgccatgctctggagggctttgtccttggagacctggtcctggggaggggagaggccgtgtgaggccgaggaggcggcagggccaggctggagacaaggctggggctgccccagggcccctcccaggccctcagactctgctgtgtgggcttgggagagtctgggcccctgcctgggcctgtttcctaagtgtacatcacccctctgagcatggtccaccatgagaaagatttttattttattccataacccgatacctatccaaacacttccccttatgttgtgtcatgaaccctcatatttcctattccatctcaccagtggctctgagtatcgtccgtggagcaacggcaccagcatcatttggaagctggttagaaatgcaaattctccagccccggcccagacccactgattcagaaactctgggggtgaagcccagaaatctgtcttcgctggccctgatggcagttctgatgcacgatgaagtttgagaaccactatatttcatttttaaaaaatgtcagttgccaacctaactaaattgatttcataattcatattttgaaaatcccttgttaggtgctctccctcacccccacctcgtcccccagtggaggggcaggatacttaccaggttcatggcctgtgaaggagagggaaggtacattagaaaaggcacaggtcaaggcaggtgtagggtgggggcgtgtcatctcaccccccctccactcaatggccatctggctctcgagtctgaggaaggtaggggggctcagaggtagctgtgtacccttcccccaccccactgctccccagagggagggcttgctggctgggggtgccctgaaaagggcaggatggagacccagatggtggacaagctggtaccctgggtctgtgcatgccccctggagctgtgatataagcacagggcctggagcggggggcccagtctgctgcgcagctgtggaacagggagaagacacagcctacgggggccccgagcccacgttctgagatcctcagctgcaaagcagccaggattgagcatccagtgcaaggaaaagcccaccacaaggactgtgccagccaatgtgcccgggtctcctccctgcccacccggagacccggtgcagttaacaagcagcaattaggaggaaggagggaaaggaaaaagaagaagaaaagaggtgggcctcagtggcctccagacagtcctcctctccctccactgcatggctggctgtccccccgggctcctgcttagtccccaggggccgcagcctcctgtagcccaaagtggactttgggctccatgccgtcgtatacgtttgaggcaccctccaccccgccacggctctcccgccacctctctgccctacgctgggctcagaagacccggccgggccaagcggcaggggacccctaccttcaacttggactgaatctctcgagatttccgcctggctagaacctgcaagtggctagagacctgtagaaagagagagaaagagagaaaaagagcagaaagggcagaaaaggcaagaacagagcttcagccagaaaagaggcacagtggggccagagagctggccgcggcggaggcctgagctgtgcagcgatagcagtggaggcgctgaggagggactggaggccctagtcaggcgcccaacgtaccttgatgccaacctggtactcccgcaccttcttccgagctagaacctgtatgtggctggacacctaggggccgccccgcgccccgccaaagaggaaaacacagacagtgaggaggcacggcatggggtggccatgggcaaggagcatcccagccctcgtctctgggaccaaacggaagcagggggagctatggggcccttgtgagcagacacccctgagccctgccaattctctgctctcttcttggccctattttgatcaagagcctacagcagcctccaggaccaccatgtacacttgtatcgttgttcaccgcacaagaggacctaacgcaggaaggactaaaatctagtccaagctctgctgctcaacttatgtgccctggtgctgggctgcatctgacccagaggaagggtatctttttatctttccaaaatgggtgactttttctcactgatatcctcagaagaaacacttttttttttctattttttaaagatttatttatttattcaaataatctctacccccaacatgggactcaaacacaacctcgagattaagagtcacatactcgggatgcctgggtggctcagtggttgagcgtctgcccttggctcaggtcctgggatcaagtcccacatcgggcttcctgcatggagcctgcttctccctcagcctatgtctctgcctctctctctgtgtctctcatgaataaataaataaaatcttaaaaaaaaaaaaaaaaaaagagtcacatactcttctgactgagacagcctggtgccctgagacacttttctctgattggcatcaccaatggccacaatgttcctgctggccatcagattatagtaagggccatatccactgcctaagtccttgtgtcaaccctaacagcttgccagcctgtaaaaccaggcctggcccttctcctgctttgctcatccagcctcttctcccaacatgccttccttctccttggactaatataggacagtatgtgcacacatatacatgtacatttacacacacacacacacacacacacacggttggtgctcttaatatcgtttcttctccagcgcattgtcactaggcttcagagaaaccatgtccctactatattccccatgaaacagaagtggatacatggatcctctaggctgcttcacgcattcattattggcaatggctgtgggctttctttgcaagtcgttttaatcccctcaaagaaacagtttctttttaatcatagactgaaacttactgtgtatgtgatgtcctgcagcccagggggttagggcccaggggtgtgtgcctcatactgcctcaccgggcacacaggaatcagatgtgtgtcctgcaagactactgatcacttcatatcatgacaataagggacatttactgaatgtagctattattgttctcagcgttttacatgtgcgtcatctgacctctacagtaacactaagaggtcagtactagcgctatctcggagttacacatgatgaaaccaaagcacagacaggttaagcatcttgcccaaggtcacacagctggggcgtagagctgggatttgaacatagatagcttgactccagagaacacttactccaccaccaagctacgctaccaggattcttttgacccttagcacagaggaccactgccaaatggtcaagtctgtgacagctgggagtcacatgggacttaatcctaaggtaatatttagctgtttttccagtatggaggcatcgtacttcctattaattgctgtaagtatctgtaaaaacactaaccctgcattttttaaccaaaagttaaataaaaacccttgcctgtcatctggttgttctttgcaatacataaagacatgttttgttctcacaaccataggatgcttatctatctaccgacctacctatctaattttttttacgactttatttcttggggcacctaggtggctcagttggttaagcatctgccttcagcttgggtcatgatttcagggttctggaattgagtcctcatcaggctctctgctcagtgcgaaatctgcttctccctctccttctgcccttcccttcctaacagactctctctctctctcttttttttctctctctttcaaataaataaataaataaataaataaataaataaataaataaataaatctaagaaagaaagaaagaaagaaagaaagaaagaaagaaagaaagaaagaaagaaagaaagaaagaaaataaagttagaggaatgccacctttgcaaaatgacaaaattcttaaattctgagctttgcctgggctgctttgtggaatcgcactacacggccagccttcctgagatacccagaagcaggtacatcgttgctctgctaccttccttaaacctcaggtcacagtgactgagcttaaaggtcccttaacccctttccactctgacaaacaggttcctatgaacatttcttttgagtgaagcaggagacagtgcccttcccccgtgtctgagatggctacttagagtcatcgtcgtcgtcttcttcttcttcttcttttcttctttcttcttctttttcttcttttcttcttcttctccttctccttctccttcttctttttttttttttttttaaataagtaagccctacacccactgtggggctcaaactcacggccccaagatcaagagttgcccactgtaccaattgagccagccaggtgcctggctttttgtttatttttttattttttttattttttattttttctggctttttgtttataaagatgtcataattgcaacagcagcggcacatttttctacagcgcttggtctgttctaagcatcttcacgtattagctaatttaatggctgaggaacagaggctaaggggcaaaagcgcccttcctgtaggtgagggtatttgaatctggtgatttgattaatcagtctccttctacagccttctacagttccagggaacagggccttgtcaggttcccttgcagtatccctagtgcctagaatacagtagctccataatttgctcaatgaacaaatgctgtgcaacacgaactggccccgggagagcaactcataaatgcctgagcaaatgggggcggttcttgctcccacactgtgggggtggactcagaacctttctttgtcacggtggggatgcgactggcgggatgcgacaggtcggctttgtcaccgcacccatggggagttgaggagctgggtgcaaggtccaaagcccactagagagggaggagtgtggaggatcagaaccagtgtctggtcctctagtctctgtgcacagcctgtctctctcccaggcaccccacacataggccaccccaaccagctccctgtccaggttcctgtcagtgcagtgctgcccaccccccaaccggggcctaagccaccaatcatctctccctgccaccaccgctaccctcacctctgccatcatgcaggccgctggcgctgtggtccctcatccctgcctctgcccagccctccctgaaccattgctccagctgctccatggcccacattcctcgacagctgccactgccactccctgttctactcccttccatggcacccagctgccccgaggggaaacctgtccctcaggcctccagccaacctctctcactctcctcagctctccccacctctctccccacccgccacactgtggactgacggctctttcccgcccagtgcgttcaatcctggatttaccacctaccagccaagtaacactgatgaagttactgaacttccccatgattccgtttcttcctctggaagatgggagataattgctagatctacctcctgagattcccaccaaagtaggccccgtgtgggttcacagtgatgctatgtgtatccaacttcttcagcctgcaagtaccttctccccttctctctgcctggctaaaccctgaattccttcttacagatgcatctagagtgtcacctcctgcataagcctgggcagccccactcctccctttccctccctgatccaggttggacacctgtccggcagcacatgctcctatcctggccatgctgccctgctctgcacccatctgtcactgtgaccagctgtctcgcagcctgcccagggtcagggggctacactgggcagtaaccatgccatgtcgcagctgccccatggggctcgtccctggtccaggtgaagagggcagacccctttctctaaggcagcaggacaagcagcccgggcgggtgaggtcactcgggagaggatgggtgctgggaaggggctgaaggaggcagctgagggagggcgggcctgggcagagggcacatagcattaatcctctccctacctgttttctcgtccgggtcttcccggtcctcaatttaatgtagcgtgcgatcaactcatttcgacctggattggggcgagagaagaatgaagagtggccaaggcggcagctgggggcagcagaccacccccaccccccgaccagcctcggccagctgggaaacacgcacggctctcctctgacactgctccttggccctgtccccaccctcaagtccaaggggcacaagcagggcaggggaagggtagtggggagtcccaggtgccctcctaaggccccagggtaggggggagtggggagcagcagaacagctgggctgctcactcctagccccacagcagttccgaatctttaagtgtaagcattcacgtgtgagcgaggcctgctgcagatggacctgcctgcacacgtccccgcacacggccccacgggtgtctgaaagagttctggatgggttcctgtcctggccgtccttgccaggaggggagaccctgaacagtcccttcccttctctggtgaggcgggcaggaagaacccaatggtctccaacacaccttctacactgacagcctgtgtcaagatgtcctgggcacgtccctgtgtccttgagcctatcacccccatgtccctggtggccagtgtctctcctgccctgtgagatgctggcagatgcttagccaataccttttagcccctaaatccaggccctcagccccccaaccccataacctccccagaagggccacattctccaaattcctcctccatgacagaaccagccccactgctcctcccttcctgtctgcccctctccaccccactccctccgccttgtctaaacatacctcgtggggctgccctggccatcctggaggcagcccctgccccgtggaagcatcctggaacatctgcctgccccacaatggggctctggggctaggggtgtgcgtggcataggggatggggacagggacccggcagcccttaccactgagtcaacggctccctcctgcaccccaccatggtatcggcccctgggatgtcacaggctgagggcctgccccactcggccataggctgtcagggaggactggaaggagctagcaaggagctcccaacctccaaagggttgagtcatcccaaaaatgcatctccaggggaaccctctcggggctggacaagagggggacattcccttctgggggcacatgggaaaggtagcagagagtgggccaggagagcaggaaagacttgggagggggttgaggaatgcaggactccccatgtctctccaggcctcttcctaacgcaggccctagtcacagcaaggccccccctgccccacacccatgtgctgaagggaactggccaggagggacaccccagctgccactcctcgggcttccccacacgcggggagggaccctctctcagggctagcccagagcacacagcactgacccagtttcctatgcccactgagtcaccctgaaacctgcaggccaggagggggatgagaggaggagcagacgggggtgtcaaggtgtgggccccaatctggcggagggggcaagcctggcttgtttatgaggatccagacacacaggcttacacgcccagactcgcccatggcaggctggcggcctcgaagacttcaccgaaccggttgggtgagggggcagagagcagggggaggggcctaggagggcctggcctcctcctcctcctcctcccgcccctcagtgtccctgtgtctccccacacgcaccgtacatcttgccctcgtctgacaggataatcttgcggcggccgcagggtgggtagattgccagggcctcctggaagctctgctcgatgtcggggctccacacgccctccgcatcgttgtccagccctttgtccaggccctcgggcccatcctcccgggcctccccggggctgctgctggcattccagctgttggacgctattgtgctggttgctctgggctctgggcctgagcccactgggcagccggagcctgcagggcagacacagaggggttagggtcagggctgtcctagatcagagcaatctcccactccaaggcctggtgctccagggtggggtggggatcaccaggggttccgcttattcagtgctatgcaaccttgaatgagctacaccacctctctgagctttggttttgtgtgatggagagaaggtctgcctgaggttgtaagggttaaaattaaatgagatcatgacaaaggaccaaccacaaagcctggctcctaaccctcaagacgcaggaccgctggtgatcagtaacaacaataatacctcatatctacgcggccctttggtggagattaagcacgtgcatattcatttaatcctcaaaactaaggcagggagggcaaggactgatactcattattcagatgggaaattgaggctcagaaagtcgtgctgctgccacaggcatcgtgttgagcagagtggaaaaacagagaagggcctggtgggtgtttctacagctctcagaggggcctgcttggctctgactttgccagctcttcctcctgccatcagcagccccaaccagggacccccaccctcctcactcttcccccagcatcttcctgctgaagacccactgtaggaaggggagggccctggacccaggaagggtgcggttttgacttccctaaaagataactcacaggaaccctgccaaggaaactaaacacggggcagggactgccccgggaattacacggagggagcgatgctggctggcaagggagcagctgagaaggtgcctggcccacagccttgctcaaccccaccggctcctccatcccacttcctgttcctgcacctcccggccccacagcagcccataaaccacccacacgcccgcccctgccctggcccacatcgcagatgggccagggctctgtaaactctgagttccctgcacacgccgggctcagttattaactcagaccacacccagcagtccccccaacacacacagccccaatgctcaccctccaagccccttcagcctcagaccctgcatgcccagtgtcctgggggcctctgagcccaagatggctagatccaaggactttgctctggtctgcagggaaagctggggtggggtggggggtggggagggtcgagaggtgggcaatccctctgaagccaggaaagggaattctatcctctcagacaagaattccaggtcctgccaaatgggcaggggtcttctgcagggggccacctgttttgtttaaggaggcttgacgagggtcactagtggcatgggatggagcgggcccggggggcctgaatcgtcagatggaaacagagctaagactattgctcaaatgacggcacctgccatatggcaggtactgttctgggattttacacacactgagtcatttaatcctcacaataacatggggtagagactattattagtcccaccttacagatgaggaaaccaaagaacagagaggttaagcaacatgtcagacacacagcttgcaagggctggcaccgggctgcgagcccaggcggtctggcttccgtctcccacctgagacgaggacgaggccgggccaccctgagccggcccagtggggtccagcagggccccccacgcctccagaaccttctgtgaggcctccgagagcgggagcagtagctctcccacaccagagggcggccaggcggagggccgcgctcccggatccccatcccacccgtccttaacccccaggccaaggctgagtgcgcgcgcagagcctctgggggcccaaggggagacgcagcgccccccgcaggccggacactaacacaggctgggggggcaggagggggctccaggctctaagaccccgcccagcggagcctcaggcctggctcagagcagcgccccgcgcctggggcccgggcagcccccgcctccccgccaactgccctgcctgccccagccccgccggcctggcctcccctctcccgggcggccgccccccccccccccggggtgatgtcagccccgccccgccccccgcaggagcactgtggccaaatatggcgaacacggccgggccggagccgggagccgggacaggccgggggcggggcggcccggctgggaccgggcagctggcggggggaggggagcccggggtggcggcgggaccaccgacccggccgcccgtaggcacaggcgacacccactttctagaaacagtcctgtgggcgggggcgccgaggcaggggccccacgggtgacccccgcccccacggccgggcacaggagcaggtgtgccgcgcggtgcccggatggagaccccagtgagggtgtctggaccccggggcccgcacagacccaggggcgagcgcgggcgggcagctgcacggggcaggggcctgcactggggtccctgccggctgcagcgctcggccggcctgcggctctggtctccccagttcctggcgcgaggctggtgtgtgcccgccctcctcccctggaccctcacgccccggggacccagctccgggccggcccttcagacaactgcaggctggcctgggccaaggtggttcaggctccagcccctacagagcagggggcagccgcccacgtccagaacctctgtgcgctgggctggcccaccaggagcggcgggagacagggaggagggcccaagtgaggggtgagggctggaggctgggaagagtctgggggtggggtaaagacagggagacagaccccgacaggcaggcaaaaagacaacagaccggggagacaagagagtggcagagaataaggggtaaacccctccccccacaaaaccttggcgtgagaccctcacttccagtgagagacccagagaaggagagatccagagagcagcaggcggacaggacagggaaggtgctagagagagctggatccagagtgggggcgggtatcacgaccaagagacccagacagagacccagatccggagagagggaggcacacagtggaggggggttaaaggggcgggaagggggcatatcgataaagtcagataaagtcaagcagtgagggagggggtagagggagagagagagagagagagtgtgtgtgtgcatgtgagccgacaagagaacccagagttcagagcagatctagaaggaaggagtgacggggaagccattgctgggggccaggtaggccccagcagggccagagccaggatgtcccactcctgtcccatttgttccgccccgtggagaccacctcccgtctcggtgtgcagaggcccgttattaccacaggccgccggcctcctgtggcccactccgcctctacccgcactctgaccagccattcctgcttcgcctcttgcagggccctcagccttctgaggtcagaaggtgcctctgggcggtggcagggaagggagcaaggaggcttgggggcccccctgcggggagagaaggggccccttgctgcccactccccgccctggggccaaactgctagaataactggctggacagctccagggagggaggccagagctgggcagctgcaggggccctaggcctcagccagcccgctagccatgcagcctcgagacccgcagggcccttcacctccctttcatggaggggaggggagaggctgacagcttgggctcccccatacctctgccctggacagggatgcagataaggcaggtgggtgtcgtcctaatgtccccctgccaccctcccttccgaatcagacccctggggagacacactgagcccagtgaccttactgggtcttgtggccagcagctgtgaactccagcagggaccacagccccccaaagtgctctcatttggaatgagaacaccactcaaaacgcaagaggattagtgaaatcagcagttgcatcccgaatctcctagggctgggctgacccaccagggggttgagcacagggagggcagttgatgagggtgaagggaatctccccaccccctctgcctttcccctcttccttctcacccgcccccaaagcagggccagctgttctccagctgccagaggctcccaccctagaagtagccatgctccgggtgggaccggagagggggcaggagggggatggtgtctgcctccagcacaaggacccctgagggaccctgccaagtggccacaccctgccaggctggggagggagtaccctcctccctggagcagggtagagatttttacaggaggaagcaatttgcagagcccactaggagggaggtggggaggcctcctccccgctctcccacttattaatgtgcttccaatttgggaatcaagactctctgcacccacccacccccacactcagggtacaggcttcctggggaccagaggaggcaggccacccccctaggttttcttgtccaaagctcatcctcactgtcactgccaccccccaccagtgtaggaaagtgggagatagaatctcagagccctcaaacttccacagagagaaaggcccactgcccagatgctgtctcatttttttttaagtaatctctatgcccaacatgggactcgaacccacgaccccaagatcaagagtcacacactccaccgactgagccagccaggcactccctgtctcatcttgccccaccccagtgaaggccaggtgtccagttcatgggtgggggtggcagccaatgggtaacttggttaagcgggtttcacagttgtccactgacatgcccatccgtcccccctcaccctgcctacgccccagccctgggactctgcgtcacctgctgagctgccaccagtcattcagccaatccccccccactatgagagtcccagtgtcctctacaacacacacacacacacacacacacacacacacacacacacacacacacgggcttccttgcagccctcctctctcaagcacacactcacccgcccagccactgtcccacacattctcagttacctgcatctctatcctgttcctttttaaactttttattgtggtaacatacacttaacatcgaatttaccattttaaccatttttaagggcaccattgagtggcgttaaggacttctctgcttttaacagttatctttttcatggtcctccacatggatgccccaggcatcagggtcagaagcccccaaatttgtgacagagcatgcctggcccagccttgatggctgtcacccacactgtcctccggtctcaggcaatcacagatagtgctcacacacagaggccagtctcgggcacacctcgcagatcctctgatgtgcggggctgcagggcagggtctggagctcagggtcacctacacaccttctttcccactctgcatttcacacagatgctcagcaccatgtcacggtgctttctcctcacacacaccacagattgtcctagtttgatggagtcatatacagtcgcacgcgcagcccgtcagagttcctacaaaccagaggccacctcgtaggctgttcatacacacacacacacagtagtcacaccacagcattgaacatcacacagaatggtacccattctgcttctgacacacacagtatccaacaatcactgcatccctcacaagcagagcaacaggatcccctctagggtcagacataggctcacttgctggtctttcagaagccatgtcccccgagatggccactcacatgcagaaaccacaagtacagcttctttcacacacacatacacacacacacgtcatttatggtggttcccacgtacagacagtattagccacacacaccagtgttataaaatcacaggcagtgccacacacagcttctctcctgtacaagtccagcctcaaatgcagtcacacaaactggttttagccggttctctcacacacgcacacccccctaagcagtgtcacccacgcagaatgtcccactcagtttctctctcacacacatccagcgtcacacacggttgcactctcatttccctctatcacttcctgtcctttcgggcctggcagggagcacaggaaacaatcagcactctaggaaacctcaagggctgaggctttggggacctgtgaagggatagggattctctggcctcctgggggaccttcgaggacaggtgaagttcctttcttgcccctctcagatcctccccccaaggggcagcacctctcctgcagacaaacctaggctggcacgacaccaggacagaggggagggcagggcaaggccttgaggacgggactgagtgtgatctgctgacctctgaccagagaggctcccaccatgggcccagggcccatgagaggtccacagagacctggacctcacgcttctgcagcctccacgtgggaagaagagacggccacctcctagctaccgccatggtaatctgcagcatttagagccctcatggctccctggcaacctggggtctggtactccagagcctttccccaccgtcctcactgtgggtggacccctccgctcctcatcccttcctaagggaggtagtgggcaggactgacagcttcggttcccttccagcttccatactgagccctgtggggctctctcaggcagagggggcaggccatccaagtgacctctcaacacaactcacctgggccagccttgccagaccctggggccacttcagagggcaaggtcccccagctccacctggcttccttgtccctggctgcctgctacccacaaccttttcagccacactttcctcagtcaccccctggtttgtcctcatgttcttcctcagatcactgatcacccactcacctctccagacctcaccaggttcacgttccataatgggagaaggaaggcccactgattagaaggctgagactcagaaaggagctcggagataagggacctgagaagtcattcccagcagggaaactgaggcacaggatgacaacaggtacttaaaggcccagctgggaccagatctctaatttctcgactccctctttgagatgtcgccttctggttctaacatttcaactggcagaaggcacaggctctgcaaacctgagggcaagggtgggagcacagagacagacacagatggacagatggacatgcacttgcgcacatacacacacagccctgtcctgcagatcactgaccatcctactgagccattccctagccccaatgcactaattagcattattattccctcactagggagaggtaggggagaaggctctagaagttgagaatcccattggctcttagtctctccctgaggagggggcatccaaggcccctgaagtcaccctcaccagacagcctattcctagaagatacatcggtcaatcccctgcccacagagtgagcagggatccagaaaaccacagagccacgtcctggagtgacaccctcctgggggagggtcttagaaaaagagctacaagaatctggaacggaggagaacataacccccacacacacacatgtctaactttgggggactgtggatttcctccttgccccaggctgccccgacattctagctaaggaagtgtctcggccccctgcactggggtggaacatgtatacatagaaccaggccatatgagacgggatacataagagccaccatgggctccagcccctagagctgtgtccagtccctacccccattccctgctttcctggactacaagtccaggcctgacctggttctgcctctacctggagagagagaaagcacaaagggaggtgccccctgagaagccctcccccaaggcctcattccctctagtccagaaagaatctctgagtcctggatcagggccactctcccaaaaaggtgatagagtgggggctcagtgacagtgccctggggcctggctagttgaaaaccagttacagacaggcactcttggccttccctccccaggcaggaataaagggcatgacagacaatagtggtggtggtggtggtggtggcggtcgtcgtggggacaagcctccttcaaaccctctaaagtctaaacaagggttctgaggaagtgtagggaaaataaggccccaaagccagccccctttggaaccaggctcctagagccgtggtctggaactctgaacctccaccccaagcttaagcccctgcccctcagggggcacacgccctgggcgcgcagctctgcccccaaacaccctccacgatccagcgcagccaccaggcaccgcgcgcaggagccggcctgggcgccgggaggccgcgcgcgaggcctgcgtggagctggggccgggccggctccgagagagcgcgagccgggagtccaaagggcggcgggcccgggactgggagtcccgggtacgagctccctggcaggccctccaaaccgtgcggcccccagacccctgcctcgatacccccaacgcggacgctgggacaggcgatggcaccggggcaatctcccggcaccccgacctcccccgaccgactggtccgggtcccgggggggtgggggtggcgggagattgccccggtgccatcgcctgtcccagcgtccgcgttgggggtatcgaggcantattcatgagagacacagagagaagcagaaacataggcagagggagaagcagggtccccgtgggggaacccgatgcagaacttgatcccagaaccccagggattaaggccctgagctgaaggcagatgctcaaccaaccacttagccacccaagcacccctatcctgctttttaaagtaaatgcttccctgtacttctttatagtattatcaccaggtgtacatcccatggctaccatagtttaatcctatcctttaaagggtaaacttgtgtctttcaggagtcttaattgtaggtttcctttcctttgctccattcccctcctctgccccaccctagttttatcccttacagtttatctctgagagaatccagggcgattaacctgtgaactttcccatggtctgaatgctgtttgcacactcatggtgcagctcacctgttttccctgtcctatgcatttcatacaaactggaaatcatgggccgggcccatccgagaggggcggggccgcgcggggccacccccgtcggcgctagggcggcccaccccgcggcttcgcgacctggggctgcagcgctgctcgcccgcgggtgccacgctcccacccgctccccgcacgccgggcctggccccacctccccgggaccccactgcagtctggggctccggcctgggcggggccgggggcggggctcctgccacccggccggactcccgtcggggtgccgcgtcacgaggagccccgcggagccagggcgcccgggcctcggggctccctaaccgaccctcccacccagtcccgagccgccgaggcgcagcgccctctcccgcccgagagcccgcccccaactcccggggccccagaccccgccccggcctggcgactgcgcccgccctgcccggacccggtttgtctggttctccccgagaggcttgtttctcgaatttctccctttccccctcttcccggacctccggggccctccctctcggcccggggcccccgcggggggcgtctcgacaccacgagcccgccgagtttcggtaggaccggcgctgggcgcgggggaggggacgcgggagcgccccgggcctgggcgggagcggggctgggggtggggaggcaggtctccggcccgccccccggacccctcccgcgctccggacccctcccgccgcctcgttctccgcacgcgttgaacaaccaccgctcgccggcccgggacgcggctttattgggggtggaggtgccggctcttcctcccgcatcacctacccctcttgcgagccccccactcctcggagccctaagacggtccgggagggggttaagacaacaccgactactgctcctggacaggaagtgactggggcgcggggcggggagggggcggtcggtgagcagcgcaggcgggctccgcgaccagatgtgcggctcccgactccagatgttcttcatctctgtcggaccgccgtctgagttcctcccctgcctcggcctgtgccaggccggggagtggatggaggtcactcggagaccgtgcgcgcgggggggggggtcagcccgcgacgagagaggcgtcttcagtgggggctttggcgaatggaccctgccagcctccactgaatcctttcccccacccttggcgggcgctgggggcgctggagtcactcgcaggccagcttcccgtcgaaactggagagggcaatggcgaaggcctgcagagcgcacagcgggtaccggtagtctagggtgaaggcgtcctctgccacgcgcccgaactgcagcacgatgtagtcggctgtggacacacaggggcgggggtgtctcccagtcctggcagacagtgtcctcaactttgggagaagtctccttcctgtgcactggggcgggaaacctcagccaccatctcagttacccactctccaccctacaccccttatctggtgcagctggccccacctgcagcattagcagccttctgactgtaagcccctgagggcagggaccctgccttatcttctgccacccagggctatgtgtatgacaggcacttaaatataggaacctgtcacacgtgccccagcctacaatccttttcttatgtctcgggcttcattccttcttcccatccccggcccccgtgtctcatcttagattgccaggctctatcccttgactagccccctgaccccctactttatggagtggctccactcagccccatcccatatctggtccaggttcacagccccagtcccaacacctcccccagcatccatagggacaggaagttgctaaaaatacccctgatctctgcaggccaggctctaccagaaatgtgatctggagagtggttttccaaggccttgggacaggtgacactggggacacatccctaggatggagtgggggatggaagaagttgctcagtgtcagccaatcccaggaacccagggtcccttgggaggtatctttccatcccaaacttcctcaccttagtgggaacctctcccccaggccagggacatttttacttcattacgttctgggtgtatcttggttccctaactccttgaaggcaggcctttgaccttacttgagggaggacaatggagcaggcactcagaaatgcttgatattacctacccttacaaggcagccatcttgaagggcttgagagctggggccctggagccagaccacctgggttctcatgccagctctgcctcttacagctctaccaccttgggcaagttacttaacctctctatgcctcggttgtctcatctgccaaatagggacaataagaatacctttctcaggtactggaggggatagggatgttgaaagatttaatgattcagtatctgtaaagtccagagaacagtgcctagcacataggaagcactgtgtgtctgtgaaataaattttgatgaccagtgggtcctcctgctgttgctgggagacctttgctggtgctgggaggcaccacccttcctgagtctcagcagcctctttgaccacataaaggttgggctatcagtatttctcaagttctagcagattaactctcccttcagcacagtctttctcacccagaatattccaatatctatcccaggctctggtcaatgttagaaagaagccctgagacacctgcttggaatatctgaggctcctggaagcatagtgtcaatgcccctgcaggagggggtgaccttcctggatattctggctccagagataaaggacagctctgtgtgtgtgcgtgtgtgtaagtgtgtgtgagtgtgtgtgtgtgtgtgtgtgtgtgtgagagagagagaggtggtggggaacagcccagcttgagccttcagagactcacggtcatcggcgtggacaatctggaagttcttgactgaggcttgtgtgactcgaccttggaagttgagggtataggagccgctgtcttcattccagacaggtggcttgttgtgcagctcgatgaggctctccagggtcttgttctgccagcgtaccagcaacccgtcactggcctgggtgccaaggaggagtgttaggggaagagtcatggctggccaagacatcttgggactgaggggaagcggcctggggaacctgtgtgtgcctttgaacatgtgtgctagtgtgcagcctagaaaccagtatgtcctcaggggatccttgagagcctacttggtctttgtggtgtccttgtgtgagagggcatccctctgtgagaatgggattttgccctgggatgccaaagtggagggttggagagtagcacctggcatacagtaggtgctctgtgcccttggtaccgaagggggtcttaggtacagccacatgctggcacctgatcacaaggaggcactagacatgctgggatctacagggaactcacagttgtgctcggggagatggacaggtaaacagtggttaaaataagatgtcccggaatagagtttctcaaacgaaggaatggtgtctgtgtgatagcgctctgagatatttccttcctcagtttccttggcactagtcacattgatggcttagagtgaatctgcttcaagatcacgtcctccaagaagcctttctgaccccatgtctgatttagatgccttagctccaagtctccttccataacatcttgctcttactatttctcccactgcactgtaatagatggaattagatacttaaagggcaggtctggtattttactgacagctgtgtgcctcagtttccctcacaacagggtgttgtgaggattaaataaattaatagtgtgcggaatgttattcagatcagttcgtagcacagagtaaatgctcaataaatgtcggattgttctgatagtacttgtgttgattttggatcttcactgcctggctttaatgaatgaccgtagaatgaatgaactgtgaaattatgaggagttacccagagcggctctgggcagtgcttaccaagcccaaacacactcgggaggcactgcctctggggcattcgtgtgtttattccaggcatggaaggagcaaccatgtgacctgtggctcctcaagactacagctttccgtgctttgtgccccatgagttggccaagcctctgattccagtgtgactttctagcacaaaaggatatgtgataggctcacaggggttatttttcattgtgaaccagtaaagtgacatcactgagagtgtgaagcataccaaccatcctgtctctgaaatcccgggctcactgatgcagtgctgaggagcagagcaaaagactaacattgcaggaggccaccactccccaggatatctctgcatcttttttttttttaagatttatttatttatttattagagagagagagagagagaggcagagacacaggcagagggagaagcaggctccatgccgggagcccgatgctggatcacgccccgggccaaaggcaggcgctgaacctctgagccacccagggatccccacatctctgcgtcttatcctatacttcacacacacatacacacacaaaaacaagcaactttgcttttctgaataaaagtcaagggacccctgggttgctcagtcaattaagcctctgcctttggctgaggttatgatcctggggcccaggatcaagccctgcatcttatcgggctccctgcagggactctgcttctccctctccctgttattcccctcaccatgcccctgcttgtgctctctctctttctctcaaataattaaataaaatcttaaaaaaaaaaaaaaaaaagtcaaatcaagtcactcctgaaaccctgctgtggcttcctgtttgagtacaaaccagtcatacaggtcctatctgccccttattctcacctctcacctcaaacctaccaggcaccatcctgcctcagggcctttgtactggctcttccctctgtctggatgctttccccagatatctgtaggcttgctctctcacctccttcagctccttgcttaaacatcacctcaatgaggcctgctctgaccctgtatttaatactgaacatgtacatatttctcatcttccttctcctgtttaactttttattttttccctatcacatcactttttaaaaaatattttatttattatttgacagagagagagcacaagcagggagagccacaggcagaaggagagggagaaacaggctccccgctgagcaaggagcccactatatggcccgatcctgggaccccaggatcatgacctgagccgaaggctgatgctttgccaagtgagccacccaggtgcctccacttctcgctttctaacatactatacaatttatttatttatcacagttattgtctaatgtccatttcctccactagattgccagcttcataagggcagattcttttttattcactgatgcctcccatcacctagaatactcagcactccttacacactgaatgtgtataatacaatacacacaatatacacttcattcattgaatgaatatatgaatggattatttggtgtaaactggaaaaaaaatccctcattgcatttgtttcaatgaattcaattatagaaccccctaattcattccacaagtttccagaatgaagttgtgatgcagggtgaagagtgtgctcaggaagttgggtatgggcaaccccccacccccccagctccccaggagtggatcataagggggacacatgggagcaggaccctcaggaagaggcatccagggaggtgctgggctcacatttcgcggccggatggggaccctctcgttgtccgtgttcatgccaggaatgatgacagtcatgcgccggggacctcggaagcccagcacattggtttcctgggaaggagatcctgttaggctggcccatgccaaggggaggctcctgccaggggacccagggggggttctcacatagatcacggcggccagctcctgccgaaggctccccacatcagtactgcctcctccgcggtgcgggttctgcccattgtcaaagacggtaaagcggttgcccagcagattggacctgcaagtggggtgtgtgggggggtgctggggacagggcttggggaatctcatacccctactccaagacccatcctcacagccaggcagttttgagagcttcctatgtcatgggtgtcagtgtcttaggacagagcaacccatgtcccctgccccaggcccccctcaggaggtctttttaaaagctggatctggaaggaccctgggcagccttcaactctcagctccatttctttgctgtgtgaccctaggcaggctaaactctcagagcctcaacacccccctctgtaaaatgggcatactaatagtatttacctcgcttggtcttttttttaagattttatttattcatgagagacacagagagaggcagagacacaggcagagggagaagtgggctctatgcagggagcccaacgtgggactccatcccaggaccttgggatcaggacctgagccaaaggcaggcactcaatcatagccacccaggcgtccctcacttggtcttaataaggggattaagtgggttaatatttggaagttagaactatgcctgacacacagataggcctcacataggtgttgttaagtacataaggataagaaataagacctgacccaggggttcaccttccccttacctctcagatgtgcagtgaagattagatgagacatatagggagacagcacagggtaggtgctggatgtttgttattcattcacttactaaatgttttagtgagtcgctactatgtaccaggtgctaggaattcaaccacaaacgaaacaggcatagtccctgccctcatggaccttatgacctatttcaagtgaggttcctggtccagcagcactagcatcatctgggtgcttgctggaaatggagaatcttgccccaaacccagattcactgagccattttaactacacttccaagggatctgtgcacatttaagtgtgcgaagccagagcacctgggtggctctgtcagttgagtgtctgctttcggctcaggtcatgatcccagggtcctgggatcgagcccggcatcaggctccctgctcagcgaggagtctgcttctccctctccctctccctctgagatctccctctccttctctctctcaaataaataaaatctttttaaaaaagtgtgggatgccccaggccaggggacatttctagagtgcccagtgtggtggccactgccaggcgcagggagatggaagtgacttgccatggcgcactagccgccctgggcctcttggccccacctcagcttcccaatgaaattctcccctcctcgggacagattggtagggtcgctggagatgaggtaattggctgtcttgctccgtttccgcttcctgccagccaagaggaacacctggggagaggggggagacaggtggaggaaggaggcctgcgtgccctgaacaccctgcccactcccccacccccacccccgccagcccgaccgtcagcctgggttcctgccctctctccccctgccacctctcccctccccaccttcttctctgtgtccaggtgcaggaagtaggagggatacaggccccggtccatgcccttcttgtctcgggtcagcctgcagcggacagtccggccctgcggcgctggccgaagcacgaactcctggggctcatccacttccaccggtggggatggggctctctcctccttctgggtcggggcagaacgcacatcagccgcggagcactagctcctctgccctcgcagtccctagcagggcaggcgggacaactcaccgctttctgtgtgggaagacaagagacaggccggctgcagtggcgcgggcccctcgtgctgcccccgcagctccgccgccggtaggaggctctggggagctgggcgctttgttactattttgcttcacttgtggctaagagcctggaatctggagccagacacgtgggttcaaatcctcgttccaccactaactctgtcatgtttaaccacactgtaactcagtttttttcgcctgagaaatgcagaggttggggctggatacccaggacagatcttacttaacctatacattcaccaaacactcatttaagtctaccaaggcgccgggcatagtcctaagtatcttccagtattaactaatttgattctcttaggtcaccactgacataggtgtccaattttactaaagaagtcgaagctccgagaggttaagcaacttgcccaagatcacacagctagtgagaagcggaactgggatttaaatgctgcccagcctcctgtaagagccagagccttcaaaagactttctttctttctcttttttttcaaaagaccttctttcatgcggacactatgtcaaagggtgaactgaagtggggccaaaggtatgaactgctgtgttctaggcacatagtgttatagaagtattagctactgctgttactacagtgaatagtaactactcaatgcctgtagtagccagcatccaagatgagtcctggtgatccctgcctcctgatatttttaaaatattttatttattcatgagagaacacagagagaggcagagacacaggcagagggagaagcaggctccttgtggggagcccgacatgagtcttgatcccaggactcctggatcacaccctgagctgaaggcagatgcccaaccactgagccacacagatgcccgcctgcctcccggtatttacacctcatgtagtctccttccacatcatattagagttgctctttctgacaaatggaacatagcagaagtgatgggggtatgggggcgtcacttctaaggctgggccataatagatattgtgccttctccttgctgtctcccttgggccactcgagctctgggggaagctggctgccatgtcattagaacactcaagctgccctgtggagagggctccagccaacatccatgacagtgaaccattttatttttttttaaagatttatttatttattcattcagagagagagagaggcagagacacaggcagagggagaagcaggctccatgcaggaagcccgacatgggactcgatcccgggtctccaggatcacaccctgggctgcaggtggtgccaaaccactgagccacccggggctgcccaacagtgaaccattttagaagtggatcctctctttccagccaagctttcagagtgactgcagacccaactagcatcttgacagcaatctcatgaccctgagccagaagtaccctgctaagccccttccagattcctgacttacagaaattaagaaatgtttgtggttttaaggcaccaagttttgggggtgacttgtcacaccacaatacagaggtaagacaatgaatgaataaataagcttatcttgctcatggaataactccaaacaacagtttggttgcattcccctatagagtggcctggcccagcctggtgaccccacagcagcccctttggttctcacatgcttggtgccctccatgctcatgttctaagggaaaaccatgattccaactccaactttcccagtagggaagagaagggactgccagcctgggtgtgtgctatatgaaagccactaagaatccctgattatgctgcggttggccttttttgctgagggcaggtttggactgtatgtgaggtgaggctggtgtcggcaagcagacccttagcctgcaggcaagtgagcacctcttctccactctgggctgctccaagaagaaacttgggaaacgcaagactatgtttggaatgcagtgtgcagaaagccagagcttattcaaacatttccacagctgtgaatttctagggcctactgtattgaaggctgcacggcggttatattccccgctggagataagaaactcacctttcagtttatatatcggtatctggtgatgttggctaatgtgagtcagtccctcaagacgtgaccactcctgaactaactaataaacccgtatggaggagggtgctggaggcccctgtctgccagagttaacctttcagctgccggaaggttgggccctcctgggttggggggcaggtagcagcagaacacacttgggtactagaacggtagcatgaaaatattttaacaactcatacaatcattgcccaagggggtgcacatgtgcccgtctgcctgtgtgtcgtacctctctggtacagaaaatgggtgtctcttcacagcggccgtgtgagcatctctggctgggtctgctgggttaggctgcagaggggaggacttagagtccagataacatcaggcccccagggggccaatcccagcctagtgacccctccactgcttttgctgttctcacaaggctggtgccctttgtcctattgtgtcatcagagagggagccaagattctaaccccaagccattccccaggccccccgccaggttccacactcttgtccctcccaagcccaggtccctgccactgctccttgaaggggcctcagcccccttcccctctggatcctgacctttttgccttttccttttgctttgcccttctgattgctgttcttggtcaccacgcctgccacttctcccccctcttcttcttcctccttcttctgctcttctgagcctttggaaatgcctggacatagtggcgggacaagtctgtgaaccccttaccctgtggagcacctcatgttttgcaaagcacttctaacatccatgtcttactcataccctccccacaaacacaagagtaatcccataatactagtatcagagactcagaaaggctaagatacctgcctgaggccacacagctattaaagtggggatcaagatgcccctcaagacttgtgactctgagccccctccttaccctacgctgaactccggctccccaccccccaggactgcctctagatgtcatggcaccagaggcctctgtcacccacctttcttcttctgagctttttcagctgggccttcttccccaaccagaaacatggctgctggggtcttctttgtcactctggccgggctccctgaagggtcctggtcagcctccccagaccctgtgtatgcggatgtgaaggggtcacactcccctacagccagagtcccatgttcttccagagaccggcctcacctttcttcttcgtctttctcatcttggtcccctccccagctggtgcctcctttttcttaatgcgcagaggtttgggtgcggggacggggcttgccaggtcccctggaaagggagataggggttaggcaaagaagagcctgttggggctgaaggccaccttcccacccacttgtcattccttcagtttccagggaggctgaaggcctgacgatggctcagtctgtcttcggctcgccactttttaattttttttaagattttatttatttatttgacagggagagagaataggagtagggggagcagcagagggaggagaggcagactccctgggagcctgacgtggggctcaatcccaaaaccctgggatcatgacctgagccaaaggcagatacttaatggactgggccaccccagcatctctgcgtgttgcattttaatcctgagtctgtaaagggctggaaaataccaggagcttcaaaagcattacagaatgaatgaacatctaactgatgttctaactgaacatctgattcccagctcccaccccatcttccccagaaaacttcctctagcaggtgctacagacggcactctgtccctcccacagaggcccaagatcctagctacctgttcacattgagaccagactgcggtacctgtagggcgaggtgcccaggccagacaaccatcatagcacttatttcactgactgatttttacagtaatcactttgatacttttataaaaattataactataattcatattgagttaaaaaaaaatactaaaaaaaatcacaaagaaaactaaaatcctccactttccctggctcacagagccctctgggcaggcagtggtgggagctcatattgatctctgtacttgggggccatcaggagaaagacaccagagaaagaaactcttgtgtccaggcactgggtagtgttctgatgtctcaactctcatatcgctgaggcccctgagcccctgaaggacagggcaagttttacagtgtgtgtgtgtgtgtgtgtgtgtgtgtgtgtgtgctccttctctcacccttctgaccctgggccttggccctcctctccttgatcccggcagaagtcttctctttaggaggcttcttgggtggcagagggattttctctttcttttcctcctcttcttctacctcttcctcttcctggtcctcctcttcctcctcctcatcctctgtaggtagaaactcctcataatgggggccggcatgggcccggttatctgggagcccagtccccccagattgctgggaagtggtaaatgagagccaggggtgggagtttccccttctggaacaggagcaggaggaggaacagtccagcaccttcctcaaagcacgggggccaattcccaaggtgttcgggtgcagggagtgggggctgggggaatgctaggggcttggcagtcctgtccagggacatacccttctctgtagggccttcgccccctccgggaccccactcctcacacactcctgcctgtctgctagtctccccttctcggccccttcgctgcccccgcgccgccccgctcggcttctccgtggcccggagcagttaccgacctcagccagacccatctgggctagctccggcccctagcttaaggccagactctgaaccgccccgtgcctcagtttccccatccagaaaacagagtgacgaataagagaatacacttttaatctggctcccagagcggccggaggaggggcggctgcttctggggcttcgcgcctcccctcgcctcctctccccgccggcgccgtctcaccgtccgcggcgtccggggctcgcgctaccaggaaggtttcccgcgggtcgcgcttggcctcggggtcccggaggaacttggcgtagacggtctgcggcggccgcgcctccgggggcggcggggccggctcctcccgcgccttcccgcagcggccggctgagccgagaggccgggtcaggccgggagccccagacgctgtcccgctcggcccccgcgcgggtctgtcctgggcgctctctccaccccgacaccccagcccccacccactccacccccgcccccgggctccaggactcagccgcacccctcccgccccctcaccctcggccccccgcccgcctccgggtctccggggcctggatcctttagggcagggggactcgggggcctctgtcttcttcttcctcaacttctgccccttggcgggtcgctgcggagcggggtcgggaggagggagaggaaggagaggggggctcggacggctgcccatgaccctctaatcccttgagctgccagaaataaccgcggattatcgggaggggaactgcagcctccttggggtgaggaacaatgacccctcccatgcatcacggccacgtccaaggccccagagcctcagcttctcccctggacatcccatgcccccaaacacatttcctcaaaaaaaaaaaaaaaaaaaaagcaaaactgcagggaagcaaccccccagacgctgtagaggggacacgccccactccagatcgcctaccctgcgtagggctactgcaaagtggagatgaggttcccctcgcctcctttccaagcagggggacatacctgcttggggcgctgctggacctccgggctctggccttcctcctcatgtccgctgagggtggcagaggcatcagtctgtcttcctcccctttcctgtcctccccaacccctccgagccctggtcccccaaccccaggggtcaggcaggtagaggtggtgagggtggtggggctgcttccgcacctgtcggaggcccacacctctcggagggtgtcgtcctgcagcggcatggtgcattcgcctatccgcacccccttctctggccaccctgcggctggaggagcctcccagcgctcccggctaatccaggctcaacctcaccccacctcccgctggcccaggagggcggcagcactgggggaggcgcttctcctggcccatgaccctcgcccccctggcccattccacaggaggaagaggctgaactgccaagtgctcagaccaccagcaccctgaaggaggccatcagtgccagccccgccgtttcccacccagctttgggttagaggtgccaatttgtaatttgttaggggttagtggggtgtgggaagaaaatattagatcggatcttgtatttatttttcataaaaactgagaattaggatttactgatatttagtatataaggattgacaggagcatgtgtatatacagtacttgattgagaaaaattatggatgtacacttacattttttttttttttttttttgctgacaaggaacatgcttttgtaaaagtttagagatcagggggtacctggggggctcagtcggttaagcatctacctttggctcaggtcatgatcttggggtccagggatcaagtcccacatctggcttcctgctcagcagggagtctgtttctccctctcccactgtccctccccactgcttgggctctctctcagataaataaataaagtcttttaaaaaaaagtttagggatccctgggtggcgcagcggtttagcgcctgcctttggcccagggcgcgatcctggagacccgggatcaaatcccacatcgggctcccagtgcatggagcctgcttctccctctgcctatgtctctgcctctctctctctgtgtgtgactattataaataaataaaaattaaaaaaaaaagtttagagaccagggatatagttttttatttttttaaaaagtaatctcctagcctcaaggtggggctcaaactcatgaccccactcatgacccactcatgacctacggatcacataggaatcacgtggtccaccaactgagccagccagggccttccccaaaccaaggatatagtgttgatatgattaatatcatgggcaaagtttggttcaatgctaaggaagcccagaggaggggtcccaatcagctgtcctgcaggcttcctgaagcccgatctaaaattttaaaaatgatgaataggaattccacaggcaataaataaataaataaaaataaaatttaaaaagtgggttggattacctagaaagggagcaagatgaaggcctagaggttggaaatagccagatgtgttcaaatgttcagcaccaggagacaggcagtcatctcatacatgggtcagccctgagctctgccacttaagggctaaatgtccttgggtgacttacttagcctctctgagcctccatttcctcatttataaaatgggcttgacctggtaaggatatttttcagattcagggagatgagaggcacctgtgtggcttaggcggctaagtgtccaactcttggtttcagctcgggacatgatctcggtgtcctgagttcagctgtgcgccgtggcaggttcggtgagaaaggagcatgcagtgggtgctcagcaactggtaactgtgtgcccctttccactgaacttccacttcatcccggtctcctcagcatttacaccccttttttttttaaattttatttatttatgagagacagaggcagagacacaggcagagggagaagcaggctccatgcagggagcccgacgtgagactccatcctgggtctccaggatcataccctgggctgaaggcggcactaaaccaccgagccacctgggctgccctcttttttttttttttaagatttttatttattcattcatgacagacacagaaagagagagaaagagaggcagagacacaggcagagggagaagcaggctgcatgcaaggagtacacctcttgatacatgagtggggttcattttttcaatgacgtaatgagtgcatttttaattccattcaattctccaaagagtccagtgagataggcggggtggagatgattatctccattatatggatggacgcactgaggcccgtggaggtgacgtgagtgctcggggagtgatctgcgtcagccagatcataaggtggcttggttggggtgtgaatccagacctgactcctgtaagagcctttacccctaacccttgcatgttttatgcagtcacaaggattagagatggggcatgaaggaaatagtcaggcttttgtatcccatttgcttggtccacctgatccagatttgccctaatccatcttcctaaaataccacttcttcagttgacacctttgctcaagaacattcatcggctccctactgcctaaggaccaggtttaatttttttttctttttctttttttttcccccctttttgtaagggcgcaggaccgggtttaaatgtgccaggctggcattcaaggctctccctcgtctgactccaacctgcctttctaattggagggctatcccaaactgtgctattcatccaggcgcataggtttgcatatgtcctttatattctctctcctccatgcttttgcttaagctcttcccacccggaatgcctagcctgttccaagaaacctgtccaactctaaatagccctcaagtccccacctccaggattccttggccctcacgggcctctgcatgcatagtaataatattaataataataacaacaacaacatttattgcccacctactatgtgtcagtttccttgttccccttctctctccaccctcacaataatgtttatgaggcagacattaacagcctaatagcaaagatgaggaaattaatggctgagagtcagtcaacacgtatttccagagagcactttgtgccaaacagtatgctaagccctggtcatccagtgatggacaaaaagttatggtccctgccctcatggagctaaacttctgtggaagacagggagtaaagacacaaatacaccaattagttgatgtgtgatctcgctgttattaattgtaataaatgccaagaagaaaaagaactgggttctgcgaaaacagcaggtgggaatctgggctggatttagaggacagacaaggctatctgggaagggaggttttttttgtttttgtttttgttttttttttttttttttgggggggaagggagtttttaaactgagccctgatgggctgcctggctggctcagtcagtagatcagtaaagcgtgtgactcttgatcttgggggtgtgagcttgagccccacgttggaggtagagtttacttaataaatactaaaatatgttgagacctgaaggctttcagagactaggaatgagatccttccaggcataaggcacagcttatgcaaaaatctcgaggcagcaaagcacttggcacaacagaacaggggcaccactggatagggcttcaagacccgctctttagagggtttctgaagatctcaaaccccaaatacatgactaagaaccagaggacacctggggctcagtgctgatctgacaaggcaaactggaaagctaaatatccacattcttttttttttttttttaatttattcatagacacacacacacacacagagggaggcagagacacaggctgagggagaagcaggctccatgctgggagcccaaccgacttgggactgatcctgagtctccaggatcacatcctgggctgcaggcggcgctaaaccgctgcactaaccgggctgcaccaaatattcacattctaatagtaccagggccacagggaaactttcatatcttaaaccagagaggcctgcactggactagagatggaccgggtggtggcccaggtcagaggacactgctttggaatgtaggcccatgtgaacagcagaagctcttaagtgaagaaaaagtttaattcatttctcagacctctcctcttgggctgcatggatgtgatagatgtttgcataataaaagtgtccatttctcctgcttcttttcatgttctgaaggttctcatgaattagcactggtattcttaaagttgcacatggcagctgaagaacattttaaaatattaaaaacaattcatacgacttaaatttgtatatatgtagttcgggacataacttgtggggcatgacagctgtttctcacattgacacatcagatgctatttggggaacagttctgttttcctaaaaatatttaataagatggaattaaaatttctaaaactatttaaatctgattacattttgctacttattaattataaaccatatttgccattaaattttaatacataggggatcccggggtggctcagtgatctagcgcctgccttcggcctagggcatgatcctgaggtcccggggtcaagtcccacatcggactccctgcatgaagcctgcttctcccttggcctgtgtctctgcctctctctctctctcctttctgtctctcatgaataaataaatagaatcttaaaaaaaataaaataaattttaatacataattttgaatatattagaaaagtcacttttgaaaacaggtgaaaaataattttattaaaaatagtttctgggatccctgggtggcccagcggtttagcgcctgcctttggcccagggcgcaatcctagagacctgggatcgaatcccacatcgggctcctggtgcatgtagcctgcttctccctctgcctgtgtctctgcctctctctctctgtctctgtgtgactatcataaataaacaaaaattaaaaaaaaacaaaataaaaatagtttctttttaaatttttttattttaaaaattatttatttattcatgagagatacagagagagaggcagagacacaggcagagggagaagcaggctccctgtggggagcccgacatggaactcgattccagaaccctggggtcatgatctgagccaaagacaggtgctcaaccactgagccacccaggtgtcccaagttaattttatttaaaaaaaaatttttagggcagccccggtggctcagaggtttagcgccacattcagccaggggcgtgatcctggagaccagggattgagtcccacatcgggttccctgcatggagcctgcttctccctctgcctgtgtctctgcctctttctctctctctgtgtctctcatcaatcaataaataaaaaatcttaaaaaaatttttttaaagattttttatttatttacttgagagagagcacacacaagacagcacagagggagagagagaagcagacccctccccactccagcagagtgcccacccccaggctggatcctaggaccctgagatcttgaccctgagccaagggcagccactgagccaactaagccacccaggagcccctttaaaatttttcttaaaatatttatttgaaagagagacagagtgagggagaacatggagtgtgaggggcagagggagagggaaaagcagacttccctgctgcagggagcctgatgaggatgcggggcgggggggggggggggcgggtagagcgctgatcaataccagaggccaaggaggacattttacagactgagtcactcaggtgccccctcctttttttttctaaagaatttttattcatttgaggaggatggaaaaagtgagagcatgaacagggggtaggggcagagggagaaggagaagcagactccctgctgagcagggacccccccccccatacggggcttgatcccaggaccctgagatcatgacctgagtcgaaggcagatgcctaactgactgagccacccaggtgccccaaaaggtttttattcatttatttaagagagagagagcacgagtgagggaaagagcaaagggagaaggagacacagaatctcaagccgactccacactgagccggaagccaaacattgggcttgatctcatcaccctcagatcttgacctgagccgaaatcaaaagtcagatgcttaatcaactgagccactcaggtgcccctaaaaagatttttgttgttgttattgttgcttttaacatttattatagttacttttgaggagaatgtattcatattttgtatacttggaatgcaattatatttttaaaaatccttgaagaattaatgcaggttcagatcatgataggaacagaaggtagcaaagtggaactcagaaaacaatgaaaagaaatttctgggtctcggtgacactagattcaatgagaatatgtggggaatttagagacagtataactaaatgtccagatttgggtctgaccgggatttagaagtgagcatcaagattttggttaaaatgaatgtcagtttaggaataagaatcagatcaggaacacagatgacttctaataccttctgatttaataccattgcaacaggcctttttcaaagagaaacatgctcaaatttctatacttacaccttgttttggtctaaaaatgacatttcttagcttgatcactggcattagttaccagattcaattccacatgaactttagctgttttctaaaatcaaatctccattttaaaataagattttatttatttgtttgagagagagagagagagagagagaaagagagaaggagcccgggggataggcagagggagaagcagactccctgctgagctgggagccccaccttgggcttgatcctaggactctgggatcatgacctcagccaaacgcagatgcttaaccaattgagccacccaggtgcccccctttctttttaactaagctccacacccagtgtgcaactcaatgcagtatttgaactcaacttcctgagatcaagacctgagctgagatcatgagtcggatggttacctgactgagctacccagatgcccctaaaaataaatctattttcggaagacagagattccccgccacccacgccaactgggatgctgataagtaaggacttctaccatgagccaggcacaatttatcctcacagcatgcttgcatatctgcagctcagacaaattaagtgacttgtccaagtaacttggagccatagtgttgaccaaacaccctggtgttacttgtgtcatcactggtccctgcggaaactttgaaaggtgagtgggcacattgtttcacctctctatgggcccgttttctagtcatagtggtgacaataattgtacatgatgttagggaagtttcgggaatggaacgatgtaggtgcttagcacagtgctgagcacagagcaagtgccctattgatgtcggctgcatgtcttttaccttcattttacaggtgaacaaatgtgaggcccaggtctctgaggggctcaaacccagggctccctgggtcagcatatgtggtgcaatggtgacaagagggcatattgggaaagtctgaagcagtggttgagagttggagatgttgcccagaaatagactcaagagtcctgcttcaccacattccagctgggagacgttgggcaagctttcccctctggcttaatgtatcttgccctcaacctcaatttttcttttctttttaagattttatttagtcacgagagacacagagacataggcagagggagaagtaggctccctgccagaagtagggcaggggagcctgatgcaggattggatcccaggacctgagtggaaggcagatgctcaaccactgagccacccaggtatcccatggcatagtttaaccagaagttcaggaactggatcatggttagagttgggttggggtgaggtttagggctgaagtttataccagggttgggtttcaggtcagaaataggaagagcgcaagggtgggattaggtgtcactgaaggtgtctggcacacttagaaatgggcatttatgggttctgggatatggctggtgctagggttagtgtttgatgcagtggctctcaggcagggcatttggaaatggggggaggtgttttaagttgtcacaatgggggcgccttctgtggggccagaaattctcactctttaaatttatgcccttggtcaagtcatggttctcaaggtggggtccctggaccagcagctgcaccagcggtcacttgggaagtcagcggcagcgcaaattctctgggaccttaccactgagcaccggcagctggggagctggggcgcagaggcgaggggagcagtcggcactctagcaccccctgggggattctagtgtccactcaaatgtgagaaccaccgcaaaacagcgcggttgagactgacactgcttcgccctccggcaggtgtccacacttctctgaataacggagcacatctcatgagctgcggatggcgcggtccatgaggcaagggactttgaacgtcccggtcaccgctgtctcttctctccgtgttgaggaactgaccgaggagacagagacagagctatccgtgaacagggaggggagaccctgcctttcccttattctcttggttcccaaaaacatgaggctaaggtttcccgggtttcccgatagatttctggcaccaaggacctctctacatgcctgcgggtcctgctggcgctgggggcggaggtgtgggttctggaacacccaccgtgcactcgccccaagtccctttgcgtgtcctcggggcacgattgcggcctgggggccttcctcgacaatttaggacatttttcctttttttatttttttaagatttctttattcatgagagagagagagaaagagagagagagagagagagagagggagagaggcgcagaggcagaaacaggctccatgcagggagcccgatgtgggattcaattccaggactccagggtcacgccctgggctgaaggcaggagctttaaccgctgagccacccaggcgtcccaactttttttttttttttagattttatttatttattcattcatgagagacacagagaggcagagacgcaggcagagggagaagcaggctccatgcagggagccccctgtgggactcgatccggggactccagggtcacacccgggctgaaggcggcgctaaccgctgcgccaccggagctgccccccccccccccccttttaaattttactttttattttggaacaatttgaaacttacacatgcgtcgcaagaccagggtaacgaactctagcgtacccttggcttgaagaccccgtgtgagtttgccagttgccggaatgatggcgttcagggtcggggccggccggctccgcggcggtgtcggtctccctagtcctcgcggcgtcagggcttgtcggggaacagagctgcacgccggctgcacgttcgattcaagcgactggagactcgtctcggacccaacctcggtgtaacaagcccctccctgagcatcatctcagctgggtacccagtggccctggggggcgcaggcaccgcgaaccgacccgaagccaggccggacttggcttgattggcacattcactggaccagccgggagcattctcgcatcgggcagccgaacccaggggttcaagaggcgtgtcctcaagtctcatctccctgcatccccccgtggtgctaggaaaggtgacaacaaaggttgtgtccctggtcacatcgattcgccggggcgggacctgactggctccacctgggtcgcctgcttctccttggattaggtggtttgggtcaagaggatgggggtgctcggattggccagcgcagccttgggccgcctgggggcggggctctctgtaattgacaacccaaggaattcctaggggagacggtaatgctaaaaggataaagcgggggcgggggggggctgctactgctgatcggtgggcgagtagtccgcatggggggccatcgtcagagtcaggatcagaatcccagcggtgcttagctgctgccgcagtagcagccctggcaacgttcaccgcgagtttgctgggttccgggcactgttcgaagtgtttcctatattagctcgtttaataccaaccattttatgttatagatgctactttcatgcacgttttccgtacgaggcaactgcacggagaggggcagtcacttgcccgaggtcacacggcccaacgcagcagacccgggggtcccacagccgcaggcctccctccggagaaacaccccgggacacaccctcctccatcctccgtgcagtagcagcaggtctcctgctccgggcggggcgccgtccccaggagcactcgtcctccagcgcacccgtgagccccgggagagtagaacacccccgcagattgcttagattgcttatcggaagttccccattacctccagagcctggagcaaagccttggggagcagaagacagaatgggtggctttgtagcggtgcttctccactagaatacttaccagaccttcacaaaatcccagtggtcaagctacaccccagaccaattaaccagtatctctggggtggggctcaggcttcagtattctttaaggcttctccagtgaattaaatatccagccaaggtggagaaccattcgtttagaggtcttctggctcagtggaagcagctgtggggtaagatttacctgggtttgagacctggccctatcactgcacctgtgtgactttgtgccagccccttaacttctctgagcttcaatttcctcatgtgtggaagaagatctgttgtcaagacagcgcagggattgtcagggctgaatttgatgtctaaggctcctagcacagagctgtcgctgagctccatccttaatattaaggagcgggcaaaacagagcaggccctggtctcctgcaggatcaaacctacgcaggaccacccagaaaggcagagagacgccaatgactcaccaccactaggatggggctgtggaatagattttaggggccttagggaccctccgaccccaggttctaccaccttgagcctctgccctccctcatcgagggctttgatgattccgaatggggtgaaattgagacaggatggggccgacgcgcgggagtggaagcagattggggaagcggggtgcggggaggaaatggctgtgggagtgcactgactgagccctaccaccaggtggcgacaggaacccacccactgaaggcccagccttaaggagaggaagacggaataacagattattagagagaggacttttttttggtttggttttgttttcttgtgccccccctttcttctttttttagtactaggtatatgctaaagtcgtattttctttcatttctgtttacttcttgcagcagtcctgtggtaggcaccattaccctccttaagtgggtgaagaaattgaggcggtcctgctaactggcaactgggattaaacccagtcattctggctccagatgctagtctcttaaccactgaggtcatagaaggtcagagctgcgagggcctttggaaattctcaggtcttgtgattcctaaacctgtttgataaaaaaaatcacctgaggctcttttagaaaaatttcagattcctggggcccaggccaggcactgaattagaatgtcccgggaaaaggggcctgggaatgtgtgtggttaacaagagtcccagtttggaaacatggatctgttctcagagagggaaagtgacctgttcaaggtcacatgaccagtctctctcaagctcctagtaccttgaaatccagaagccaggtcaccgcctaaaaaaaagatgagataatataccatgtgatccagcaattctacttctgggtatatcccccaaagaattcaaagcaaggtcttaaagaaatatttgaatacccatgctcacagcagcattacttgcaatacctagaaggtggatgccacccaagtgtccatcaacagatgaatgaataagcaaatgtggtttacatatgtaattaaatattattcagtcttaaaaaggaagggaatgctgtcacatgttacaacatggatgaactttgaggacgttatgctaagtgcaataagcccatcacaaaaagatgaatagcatatagttccatttatatgaagtgcatagaggagtcacattcacagaggcagagagtagaattatggtttccgggagctggggaaagaggggtatggggagttcatgcttaacagtatacagtttgggaagatgaaaagaattctggagatggatggtggtgatggttgcacaatagtatttacttaatatcactgaactgcacattaaaaattggttagaatgattgatttttatgtatattttactacagtaagagatagtgggggaaaaaaagagatgaccataatctgtgcccaaccctggagggcggtagtaatgagaaacaagaagataagtatgatctcctttatcttttttttaagtttatttaattaatctctaccactaactcaaactcacaaccttgagatcaaaggtcacatgctcttccaactgagccagccaggcaccccaattttccttatcttttaaatgactttgtgaataaatattacatggccattgaggaataccataaaatcacctctctcctcaaaaggattatactggagcgcttggatggctcagtgggttaagtgtctgacttgattttggctcaggtcaagatctcagggtcatgagattgagccctgggtgggactctgtgctgggcatggagtctgcttaagattctctccttccctctccctcagcccatcccctgcctctctctcaaaaaaaaaaaggattgtactaaaaatgtctgaatgtattttttttccccaaaacttcatcaactttcggttttatcattttacttttttctttttttctttttaattttttaagtttatttgttttattaaaatatgtaggcggtgctacagagtttctgatatttttgttttatgatggtcacacagagagagagagaggcagagtgagaagcaggctccatgcaccgggagcccgaagcaggctccatgcacggggagcccgacgtgggattcgatcccgggtcttccaggattgcgccctgggccaaaggcaggcgctaaaccgctgcgccacccagggatccctccccaaaaatgttaattgcaaatttattatactaaataaaacaaatctatgtttattgttaaagtgaatcaataaaactactacatctgttattgagaggggacagtggcccctgctttgatttttcctgcttattcaggaattctaggttctcaaatggaggctatcaaggaagagggatggagttggggaccatgtatataaaaactcctgttcattttactgtaccaccagctccaggggctgttattatttaacatctagatccctctccttgtggtaggacaatggtgggggagaggctgagcaggaatgttccctcatcctcggcctaccaaagagtcctgcaattgccagtccaatttctcctccatctctcttctcttccttgtctaaaaaatattttatttattcataagagacatggggtggggggcacagacataggcagagggagaagcaggctccacacaaggagcccaatgcaggacttgatcctgggactcaaggatcacaccctgggccaaaggcagacactgaactgctgagccacccagggatccctctcttcccttcctaaagaagactgattcttccatgtggctaaaaaatctgggtatggaggaagaaccttaatttattattattattaattattattattatttggtgggagatggatattgaaaggagcagcacagaatagcttcaggacatgaggaatgagggaagagaagaaagaggattttaattagcgtggctgtgaactgtgcatctgaatccctttgaagtcctttgagaagcgtgactaaggagtgagattgcttgttaattcctttaggctattgggttgtataccttgggtcagacactgttctcagactgaaccacatggggctgtgttttattagggttccacccttattaacaaagaccagggcatgagttcttgaggctccaacaccctgaccttcctgctactcactgccagggcacaccctggaccctgtcgtcaccccaaactgctccacctccgaaactacaattcagacatcccctctctgattggcagtcttcccacaccacacctgctaccctttgctcactttcttccgctacacctctcctttgaccccatcaggacttccagcccatcgatcccaattgtgcccaatcattttttctctttccttttggtaatggcatctactttttccttggaggaaaaatttcagacccctggccaacagcagaattggtcatgtgatgctagtcagtccagggaaagccacccccaggactgttgctgagattccagataaggggacattttctttctgctcaagtggctcagtgggcaggaggacatagcctggactggctgggggtcttcctggggatgagagcctgcaggataataggaaaagctgagcaaagagagatttctcataatcttgttagagtatctggaactagccgttcctgaaactatcttggatttttcagataatgaatcaatatctaatatttgtaagtcagggttggattctctcacttgaaacaaagtgacagggcacctgggtggctcagtggttgagcatctggcttgggctcaggttgtgatcccggggtcctgggattgagtcccgccttgggctccccgtgtagagtctgattctccctctgcctgtgtctcttcctctgcctctctctgtgtgtttctcatgaataaataaataaaatcttaaaaaaaaaaagacctgattttacagtgtcactctagctagactctagatcaggggttcctaaatgtggttgctcatcagaatcatgagtggagattttttcccttaaaacctttgcatgaaggataacacagatacagaagaatgcataaaacataaatgtacatgtcaatgcattattataaagccaactcccatgtaatctcatctatatcaagaaatagaacattgttagactctacaagccccagccccttcctctcgttcacagggaaccactatcctgacttcaatggcaatcacgtcctagcttcctgagatcattttcagcctgagtatgcttcctgttggaagaggtaatcaagaggacatgactgtcagttggccctggagctggactcaagtaatctgaggctcctcatcccctctccctccatccttggaatgtatcttctacccaccattcccatagtgggagccattttcaaggacatagtcttgaaagaataaggtggcactgagagtgtctgggtatacacgtgaccaaactcacatctggcaggcgagtgcggagttctactccttatggccactacagacaagccttgcggccaggagtggcctgtctctttcttggggctctctttgccctccgtatacaggcgccagttttcaaactgacacttccctaaacactgtggtgtacttttgcctgttttagagtgttatgcaaatggaactatttattaatcttaatgaaaccaaatttgtcagacttttctcctttaaggttggtgcttttgtatcatgaaaagaaatctgtcaccaccctgaggtttgttttttgttttttgtttttaagattttatttattcatttatgagagacacacagagagagagagagagaggcagagacacgggcagagggagaagcaggctccatgcagggagcccgacagggtactcgatcccgggaccccaggatcatgccctgggctgaaggcaggcgctaaaccactgagccacccagtgatcccctttcttttataatctttattgttctgccctccatatttaggacaacaacccacttgggatttatttgtttacggtgtgaggtcagagtcaagttccagttttacctcgcatgaacactcaatccatttactgaaaacgctcatccttccctgtgctcttcaatgccacatgaatcacaaccccacactgtccatattgacatcagcttctggtgttttcccagtctgtttgtccttgtacaaatatcaccctctcctcacgactgtacgtacttttacaaaaagtcttgcttttcagtagagtaatatttccatgttgttctttaggaaggaaactatctttagccccttcatttccatatgtattttagaatcaacctgttgtgttccaccaaaaaaaaccctcaaccccctcccccaaagaaaactctgttaggtatttatttgattgcactgaacctgtagatcaatacattgttcaacatcaagtcttctaatctttgtttcctatttaagatgcacatgttaggaagagaagatataggatgaaggggacctataataatttctttttaggggggagtgtccagatttattgagatataattgacatataacacagattgtaaatttaaggtgtacaggtgttggtcggatgcatttatatattacagaatgattaccaccataaattagctcacacctgtatcctgtcacataattatcatttctttttttggtgagaacatgtaagatctactctttaagtaatttattttttttttaatttttttttatttatttatgatagtcacacagagagagagagagagaggcagagacataggcagagggagaagcaggctccatgcaccgggagcctgacgtgggattcgatcccgggtctccaggatcgcgccctgggccaaaggcaggcgctaaaccgctgcgccaccgagggatccccagtaatttattttttaaaagattttatttttaagtaatctctacacccaacataaggcttcaacttacaactccaagatcaagagtcgtatgctctactggctgagccagccaggtgcccctgctcttaaggaactttgtatatatatatatatatatttttttttatatatttaaattatacattaaattatatatttaaattagatatatatcaaatatattagtatataatttatatatatatataatgcagtattattagctataatcaccatgctgtatattagatccttagaatttgttaatcttgtaactggaagtctgcactctggaagtttatcttgcaatacttgaacatggacatatttatatgtgtgtgtttgtgtgtactcacacatgtccatttatttagagaaatttatttatttatttatttatttatttatttatttatttatttatttatatatgatagacacagagagagagaggcagagacacaggcggagggagaagcaggctccatgccgggagcccaacgcgggacttgatctcgggactccaggatcgcgccctgggccaaaggcaggtgctaaaccgctgagccacgcagggattccctatttagataatttaaaattttttctgtataatgcatttttgcccatcttttgatagatttatctctaaataattggtatattttaaaatgccattcaaggagcttacagttcagattctttggctcaacttttagagagtctgagtgagtagttctgggggcatctagatatgaattttgaaaaagctgcccaggtgattctgatgcgtgttcaggcttgggaacatgggcatctctgtggctccactcattgtctctttccagtcctgttcagctccctccccctccagctggcctaatcccattggcctttggctgcatgcaagtctctctggagtaagcccccaagccctgcaggtcccaccatctccctttactcaaagtcccatgcactttcagaaggggttgtctacacctgtgatttcaactttttaggcttgcatactcctttaaataaatttgaaaacccatgtagtccctcacgcatttttgtttttgtttttaagatttatttatttatttgagaggggcagagagaaatttaagcagacactacactgagcacagagccccacgtggggcttgatcccataagcctgagatcacaccctgaaccaaaaccagagtcagtcgcttaaccagctgctgcacccaggcacatacaccccgccccatggtttttaactgacatctcattcaaaccatccttactcacccctgtgcccttctagtctaccaggctggctcttcttttcaccctgtcattcactcctgcaaggtggcttctgctgcctgcatgccactaaagctgctctaatctaggtcttcggactctcatgtcactcagttgaggggacaatttcagtctttgtcttccctgctttccctacagcatttgacatgctctctccctgggtacccatgacacaacattttcctattcccctaccccacctccctaatgagctactcactgtctgtgttgaatgattgaagggaacaaacagggagagaggatcgagggtacctgggaaggagggtgccagaagggtttcccacagagcctctcctgtaccaagacctgccaatcatacccacccatacaacttttttttcccccacaatgaagaaaacagcattggtcactgtaaaaatttaagcatactgaaaagaaaaagagaaaggcaattataattacccgaaatctccctaccctgagaacattcaccatcatactgctggtgcccatctctctgtctctctatgcatttatatgtgcacctacaagtgttagtttacaaaaagctggcaacaatggttattatcctagatgtctttaaaattttttttccttatctgttcattttattaaaagcaaaaataaaaataaacaagtagaacttcatcaaaataaagagttctgcacaacaaagggaaacaatcaacaaaattaaaagataaactactgaatgggagaagataactgcaaacaacatatctgataaagggttactatccaaaatatagaaataacttatatgactcagcaccaaaaaaattgcaaataatccaattaaaaaatgggcagaagacatgaacagacatttctccaaagaagacatccaaggggtccctgggtggctcaggtggttgggcatctacctttagctctgttcatgatctgggggtcctgggatctgtccccacaatgggctctctgctcagcgggaagcctgcttttctctctccctctgcagttagttatccctgcttgtgtgctctcttgcttaaataaaatcttttttttttttaaagaaaacatccagatgaccaacatgaaaagatgttcatcatgactaatcatcatgcaaattaaaaccacaatgaaatatcaccttacacctgtcagaatggctaaaatcaaaacacaaacaacaaatgttggtaaggaggcagaaaagggaaccctcttacactgttggtgggattgcaaactggtgaagctgctgtggaaaacagtatggaggttcctcaaaaattagaaaatagatgggacgcctgggtggctcagtggtttagcacctgcctgtggcctggggcatgatcctggagtcccaggatcgagtcccatattgggctccctgcatggagcctgcttctccctctgcctgtgtctctgtctctctctttctgtgtctctcatggataaataaataaaatcttttaaaaaattagaaaataggaatagaaatactagaaaaaatagaaagagaaatataccatccagtaattccactactgggtatttatgcaaagaatacaaagacactgattcaaaaggatatgtgcgcccctgtgtttatagcagcattgtttataatagccaaattatggaaacagcccaagtgaccattgatagatgaatggataaagaagatgtagcgaatatacacaatggattattactcaaccataaaaaagaatgaagtcttgtcatttgcagcaacatggaggagctatagagtataacgcttaagtgaaataagtcagccagagagagacaaatatgtaatttcactcgtatgtggaattgaagaacaaaataaattaaacaaaggaaaaaaatagaaagacaaaccaagacacaggctcttaattacagagaacaaattgatggtttgacgaggtgggtggggagatgggagaaacaggtggaggggattaagagtacacatgatgagcactgactcatttacagaatggtcgaatcactatattatacacctaaaactaatatcacactgtatgttaactataatggaattaaaattaaaagcttaataaaaaataaaattagggacacctgggtggctcaggggttgagcatctccctttggctcaggtcatgaccccagggtcttgggatggagtcctgagtcaggtgccccagagggagcctgcttctctctctgcctatatctctatctctttctgtatctctcatcaataaataaataaaatcttaaaaccaaaattaaaagcattccatttatttaccaggtttgtcttgttttcactactatgactaatgatacaataaatattcttacatatattcatccttatgtgctcaggcttttatttttaaggttttttttttttttaagattttatttattcacaagagacacacacagagagaggcagagacacaggcagagggagaagcaggctccgtgcagggagcctgaagtgggacctgatcctgggtctccaggatcacgccctgggccgaaggcaggcactaaacccctgagccacccagggatcccctcaagtggtttcctatcctattaacacccttttgacttcagggaaggtgtcttttgccataaacaatttataacttttatgtgattatatgtgtatacatttactctcatggggtttggctgtctggtctggtttaaaaggtcttttggaatatattttgcatgttatttacatttatggtgttaaactgtctgaaatttatttgggtacagtgagaggcaggggtcccagctcatcgtcttcctggtgggagaccagctgggtcagcatcgcttagtaaataaactacccttcttttctcaccgaatcaaaagcccatcattgttatacataaaatccaatcggtattgggatctgttcttgtgctctcttctatttcactgaatttttcatcacctccttgaccattcttggacaggtgttggcaggagtcagagttctggaaaagcttatgcacgactgtttctgcattgagtgtttgtgtgcccctctctgccccctgcccttccccctgccagccttgacaagcctctcaccacccctctgctgcagaagcagccagtactaatctcattatacctcttatccctgtttctgtccccgtcagcctcctcagcctcctccttgggcctaatccccatctggccctgtttccccttctttcatcccgtctcccactcccttactactggaagcctccacaagctcccttgacctcaggcatgggaagggccctagagtttgtcttctgtgaacggtttccttcacctcctagctcttctggacaactggctctccccgaggaccctggatcccctaccactagctctaatggtggctgttctttctccctcactcctccttcccccagggccaggaagtagagtgggtgacctccttgctccacttccagaatatgacccctctccactccacttagctttagctctcatgctgtttgacgatactgttgttgcagacaccctacaccctggtcactcctcatccctttaaagagttaggtcctgacttgctgcccttgtctctgacaccactccagccatcattctggacatgtttagtgttcacatagatggtccttccaatccgctggcttctcagtctccacctggcctcagccctctaccccatggtcacacctgaggctgtgctgtaactacccataagcctctcaccctggctttttgctgcctctgcctgagatccatgctgcaggcgtgttctctccacctgcctcacctcccccactgattttcacctccattgctttgggctctctcttcacctagtttgtattttgcagttttgtcagagatggcctttctggattgagtcctctcagtatgagatcacttaccagagactcctggtaggatgtgtgtcctagttatctattgctatataacttagtggcataaaaccacaatcgttttatttgctgatgattctgtgggtcagcaatttggctctactcagttgggcgattcctttgctggtcacatctgggatcattcatgcggtggcagtcatctggtggcttggccagggctggatgaatgccccaagacatctggcctgttggtacaggccatcagttgggactgtctctgcacatggcctcttgtcccccaagaggcccactctggctccttcctttgacggtcccctcctcagggacacctccacctgctttgggggacctggccttagaacacccacaaaatcgtgtctgctatagtgtgtaggtcacagcacattacaaagccaatccagatttgagagagtagagcaatagatcccaccaattttttttttaagattttatttatttatttattcatgagagacacagagaccgaggcagagacagaggcagaggaagaagcagactccccactgggtgcccgataagggatctgatcctggggccgtgagatcacaccctgagccaaaagcaaccgctgagccatccaggcatccctagattcctacctcttgatgggagttgcaataaagtcacattgccaaggggtgtacatacagagaggggagggacatgtggccattttattttgctatctaccacactgtgttagcttgtacagctaggagaggagttagcagtttgctgagttgattgactaaaccttgccctccatgatggcctccattcagtgaggttgaagtgtgagtacttccctggaatcatgtagaaggaatgtgaaagcataggaagggggaaaatgggagtggatttgtcacatgtgtcctgcacatcccctcctcactgcatctcctgagaagtctcaggggatacacctgctatgaagaagccagcaatactgtagcatggaggaggatcagaatcctcgatgagccctgtgcactttcctgtaggccaggagtagtgggggtaaggcccacccctgagatgagctccaacatttcagtaagaaagctggagtcctggacgagaagaggccaagtggcaacatttggtcaccagagccatactgggctctcgaggaaggcaatcagaatgttttgacctgcatgggtttttttgtggctatggtgaccctagaaataaaacagatgggcagcctattaaaatatttcttgggaaccctgggtggcgcagcggtttggtgtctgcctttggcacagggtgcgatcctggagacccgggatcgaatcccacgttgggctcccggtgcatggagcctgcttctccctctgcctgtgtctctgcctctctctctctctctgtgactatcataaataaataaaaattaaaaaaaaaaagaaaatatttcttgatcttcagagcagaaacatgacaggtcaggtagccagaaacctgacttaatttccataatgatggtcacagtttggagctaatgcagatcattgactcagagcccctggattgaattgagcccagtgtccccttgagacaggatcttgcaaaaccccataagcatgcagtataaatctctgaagctttcctcaaagggctctgcagccatttactaaggtaactgtattcttggagaaatggacattctcagactctttggagattactagatactggctttgaatcatcattaattcctgggaaccaaaaaagccagaaggggcctatggtggttagatgttaaatggaattttgactaatgtctaaatcacagtgaataaaggaagaccactgactcttcctgtggttatttttctagttttttgaatgaatgcttggccaatgacagaacctcacattggtctcagaatcatggaattaaggctatgaaggaccacaagttaggatcccagaactttgcctccctctaaagataggaaactaaaagctgtgttgcacacttgggaaagctgcagggatgatgctacttatgttttcttttctgtatttctttttttttaagggaggaggggcagaggggagagagaatctcaagcagactccccaatggcttacaggtcatggagtgggagactcaggttgcagtgcacatggttccaccatttgggtcttctgacccaacaggtcaaatgacagttgaagtatctatggcagataggagccaccgggaagccctaatggagagtcacagcacgcacacacaaacttttggagcaattctatgccctcttcgtcagagaactcctttcctttggatttggctccaagcttgctactaggtgttggtagagactcagtgtttgaccatgggacatcaagtggccatgtgatctgaggtgcccattagatactgagtattatctggcccaccaagtcacaaggcagacaacatcttgaaatgttgggcttcattttacaggatgaactgctttgaagaagcacccaaaatatacaaatctagaaatcaaagagtggaagtagtaagtaagtagttcttagtagtaagtagttcttgtcataattacatctaataatatatccataaattttttgcttcctattcctgcaactctgagctctgctagtttatttttttaaagatttcacttatttgacagaaagagcactagcagagggagcaacaggtagagagagagggagaagcagactgcccattgagcaaggaacctgatgtggggctcaatcgcaggaccctgggatcttgacctgagctgaaggtggacacttaaccaactgagccacccatgcatctctgagctctgctggcttaaaggtcatgattcccagtagaggaatgcttccaccatggggcacagggttgatttaattgacctggaagctgacactgcctggtcatttggggctcctcatgtcactgaaccaacagacaaaggaagcagttactctacttgctgaaacggttgaatctgataaccaaagaaaaatagggtcacgggcagcccccgtggcacagcggtttagcgccgcctgcagcccagggtgtattcctggagacccgggatcgagtcccacatcgggctccctgcatggagcctgcttctccctctgcctgtgtctctgcctctctctctctctctctgtgtctctcatgaataaataaataaaatctaaaaaaaaaagaaaaagagtctctgcggaatcaccatggcatccgggaccctgtacacatatcctgaaaactggagggccttcaaggctctcattcttgctcagtacagcggggctcaggtccgcgtgctctccgtaccaccccacttccactttggccaaaccaactgcacccctgaatttctccgtaaatttcctgccagcaagtttccagcatttgagggtgatgatggattctgtgtgtttgagagcaatgccattgcctactatgtgagcaatgaggagctgcggggaagtactccagaggcagcagcccaggtggtgcagtgggtgagctttgctgatagcgacatagtgcccccagccagtacctgggtgtttcctaccttgggcatcatgcaccacaacaagcaggccacagagaatgcaaaggaggaagtgaggcgaattctggggctcctggatactcatttgaagacgaggacttttctggtgggcgaacgtgtgacactggctgacatcacagttgtctgcaccctgttgtggctctatagacaggtcctggagccttctttctgccaggccttccccaataccaaccgctgattccttacctgcataaccagccccagttctgggctgtcttgggggaggtgaaactctgtgagaagatggcccagtttgatgctaaaaagtttgcagagagccaacctaaaaaagacaccccacggaaagagaagggttctcgggaagagaagcagaagccccaggctgagcggaaagagaagaaggctgctgcccctgctcctgaggaagaaatggttgaatgtgagcaggcactggctgctgagccaaaggccaaaggcccctttgctcacctgcccaagagtacctttgcgttggacgaatttaagtgcaagtactccaatgaggacactctcactgtggcactgccgtatttctgggagcactttgataaggatggctggtccctgtggtacgctgagtaccgcttccctgaggagctcactcagacctttatgagttgtaacctcatcactgggatgttccagtggttggacaagctgaagctgaggaagaatgcctttgccagtgtcatcttctttggaaccaacaacagcagttccatttctggagtctgggtcttccgaggccaggagcttgtctttccgctgagtccagattggcaggtggactacgagtcctatatgtggtggaaactggatcctggcagcgaggagacccagacgctggttcgagagtacttttcctgggagggggccttccagcatgtgggcaaaatcttcaatcagggcaagatcttcaagtaaacatctcttgtcatcgcctagttgcctgtacctgcccttcagcgagatgggggtcattaaaggaaactgaacattgaacccttaaaaaaaaaagaaaaagaaaaatagggtcactattacatgatgaggtcagagctatgtttagaatctggagtgttctccggggtgtctcttagtacttttatattctcaagtaaaagttaagggaaaacaatagcataacaacaaaagacaggaccactgagaattcatatccttgggaattaaataaagtgataccccatcaaatgaagaattcaaccaactgaggtgccagccctaggcaaagggaacacggaataaagaatagaagaagtgattaatgtcaactattgtcttgtagtgaactacacaaaccagtatgtagtaggtgggcacattttctggtttgtttgttaagtgtgtaaatattcacatgcacaccatcagtttttgagggctgccatgacaaagccacagtctgggtggcttaaaaaaacaagaacaaaaacaatagaaatctattctctccggcagcccgggtggctcagaggtttagcgccaccctcaccctggggcatgatcctgaggttctgggatagagtcccacgtcgggctccctgcatggagcctgcttctccctctgccctctgcctctgcctctgtgtgtgtgtgtgtgtgtgtgtgtgtgatgaataaataaacaaaatctttaaaaaatatctattctttcatggtttgagaggtggaagtctgaaataaaggtgtgtgcaggatcatgtctctcaaaggctctagggaaggaacctttcttgcctctctcagcttttggcagctcctggcagctcttggtgttctttgggttgtacacacatcacttcaatctctgcccccaccagaacacaatattctccctgggtctgtatgacattttcttcttgtaagaacctgtcagattaaattgggtcccatcctaataatctcactgtagtttgattacatttgtaaagactatatttctaaatgagatcacacttaccccctaagatactgggggttaggacttcatttttaaaattatttttattgtttttttaagattttatttatttatttgagagcgagcgagcgaaagagagccagagaatgagagagcacaggcagaggcagagggagaatcagactcctgccgagcagggagcccaatgtggggctgaatcccaggatcccaggaccccaggataacgacctgagacaaatatagacacttaaccaactgagccacctaggtgcccatgggaggttaggacttcaatttatctctttggaagacaactgtacccataggatatataatcacataggcatacatacaaagaaatttatgtatttttccctctttcttcaaccttttagtttatataaagattctaatgggtggttaatttttttttggggggtggttaattttttaaaaaatattttatttatttattcatgagagacacggagacagagagaggggcagagacacaggcagagggagaagcaggctccatgcagggagcccgacgtgggactcgatcccaggtctccaggatcacaccccgggctgaagccggagctaaaccgctgagccacaggggctgccctaatgggtggttaatttaacagtttagtctgtagatcacagaatagtcagcttggaactgtgaatgactcctggactaattaacatcctttagggatgactgtagggaatctgtgtatcgctttttgggggaaagggtgagagtgtcttcattgtttggagcatagtcgcatctatcctgttaggcagaagcataaggctgttttgttacacagaagttcaaatacaggtagagagatgggtatggttgctgggtaggtgaaggggtggatcatgtggatcgttactagtttccggctgctcacccaccctctatattccgctctgactttctggagcaggagcttctgcgtttcctgtcagttggcttccaactgcgcttctaccagcagggggcactagaggaagaccgtgggccagggctggaccccatctgctctgcagcagcagccggcacatcatcccagccagcagtagttggcttcagcctccagtttgttttgggagtctcagttccggcctctccactctcccaggatctcctctcctctcctcctctcccgccccggtcctggggtctcctcctctgagctgtcctgagcacagcaggacaccacctctcttcagagatgggaccctcacctccaagagcctccactcctcacccccgctccaagcttttaggatcttcgttttgctcccccagcccttccactcgtcattgctttctggggtaacacatttcaccgtgggacatgagtgtcccatgttttctagcctctgcttcccaatgccctcttttacattctctcttaaaatagctagtgaggtatctattttcttgactggactctgatagggataatttctagacaaggtgggggaggagatatcaactttactatattaaaatcagatgtcaaggaccctgacttctacatttttgcatacccacaggaccgaatgaggactcttacaaatattcagcaaatggcggagtaatgaataatgaatgagtcaatgtgcccataaaagatacccacgtcctggggcgccaagatggcttagttggttaggcatgcgattcttgatttcagctcaggtagtgacctcagcgtctttttttttttaagattttttttttttatttatttatgatagtcacacagagggagacagagaggcagagacacaggcagagagagaagcaggctccatgcaccgggagcccgacgtgggattcgatcccggggccccaggattgtgccctgggccaaaggcaggcgccaaactgctgcgccacccagggatcccaagctcaggtagtgacctcagggtcttaaaatcaagacccactttgggctcctggctcagccaggagtctgcttgggattctctccttctctctctgcccctccccaccacactggtacatgctgtctctctccctctcaaataataaatgaaaaaatcttaaaagaaattcatgtcctaaactgtggatcctatgaatctttccttatacagaggggagaaggggtctttgcagatgtgatgattaaaaatcttgaactggggagattatcctagattgtcaaggttgctctaagtgcaaacagatgcatttttaaaaaagattttatttatttattcatgagagacacacagagagatagagaagcagagagagaaccagagagagaagcaggctccatgcaaggagcctgatgtgggattcgatcccgagccacccagggatccccaaacaaatgcattcttataagagggatgcaaaggcagatttggtagagagaggaaaaggtgatgtgcagatggagcaaagattttaagaggctggcctggaagattggagtgataagccaaggactgctgacagccattggcagctggcaggagcaaggaacagattctcatcttgagcctctggaactgttgtttgacaccatcaggttgtggtaatttgtttacagcagccccaggaaacaaatacatgaatattggattggatcagattattctttggggcatgggatgcaaaaagccactgccaaggcattcaatgcaagaaggaaaggagagggagaaaaatagagccacagattgatgtgggagaggactttcctgaggaaaatagttcttctgatgtcacatcccagtggcttaatcggacaggtcaatgtcctgtctattttcattccatttggacccctcattttcaactttctgacttattttatattctaacccacctactacctaaaaggatttgaagtggtttatagtaaaaaacaactctagagggcctgggtggttcagtcggttaagcatctgcctttggcttaggtcatgatctcagggtcctgggatcaagccctgcattgggctccttgctcagccagggagcctgcttctccctctgcccctcctctggcttatgctcgcttgcacgtgcgctctctctctcaaataaataaataaaaatctttaaaattaaaaaaagacagccctaagtaaatgtgaaatgagaggaactgaagtcacattataggagtcatcattaatttattcattctttaatttttttaagagttcagctttttactgagcagcttatagaagtttagtcaaaaagaccaaagctgggtcatctgggtggctcagtgattgagcgtctgccttcggctcaggtcggatgaagtcctgcaacgggctccccatggggagcctgcttctccctctgcctgtgtctctgcctctctctctctctctgtgtgtgtctctcatgaatagataaatgaaatctttttttttttaaagaccaaagcccatgtcattcttcattcttgtactcatttaaaacattctacccaccaaatgaatcttcccagcactgtgcttgatttgataaagatgctccttatgatgcaggaccaagatagtcagaaattatgaaacgagaatgaactgaagcagcttgatgtttgggctcagtatggctaagaaatagggttatacaccaaacatcagcctgcctgtgttctagtcttcactctgctgcttgtctggctcctgggacgcagtttcctccaatagcctggggacctgaatgactatatggaagaaggctggctgttcacctgctcagtattgttatataacacacaaagaaatatctattgtgtataagccttccatacttcgaggtctgtttgtggaagcaactggcttgtctttcagtacaacattctagggcaatagattcatcaattattggggataggatgcactgctgatggagcctgtaatactgggacataagagatatatatttgatcttcctcctgtttcttcttcctccttcctcctgtttcagagctcttaatacccttgaaatttcctaagaggcaagagcaataggagcattgtttgttgcaatatttagtcttttgtccttgatttcctgaaacagctccagagccataaaggtaaaaggagtgtcttattattcataacaaacctcttcaatcatacctgactttatttatgttaaggagatgacttttggaaagtccctaaggatggggggctggtttccagggcaaccaaccaccgattagaggattggaactttcactcccaaccccttgaccttgaaggagaagggctagagattgaggtcaatcagcaatgcccagtgatttgatcaaccatgcttatgtaatatagcctccataaaaaccccaaaggaggggcagcccaggtggctcagtggtttagcactgccttcagcccagggtgtgatcctggagacccaggatcgagtcccacgttgggctccctgcatggagcctgcttctccctctgcctgtgtctctgcctctctctctctgtctgtgcctctcatgaataaataaataaaatctttaaaaaaaaaaccccaaaggatggaggttcagagagtttctgggttggtagatgcattggaggttctggaaagagtgatgctctaagagaccatggaggcttcacatgtgctctgccttgtgcatctctcccatctggctgttcctcagtcatatctttctatcataaactggtaatctagtaagtatatgttttcctgagttccatgggcaactttagaaaactaattgaagctgaggagggcgtcatggaaacttctgaaatatactcgattggtcagaacacaaatgacaccctggacttccatgttggtgtatgaagttaatgtggggagtagtcttgtggcctcagcccttaacctgtgggatctgctgctatctctaggcagatagtgtcagaattgaattaaactataggacacccagctgatgtcacagaattgcttgatgtgtagaaaacacccacacatctgctgtcaaaagtggtgttgtaatagagatagagtgtgagtagcagaagaaatacagaaggaagtgagttttttctttacattgagtcattttggctgagagcagggcttagtaagcccctgagccaaatccagtctgccatctgtttttttgtctcttttctttgaaagtttaccaatttgtttattattttttttttttagtaatctatatgctcaatgtagggctcaaactcatgaccccaagatcaagagtcacatgctcttccaactgagccagctgggtgccccccttttaagttaaattgtatttttgaatagatataataagcacatgatagaacattcaaaaggtaaaaataaatatactttggaagtaatttcctctattcccatccacagttgcctacttttcctcctcaggtgcagccactattactggtggactcctgttgtctactagagatgttgagaatttgtgcatctaagtgtgtatgtgtattgcctaatccaggtcataacaatttacctatacatttcttctataattcagttctattgttttagctggtatcagggttatgctggtctcagaatgagttaggaagtgctccctcttcaatttttttggagaagtatgagaaggattggtattagttcttgtttaaatgtttgctagaatttaccagggaagcatcagatccaggagttttctttgttgggggatttttttttaaagattttattcatttatttgttcatagagacagagagagagagagagagagagagaggcagcgacacaggcagaaggagaagcaggctccatgcagggagccctacgtgggactccatcccaggtctccaggatcacaccccggggccgcaggcggcgctaaaccactgctgccactagggctgccctgttgggagattttcttaaagatataattgacttattacaacattgcattagttctaggtgtagaaacataattatttgatatatgcatgtattgcaaaattattaccataataagtttagtatcaccacacatagttacagatttttttctggtgatgagaatgtttaagatttactcctcgtgactttcagatatacaattcagtattactaattatagtcaccatgctgtacatgaatccccaagacttatttatcttatagctggaagtttgtacccattgacctcctttatccatttcactcatcacccccaccccagcctgagcaaccaccaatctactctgtcattatgggtttgtttgtttgttttttagattctatatataagtaagatcatctagcatttgtctttccctatctgacctatttcacttagcatagcattctcaaggttgattaatcttgttacaaatggcaagatttccttctttctttttttttttgatttccttctttcatatggcttctttcatattccattgtgtgtgcatgaacttatttatttgtatatatgcttaactcatacacatatgccaattaaaaaaaagattttatttttaagtaatctctacatccatcatggggcttgaactcacaaccttgagatcaagagtcacgtgctccacagattgagccagccaggcaccccctgacacacaccacattttatttattcatttatatgagatgctcatattatttttctcttcaatttagtgtgctttcatgtcttggctattgcaaataatgctgcaatgaatatgatacagtgattttctctcccttgtgaagatacccaggagtggaattgctggatcatggtagttctatttaattttgaggggaacccccatgctgtttttcacagtggctgcattaatttacattcccaagagcagtgcacgagggttcccttttctccacatcctcatcaacacatattctttcatctttttgataatagtcgttatgatgggtgtgaggtggtacctcattatcattttgatttgcatttccctgatgatgagtgacatcaagcatcttgtcatgtatctgttgtacatttatctgtcttctttggaaaaaatgtattcagagccttgcccatttattttattttattttttttcttgcccatttttcaattggattgtttggattttttgctactgaactgtatgagttctttacatatttgggtattagccccttatcacatatatgatttgcaaacattttctctcatttggtgggttctttctttctttctttcttctttcttttttttttttaagttgttatttatttatttgacagagagagagggagagtttgagcacaagcaggaggagcagcagagggcaagggagaagcagatacgccactgagcaggaaacctgacacagggcttggtctcaggaccctgggatcatgacctgaaacaaaggcagatgcttaactgactgagccacccaggtgccccatacttttttcctttcattgatattttctttgctctgcagattcattttaggttgttatagttccacttgttttttcttttattgcctttgattttggtgtcaaattcaaaaaatagtttcaagatcaatgtcaaaaacactttcctccatttttttcttctaggatttttatggtttcaggtcttacattcaagtctttaatccattttgagttgatttttatatctggtataagacagtggtgcagtttcattcttttaaatgtggttgtccagttttcccagcaccatttattgaagagacttctcctttcctcattgtatattccagcatctttgctgtgaattaattgaccacatttgtgtgggttaacatctgggttctctgttttgtttaattaatctgtgtctgttttagtgcaaatactatactatgttgatactatagctttgtaatgtattttgaaatcagggagtgatacctatagctttgttctttctcaatatttcttgtctaattgggatcttgtgtggttctatacaaattttaggcttgtttgttatatgtctgctaaaaatggcattggaattttggtagggattatgttgaatctgtagattgctttgggtagtatggacattttaacatttttccattccatgagaattaaatatctttccatttatttgtgagttcatcagtgtcttatagttttcaaggtacaggtattttacttttggttacatttattcctcagaaaaaaaaagaaaaaaaatttattcctcagtattttattattttttgacacagttataagtggctttgttctcttaatttctctttctggtagctcattattagtatatataaatgcaacaaatttttgtatattgattttgtatcctgcaagtttactaaatttgtttattctgggtttttgttttgttttgttttgttggtggcatctttagggttttctatattatgtcatctgcaaatagtgacaattttacatctctctttctggtttggttgccttttatttcttttcttacctaattgctctggctaggacttccagtactatgttgaataaaagtggtgagaatgagcatctttgtcctgttcctcatcttagaggaagagctttcagtttttcaccattgagtatgatgttagctatgggcttgtcatatacaatcattatgttgaggtatatgctcctgatacccactttgctgagagttttcatcataaatagatgttgaattttgtcaaatgcttattctgcaatatattgagatgctcataatatttttattattcatttgttaatgtagtgtatcatattgattgatttgtggatgttgaaccttccttgcttcctgggataaatccgcttgatcgtggtgtctgatccttttaatgtactgtggaatttggtttggtaatgctttgaggttttgcatctatgttcatcagggatatcggcctctagttttcttgttatgacctagtctgactagggtatctaagtagtgctgtctccataaaaagtgagtttggaatattccctcttcatctttttttttttttaattgaagtatagttgacacacaatgttatgttggttttaggtgtgtctatatactatgctcaccacgagtgaggctaccatctgtcaccataaaatgctgttacaatgtcattgactatattctctattctgtgcctttcattgtcatgattcactcaccccataactagaaacctgtgtcactccttcactcatttggcccatcctccacccttcctgctgacaaccatcaacttgttctctgtatttatgggtcatttctgctttctttttaaagttttatttatttaagtaatctctacaccccatgtgggctcaaactcatgaccccaagatcaaaagttgcatgctcttccaactgagccagacaggtgtccctgttttgttttttttttaaaggatttatttatttattttagagagagagagagagagagagagcatactagtagggggaggggcagagggatagaatcttcaagcagactccttgctgagtgtggagcccagtgcagggctcaatcccacaacctgtgagatgatgacctgagttgtaaccaaagagtcaagcgcttaaccgactgagctattgaggctcagtcatatagtgaatgtttttgctttttgtttatttgttggttgttttttttaaagatttatttatttatgatagacatagagagagagggagagagagagagagagagagaggcagagacacaggaggagggagaagcaggctccatgcagggagcctgacgcaggaccagatcccgggactccaggatcacaccctgggccaaaggcaggcgctaaaccactgagccacccagggagccccgttgttggttggttttattttttagattccacatataagtgaaatcatatgatgtttgtctttttctgacttatttcattttgtataacaccctctaggtccatccatgcggttgcaaatggtagaaactagttctttttatggctaagtaatattactgtgtgtgtgtgtgtgtgtgtgtgtgtgtatcacatctttattcatctattggtagacaattgggtggctttgatatcttggctattataaataatgtcacagtaaccataagggttcatatatctttttgtattagtgttttgttttctttgggtaacctcttccatttttggaaaaagcttgacataaattggtattaatctttctttatgtgtttgctagaattcaccagggaaaccatctggtcctggacttggcttttttgggaagtttttaattgctgattctatctccttattacttataattgtattcacattttcaacttctttatgatatagttggcttatcactctaggaatataggtggcttttgcactctaggaattttttcctttcctctagcttatctaattttttggtgtaaagttgttcatagcattctcttatattcctttttatttctttttttaaatttatttatttattcatgagagacacagaaggagagagaggcagagacacacacaggaagagggagaagcaggctccatgcagggagcccaacatgggactcgatccttagtacccagaatcacaccccaggctgaaggtggcgctaaagcactaagccactggggctgccctcctttttttttttttttttttttttttttttttttttaatttttatttatttatgatagtcaacagagagagagagagagaggcagagacataggcagaagcaggctccatgcaccgggagcccgacgtgggattcgattcctggtctccaggatcgcgccctgggccaaaggcaggcgctaaaccgctgcgccaccctgggatcccttgccctcgtttatatttctgtagcattgttagtgatccctacttcttcttctgatatttataatttgagtcttttttttttttaaagatttgtttatttatttgttcatgatagacatagagagagaaagaggcagagacacaggcagagggagaagcaggctccatgcagggagccccacgcaggactctatcccgggactccaggatcgtgccctgagccaaaggcaggcgctaagccgctgagccacccagggatcccctatnnnnnnnnnnnnnnnnnnnnnnnnnnnnnnnnnnnnnnnntgcttgtcaggggggcgcagcctatggaaatacgccagcaacgcggcctatctatctctctctctctgtgtgtgtgactatcataaatagatataaataaaaaaaaaataaaaaaaattgagtcttttcttttggacttagtccaatgaggtaaaggttgatctttttaaggatttgattttatgaatttttctctgtgtttttccattctttattttgtttctcttctctagtctttattatttccttccttctgctagctttgggtttagtttgttctttttctatctcctaagtaatacaattaggttgttgatttgagatttttaaaaaagaagtctctattattgtagacctgtctcttttacctttcaactgttaggtttttcttcatatattttgatggtttgtcaggaggtagataaatgtttataactgttttattttcttgctgtattgagcctatgattattattttattttatttctatttttatttttatttttaagtaggattcacacccagcgtggagcccaacaaggggcttgaactcaaaccctgagatcaagacctgggctgagatcaggagttgaacttttaagtgactgagtcacccaggggcctctttagccttttattaatgtatacttgtcctttgtctcttgtgaactttttaaattaactaattttggctgatattagtatggctactcttctcttttggttgctatatgcacggaatatatttttccattctttcactttcaacctgtttctgtctttgggtctcaagtgagtttcttgtagatagtatatcattggatctgtgtttttatccagttgtcttttgactgaagagttgaatccatttccacttaaagtaattacgtgacaagggacttacttctgtcatgtgctatttgttttctgtatatctttaaatttttaaaaaagattttatttattcatgagacacacacacacacacacacacagagagagagagagagggagagacacaagcaggctccatgcagggagcccaacgtgggactcgatcctgggactccaggatcatgcccctgggctgaaggcaggtgcccaaccgctgagctatccagggatcccctgttttctgtatatcttatagtctttttgtccctcatttcctgaattcctgtcttcttttgtgtttagttagcttttttgggagtgaaatgtttaaattctttcttaatttccttttgtgtatattgtaaagctattttctttgtggttaccatgggaattataattaacatcctaaaattagggatgcctgggtggttcagcaattgagcgtctgctttggctcagggcgtgatcctggggtcctgggattgagtaccgcatcaggcttcctgcatggagtctgcttctccctctgcctgtgtctctgcctctgtgtgtgtgtgtgtgtgtgtgtgtgtgtctcatgaacaaataaaagtaaaaacctttaaaaaagtcctaaagttaaaacattctaaaactgaatttatagcaacctaatttcaataacatacagaagctctattcctttacagctctatcctcacctcttttggctgttgatatcacatattgcatctttatatagtgtatgaccaaaaacatgaatgaataattcttcaaatacatcagtctcctaaattatgtagaaaacatgctttggagttaccaaccaaagttatagtagtagtaagactagtttttacactaacttaaagaaatgtatagtgttaaattatgtagaaaacaaaaagtagttacaaacacttgctataattatactagcttttataattgcccatgctattacttttattaatatatttagatctatttatggctttgaggtactgtccagtatcttttcacttcaccctgaagtactgtccagtatcttttcatttcactcctttgagcatttcttgaaggacaggtctagggcagccccggtggctcggcggtttagcgccgccttcagcccggggtgtgatcctggagtcccaggatggagtcccacatcgggctccctgcgtggagcctgcttctccctctgcctgtgtctctgcctgcctctctctgtgtgtctctcatgaataaataaataaataaaatctttaaaaaaaaaaaaaagggcaggtctagtggtcccaaactcccttaacttctgtttagctggaaatgtcttgatttcttcacttttggttataagaatcttggtctacagttttttgttttggcttgctttctcctaccctcaaaatttctttctttctttctttctttctttctttctttctttctttctttctttctttctttctttcgatttatttatttatttatttatttatttatttatttatgatagacatgggggagagagagagagaggcagagacacaggaggagggagaagtaggctccatgccgggagccctacggaggactcaatcctgggactccaggatcgtgccctgggccaaaggcaggcgttaaaccgctgagccacccaggaatcccccaccctccaaatttctgatgagaaatcagtttatgatcctattaaggatgacttgtatgtgatgatttgcttctctctttctggtttcaagattttctctttgtctttgggttttgtaagtttgattataagggtgcctgggtgactcagttggttgagggtctgacttttgatttctgctcaagtcatgatctcagggattgagccctgtatcaggctccacactcagcacagagtctgcttatccatctccctctgctcctcctcctgctcacatggtctctcccaaataaatgaataaataaaatatatttttttaaagaaagtttgattataatgtatcttggtgtgagtctctttgagttcatcttatttggaattcattgagcttttttggaactttatgttctgtatttcattaaatttaggaagttttcagccatcattccttctaatattctctttgcccctctctctctcttctggactgtcatgatgtgtatgctcatccactgatggtgtcctacaggtcccttaggctctgttcacttttcttcaatttttttcctgttccttagcctcaataatttccattgtcctatcttaaagttcactcagccataaaaaagaacaaaatcttttttttttaaagattttatttatttattcatgagacacagagagaggcaaagacacaggcagagggataagcaggctccatgccgggagcccgatgcgggactcgatcccgggacccaggatcacgccctgggccaaaggcaggagctaaaccgctgagtcacccagggatcccaaaaagaacaaaatcttgccatttgcaatgatctggatggagctagtgagtgttaatgctaagtaaaataaatcaatcagaaaaagacaagtaccatatgatttcactcatatgtgaaatttaagaaatagagagagggagaggcaaaccaagaaacagactcttaactatagagaacaaactgatggttgcagggaggggaaggagtgggggaaggggtaaaacaggtgatgaagattaaggagtgcacttgtcctgatgaacactaggtgatatatgggaccattgaatcactatattgtgcatctgaaactaatattacactgtatgataactaactggaatttatttgggtttttgtgtgtgtgtgtgtgtgttttaaagattatttatttatttaagagagagggcacacagtgggaaggggcagagggagagagagagaagcagactccccgttgagcaaggagcccgacatggggctccatctcaggaccctgggatcatgacctgagctgaaggcagatgcttaactgaatgagccacccaggcaccccaactaactggaatttaaataaaaacattttttaaaagttcttatcacaagaaaaaattgtaactatgtatgatgacagatgttgataagacttactgtctacattctggggagcttccatgcaccctccagttttgccactctccctgcctctgcacgtgttcacttctctatatgctcatgactaagtcattgacctttgctgattcaacttccagcccctctcccctccctggaggtcagaaggagcaactgaaagttccaaccctctaatcacatagctggtcctcctggcaatgagccctgccctcaagtggggtccaaacatcactgccattaataacaagacattcagcccaaccatatgactctgaagcattttcaggaactgtggatgaagaccaaatatatctgagaaacatattttagtaataggaatgaccaaatatgtattttttaaaaaggttttatttgtttacttgacagagagagaacacaagcagggggagagggagaagcaggtttcctgctgagcaaggagcctgatgtgggctcaattccaggactctgggatcatgacctgagctgaaggcagatgcttaatggactgaaccacccaggtgcccccaaatatctattttaaaaaaaaaatattttctttattcatttgagagagaaagacagagagagcacaagcaggggggaggcagagggagagggagaagcagactccctgtcaagccgggagcctgatgtggggctccatcccaggacctggagatcatgacctgagctgaagcagatgcttaactctctgagccacccaggcaccccctcaagtatgtacttttaataaatcattatatcacagttgatattaatctgaaatctattatatattaagatattaattgtaacccccatggcaaccactaagtaaattatatatatatgagaaatttgattctcattttaattcatatatatgggaattaaaatgttacactagaaaatcactaacacaaaagaggtggtggtgatggagtagagaaaaagccaaatgtcaagagattgagacatacagagaacaaatagcaaaatgtaaatcctaccttatttgtaagtatattaaatgtaaatagattaagcactcaagttgaaagagatgggcagaataaatttgaaaacaagttttaactatatgttgtctacaagatacaaactttagattcaaagtcacaaataaattgaaaataaatggatgggaagaagatatatcatgcaaatagaaaccaaaagagggttgatgtggcactatgaatatcagccaaaagagactttaggacaaaaattagagtgaagaatgttattttatagtgataaagtgagtcaatccatcaagaaaacagaataattataaacatatatgtcccagagcttcaatatacatgaagcaaaaattgacagacttgaagggagaaatagacaattcaacaacaataggtggaaacttcaatatccaactttcaataataggtaggaaaactggatagaagatcaacatggaaatagaagatttgaacaacaatataaactgtcgagacctaacagatcttcctcaaagaagccatccaagaatagcagaacacacattcttctcaagtgtacatggaacattctctaagttgaccatatgttaggtcataagacaagcctcaacaaatttaaaatgtgaaatcatacagagtatgttctgaccacaatggaatgaagttagaaattaataacagaaggaaatttggaagattcacagaactgtggaaattaaacaacataatccttaataacccatgagtcaaagaagacatcacaagggaaattagaaaatactctgaggtaaatgaaaacaaaaatgcaacatgccaaagcatccctccagaatgcagtgaaagcaatgccgagagggaaatctatagctgtaagagcctatattaaaaaaagagagatctcaagtccataacctaaacttcttccctaagaaattagaaaaagatcaaacaaaacccaaaacaagcagaaggaataaaataataaagattagcatgaaaataaatagagactaggagaacaatagagaaaatcaaggaaaccaaaagttgggttttaaaaagatcaacaaagttgacaaggcaaagccacccccttccatcacacggtctgatttctgcaaacatgccatttcaattatctattgctgcattacagactaccccaaaacattgacttgagacagaggcaaccatttatttgtccccaattctatattttagtcagggttcagtgagcatgatgcaactctgctccacatggtaggtaatccagaagctcagatggggctgttatttccaagatggcccactcccagggctggtcgtttgtgctgactcttggctggggctgtagatcccttgaatgtgggcctttccctgtgacaactcaggcttccttacagtatggcaactgcatctgccttcagcttagggtgtgaccttggagtccctggatcgagtcccacatccagctccctgcatggagcctgcttctccctctgcctgtgtctctacctctctctctctctgtgtctctcatgaataataaataaatcttgaaaaagaaaaaagaagatatggtgtgtatgcatgtatgtatatatatgtatatatacacacatatatataatacacatatacacatatatataatatacacattacatccacatccacatatatacatatgtacatatccatatacatatatatggatggagttaaagagtataatgcttagcaaaataagtcagtcagaaaaagacaaatgctatatgatttcactcatatgtgaaatttaagaaacaaaacaaataagcaaaggaaaaaaagcaagagagagaagccaagaaacagatgccctttttaaaaaagattttatttatttatttatttatttgagagaaagcacatgagcaggggggaggggcagacagggagggagaaggagaatctcaagcagactccctgctgagctcagagtccaactcagggctcagtcccacgaccctgagatcatgtcctgagatgcttaaccaactgaacaacccacacaccccaagaaacagactcttaactgtgaagaacaatctgatggtgaccagagtggagggggatgggtgaaataggtgatgcggattaaggagtacacttgtgatgagcactgggtgatgtatggaagtattggatcactatatcgtatatctaaaactaataaaatattgtatgttaatgattttttaaaagaatcatacaattcaacactaagaatattaatctgattattaaaataagcagaggacttgaaaagacattttttccaacaatatacaaatggccaacagacatgagatgctcaatatcactggccatcagggaaatgcaaatcaaaatgacaatgagctctcatctcaaacctgtcagaatggctactatcagaaagaagaaataagtgctgataagaatgtggagaaaaggtaacccttgtgcaccgttggtgagaatataaattggtgcagccactatggaaaacagaatgaagatccatcaaaattaaaaatggaaatactatataatctagtgattacacttctcagtatttatttaagaaaattaaaagactaatccaaaaagatatcctcacccctatgttgatggcaacattatctacaatagccaagatgtgaaagcaacctcagtgttcattaatagatgaatggataaagaagtgatatatatatatatatatcccactgtacacacacacacacacacacacacacacacacacacacaatggagtattactcagccatcaaaaaagaataaaatcttgccatttgcaacaacatggaatgacctagagggtattgaactaagtgaaataaatcagagaaagacaaataccatatgacttcacttatatgtggaatctaaataaacaaaacaaatgaacaaacagagcaaaatagaaatagactcataaatacagagaacagtgggggtggggggaaaataaatacagagaacaaactggtggttgccggtgggggggattagaaggatggacaaaataagtgatggggattcagaggtacaggcttccagttataagataaacaaatgatgaggtgcaaggtacagcttagggaatgtgcaggcttaccctgttttattgaacttcacttttttgcaatttgcagatactgtgttttttacaaattgaaagtttgtagcagccgagcatctgcaaatatcagtgcctttctcccaacagcacatatttactttgcgtctctgtcaattttggtgatcctcaatatctcaaactttttcatttttactatatttgttagagtggtctgtgatcagtgatctttgatgtttctattgtaactgtttgggggcctcacaaactgtactagtataagatggggaacttaaatattgtgtgtgttctgagtgccaatcagctattcctctgtttctttccctttcctctggcctccctatgcccagaaacacaacaatattgaaattaggccaattaataaccctacaatggcctctaagtgttcaagtgaaaggaagagtcacatggccctcactttaaattgaaagctagagataattaaacttaatgaggaaggcatgttgaaagccaagacagatcaaaagctaggcctcttgcaccagttagccaagttatgaatacaaatgaaaagttcttgaaggaaattaagtgttactccagtgaacacatgcatgacaagaaagcaaaacagcctcactgctgatatggagaaagtttgagtggtctgtatagaaaagcaaaaaaaacaaaacaaaacaaaacaaaaaaaaacaaaaaaacaaaacaaaacaaaaaaacaccacaacattcccctaaggcaaagcctggtccagagcaaggccctcactctcatcaattctgtgaaggctgcaagacgtgaggacgctgcaagagaaaagtctgaagctaacagaggttggtacacgaggtttaaggaaagaagccatctctgtaacacaaaagtgcaaggggggaagcagcaacgagttatccagaagatctagcttagataatccatgaaggtggctacattaaacaagagattttcaatatagatgagacaggcatcaattataagaagatgccatctgggattctctaatctagagaagagaagtcggtgcctggtttcaaagcttcaaaagacagactgactctctcattaggggctgatgcagctggtgacgttaagttgaagccagtgttcatttgccatcctgagaaaccgaaggcccttaagaattatgctaactctactcagcttgtactctacaagtgaaagaaagcctggatgacagcatatctgtttccaacatggtttactgaatatcttaagcccactgctgggagacctcctgctcagaaaaaaaaatttttttttgtttcaaaatattactgctcattgaccgtgtacctggtcacccaagagctctgatggacaacgagattaatgttttcatggctgcaaacacaacacccgtttcgcagcccatggatcaagaagtcattttgactctcaggtcttactatttaagaaatacacttcctaaggctatagctgccattcctctaatggatctgggccaagtaaattgaaaaccttctggaaaggactcaccattctagatgccattaagaacgtttgtagttcatggtaagaggtcaaaatatcaacatgaataggagtttggaaatagtttattccaacccccatggaggactttgatgggttcaagacctgagtggaggaagtgactacaggtagggtggaaatagcaagagaaatagaatcagaagtggggcctgaggataagcccacatggcttcaatctcatgatcaaacttgagtggatgaggagctgcttcttaccaacaagcaaagaaagtggtttcttgattcccgtcctttcccttataatcccttttactatttcttatattccatgtatgagtgaaaccatacgatgattgtccttctccatgttgacaaatcaaacttcaataaaaacaaatgtaaaaaaaactggtttcttgagatggaatctaccccttgtgaaggtgttgtgaagactgttgaaatgacacaaaagatgggcagcctgggtggctcagtggtttagcgccaccttcagcccatagcatgatcctggagacctgggatcgagtcccacatcgggctccctgcgtggagcctgcttctccctctgcctgtgtctctgcctttctctctgtgtctctcatgaataaataaataaattttttttttaaatttatgatagtcacagagagagagaggcagagacataggcagagggagaagcaggccccatgcaccgggagcccgatgtgggattcgatcctgggtctccaggatcgtgccctgggccaaaggcaggcgccaaaccgctgcgccacccagggatccctaaataaattttttttaaaaagaaatgacaccaaaggatttaaaatatttcctaaatgaagtggataaagcagcagcagggtttgagaggaatgactccaattttgaaagaagttctactgtggataaaatgctatcaaacagcatcacctgacacagaaaaattgctcatgagaggaagagtccatcagtgcagcaaacttcattcttgtcttattttcagacaacagccaccccagctttcagccaccaccaccctggttagcagtgatcaacatggaaacaggaccctgccccagcaaaaatgattacaacttgctgaaatcccatatgctggttgtcatcttttagcaataaagtattttttgtttaaggcacatagattttgttagacacaatgcaaaccacttttataggtactcagaaaccaaagaattcatttgacttgctttcttgggatatttttattgtggtgatctggaactgaacccacaatatcttcaagataagcctgtaataattttgttgggtgatagatggtaactcgatttatcatggtgataatttcataaggtctaagattgaattaccacattgtacacctgaaattaatgtaatattgtatgtcaactatacttaaatttaaaagagagagagccaactcacctaggagcaacatggaaaggagatacagaaacataaagtcttttgccaatgaacctaggagccatctgaaatcctgagctttagcagagggagcccaaaaagcagctgccaccaagcaaagtcattaaagaaagaagtaaaaaaaaaaaaaaaaaatgtcagaggggacctgtataatcataataacagcacagaagtgcctgggcggctcagtcggttaagtgtctgccttcagttcaggtcatgaccccagagtcctgggatggagccctgtgttagaccccctgatcagctgaggaagcctacctgtacctctccctccacctttaatgtgtcagtagtgattctatgtgattctagtgattctatgtgactttcaaaactggcctctaagtgatctgccatttccacctttactctttgaaacactccttcttggaactcaactgctgagtcacccaggcgtcccacaccacaccctctttacgcattcatctatggatggacacttggggtgtttccataatttggctattgtaaacaatgcttcacataggggtgcatgtatttctttgaattagtgtgtttgtataatatacaaaataaataaaatacccagtaacatgattaccggatcctagggtagttctatttttaactttttgaggaacctccctactgttttccccagcgactgcaccagtttgaattcccaccaacagtataagagggttcccctttctctccatccttaccaacattgatgtttcctgtgttgttaattttagctgttctgacaagcgtgaggtgattgtagttttgatttccacctccttgatgatgaatcatgttgagcatcttttcatgtgtctgttggccagctggctctcttctttggagaaatgtccgctcatgtcttccactcatttttaaattggattatttgggtttttttgagtgttgatttgtgttggtttttaatatattttgaatactaaccctgagttgtgtgaattgtttataaattttggatattaactgcttattggatgcagcatttgcaaatatcttctcccattcagaaggttgccttttcattttattgatggattctttcactgtgcaaaagctttttagtttgatgtaattccaatagtttattattgcttttgttgccctagcctgagggtatctaaaataatattgttgggcagcctgggtggctcagtggtttagcagcaccttcagcccagggcatgatcttggggacccaggatcgagtcccacatggggctccctgcacggagcctgcttcttcctctgcctgtgtctctccctctctctctctgtctctcatgaataaataaataaaatcttaaaataaaaatctttaaaaacaaaaaataaaataatattgttacgactgatgtccatggagcacctggctcactcagttggtagagcacatgacttttgatcttggagttgtgagtttgaccccacgttgggtgtagagattacttaaaatcttttttttttaaagattttatttatttatttattcatgagagacacacacagagaggtagagacataggcagagggagaagtaggctccttctggggagcccagtgtggaactagatcccggaactctgggatcacgccctgagccaaaggcagacactcttgctgagccacccaagcgtcccttaaaaataaaatcttaaaaaaaaataaaagaccaatatatgtaataatttactgtctatgttttctgttagttttatagtttcaagtcttacatttagatctttaatccacttagagttcacttttgtatatgctataagaaagtggtctagcttcattctttttcatgtagctgtccagttttcccattaccatctatggaagagaccatcttttccccattgtactttcttacctcttttgtcatagattaattgcccatataagcatggccttctttctgggttctctgttctgttccattgatctatgtatctgtttttatgtcagtattgtactgctttggttactatagctttgttgtatggtttgaaatctggggtgtgatacttccagctctattcctttttctcaatatgccatgactatttgggatcttttgtggttatatacaaattttaggattatttatatttattttataattattaaaatatttatttttaatatttaatattttgaatagtaaatatttaatttaatatttgttaaaatatttatttttaatatataaatatatttacatattaaataacatattatttattattactgtaatacaacaatgggatgcctgggtggctcagcagttgagcacctgccttcagcccggggcatagtcctgaggtcccaggattgagtcccacaccgggctccctacatgaagcctgcttctctctctgcctatgtctctgtctctgtgtctctcatgaataaataaataaaatcttttaaaaatacaaggataatatattaaataatatttatatataataaatatgatttataatgtataattttcaagaataataaatattcttgaagaacactattgatattttggtagggatggcattgattctgtagattgctttgggtaacatggatattttaacaataattttaattcttccagtccatgaacatggtatatctttccatttatttgtgttatctttaatttccttcatccgtgttttagttttcagagtactggtcttttacctacttggttaaattcatttctaggtatttttattattattatttttattatttttaaagactttatttatttatttatttatttatttatttatttattcatgagagggagagagagagagagaggcagagacataggcagagggagaagcagaatccccacaaggagtctgatgtgggactcaatcctggatcctggaaccaggacctgagccaaaggcagaccctcaaccactgagccatccaggtgtcctgatattttattattttttgatgcaattgtaaatgagattgttttcttaatttctttttcagctactccattattagtatgtagaaatgcaacagtattaattttgtatcctgcaacttcatttcttagtactaatagttttttggtggagtgtttaataatttctataatatagtatcatgtcatctgcaaataaggatggtttcacttcttacaaatggattgtttttgcttctttttgttgtctgattgctatggctaggattcaaatattatgttgaataaaagtgatgagaattgatatcttgttttgttcctaattttagaggaaaaagctttcaacttttcaccgttgagtatgatgttggctgtgggtttgtcatatatgacctttattatgctgagatatgtgccttcaatacccactttgttgagagttctttttatcatgaatggatgttgaattttgtcaaatgctttcttctgtatttattgagataatcatatgatttttattcctcatgttattaattcactgtatcatgttgtttgattagcagatactgaaatatccttacatccctaaataaattttacttgatcatggtgcatgatctttcaatatagctttgaattttatttactaatattttgttgaggactttggcttctatggtcatcaagcatattggcttatatatttttttctatctaatgcctttggttttggtatctgagaactctagcttcatagaatgaatttggaagcattctttcacaagtttttggaatagtttgaggaggataggtattaattcttaaatgtttggtagaatccacttatgaagccatctgctcctgggcttttatttgttaggagtttttaaattaccacttcaattcattactagtaattggtgtttttagattttctatttcttcctgattttgtcttggaagattatacatttctaggaatttatccatttcttctaagttgtcttatttgttggtgtataattgttcatagtagtctcttacaatcctttgtatttctgtggattcgttgtaaattttcctcttttatttatgattttatttatttgagcccccatctcttttattccccctgaagagtctgactaaatgtttattaattttgtttatccttttaaagaataagttcttaatttattatttccttttaaaaaaaactaactttaggattttttctcttctttttctagtttctttaggtgtaaggttagtttgtgtatttgagattttcttgcttcatgaggttggcttgtgccataaactcccctcttagaactgctttagttatgtgtcaaaaatttggaactgttgtgtctttacttgtctccagatatttttatttccttttttgatttcttctttgacccactggttgttttgtaacatgttgattagcctccacatgtttgtgttttttccaatttcttttcttgtaattgatttctagtttcttactgctatattcagaaaagatcgttgctgtgatttcaaacttcttaaatttattgagacttgtctttggcctaacatgatctatcatgaaaaatgttccatgtgcacttgaaaagaatgtgtattcctttgtttttggatggaatgtctatatatctattaagtccatttggtctaatgtgtcattgaaagccactgtttacttattggttttctgtctggattatctatccattgatgtaagcaaggtgataaaatctcctactattattgtgttattattaatttatcttttttcttaatttcttttatgtctgttaatatttgctttttacattaagtcctcctatatttggtgaataggtttggtggaggcagagatttataattattctgtcttcttgttgggttgatatctttagtagtatgtaatgccctttgtgtcttttgttacagtctactttaaagtctaccccaccttcatttttgtttctatttgtatgaatatgtttttccatccttttactttagtctatgtgtctttaggtctccagtgagtctcttgtaggcaatggattaatggatcttgtttttatttcttcagtcactctatgtctattgattggaatatttagtccatttgcatttaaaatagttatcaatagacatgtacttattgccattttgttcattgttttctggtttttcttcttttgctctcttttggtattatgtttggattcctttgtctaatcttttgtttatctaagtttttggtttttggttaccatgaatttcatatgtaacatcttatgcacatagcaatattttaacttgatggtcacatcagtttaaataagttttaaaagcatttttacatttttaccccccagctttatgctttatgtacatgatatcatattttatatctttttattttgtatgttgcttaactaatatttcagatattttttatttttactacttttgtctttaactttcatactatcttttaaagtagtgaatccattacctttaccatatgtttgcttttaccagtgagatttttcctttcataatttttttactttgagctatgtccttttctttttaaaagattttatttatttattcatgataggcagagacacaggcagagggagaaacaagctccatgcaggaagcccgatgtgggactccatcccaggacttcgggatcacgccctgggctgaaggcgggtgccaaaccgctgagccacccaggcatcccatccttttcctttccacgtgaagaagtccctttaacatttcttgtaaggtcagtttagtggtgataaacccctttagcttttgttgtttgggaaactgtttctccttcagttctgaatgataaccttactggtagcatattttgttttctttaaatattttttaaatttatttgacagagagagagagcgagagagagcacaagcaaggggagtggcatgcagagggagaagaagaagcaggctcccttctgagtagagagcctgatgtggggctcaatcctaggaccctgggatcatgacctgagctgaaggcagacacttaactgactgagcactcaggcacccccaggtagagtactcttagttgtagggtttttttttatattattttcagcactttgtatatatcatgccatttttttattggctataaagtttctgctgaagaatcagctgctaatcttatgagagtttccttatgagagttgtatgtaactagttgcttttctgttgctgctttttatttttattttttttaaacttttatttatttatgataggcacacagtgagagagagagagagagagaggcagagacacaggcagagggagaagcaggctccatgcaccgggagccctacgtgggattcgatcccgggtctccaggaccgcgccctgggccaaaggcaggcgccaaaccgctgcaccacccagggatccctgttgctgctttttaaaaaagattttatttatttatttatttacttatttatttagaaagaaggagtagaaggggcagagggagagagagaatctcaaacagattccatgctgagtgcaaagtccaatgcatggctcaatcttatgaccctaagttcataacctgagctgaaatcaagagctagaggcttaaccaactgagccacccaggtgctctcttttctgttgctgttttaaagattctttctttatttctaatttttttaaatttattttttattggtgttcaatttactaacatacagaataacccccagtgcccatcacccattcactcccaccccccgccctcctccccttctaccacccctagttcgtttcccagagttagcagtctttacgttctgtctccctttctgatatttcccacacatttcttctcccttcccttatattccctttcactattatttatattccccaaatgaatgagaacatataatgtttgtccttctccgactgacttacttcactcagcataataccctccagttccatccacgttgaagcaaatggtgggtatttgtcatttctaatagctgagtaatattccattgtatacataaaccacatcttctttatccattcatctttcgttggacaccgaggctccttccacagtttggctatcgtggccattgctgctataaacatcggggtgcaggtgtcccggcgtttcactgcatctgtatctttggggtaaatccccaacagtgcaattgctgggtcgtagggcaggtctatttttaactctttgaggaacctccacacagttttccagagtggctgcaccagttcacattcccaccaacagtgtaagagggttcccttttctccgcatcccctccaacatttgttgtttcctgccttgttaatttgccccattctcaccggtgtgaggtggtatctcattgtggttttgatttgtatttccctgatggcaagtgatgcagagcattttctcatgtgcttgttggccatgtctatgtcttcctctgtgagatttctcttcatgtcttttgcccatttcatgattggattgtttgtttctttggtgttgagtttaataagttctttatagatcttggaaactagccctttatctgatacgtcatttgcaaatatcttctcccattctgtaggttgtcttttagttttgttgactgtatcctttgctgtgcaaaagcttcttatcttgatgaagtcccaatagttcatttttgcttttgtttcttttgcctttgtggatgtatcttgcaagaagttactgtggccgagttcaaaaagggtgttgcctgtgttcttctctaggattttgatggaatcttgtctcacatttagatctttcatccattttgagtttatctttgtgtatggtgaaagagagtggtctagtttcattcttctgcatgtggatgtccaattttcccagcaccatttattgaagagactgtctttcttccaatggatagtctttcctcctttatcgaatattagttgaccataaagttcagggtccacttctgggttctctattctgttccactgatctatgtgtctgtttttgtgccagtaccacactgtcttgatgtatttctaatttttgacaaattattatgtgtctttgtgtggacctctttggattcatcattttgggtgctctctgttgttcatgaatctggattactattccctttccaggttacagaatttttcagctattatttcttcaaatacatcgtcttcttccctttctcttccttccactcttgggatccctaaaatgtgaatgttagtatacattacattgtcccaaaggaccctcccttactactctactcattaaaaaaaattctttttgatattttatttgaatgattttcagtaccctctgttccaggtcactaatctattcttctacatcatctaatctattattggtttcctctagtgtatttttcatttcagttactggtctttaaggagtggccttatatggaaggcatcctgtgaaattcagaatgcaatacccctggttaccagaaccaggctctccagaggtgtccctctgtgggctgaggtggctgctggccccaacctatttgctttgaggaatacctgtgactcttgtagttgcactggtgagcggtgcttgtcttctccttggggcagggatcactctggtggtgcacctgctctgaccacctgctgggttcagcagggcaagagctgctttggtggaacactagtcccagctgagctgcttgatggctgtagtgggtcagtagctgctttggtggggctctggtctgggtgtgtcaggacatgatctactttgcaggggagtgactgcttggatgtgtgtgatgggcagggtgtgtcctcagggacatgttcattagggtaagagtgagtccacaggggagagagcagtgctagtaatatagtggagagtgttagaactggcacccactggcatcagccagctaggcagaaaagggcaagaaaaatgttgcccaccagcatttctgttcctggagaaatttcctacaaatccctgtccctctcgtatataccctaagattattcaataaatctccttcacatttgtcctgacactttttcttttcttttctttctttctttttttaagattttatttatttatttaagagggagagagcacaagtggtagggaggaggagatggagaagcagactctgtgctgagcagggagccagacacggggcttgatcccaggaccctgagatcatgacctgagctgaacacagagactaaactgactgagccctccaagtgccctgtcctgggcacttttcaaactgctgcttctgtaccaggtcctggaataaaatggataaatttgtgtgtagaccttttaagagtggtttctgtttcttatagcactctggctttcctggaattaagccctactgattttttgaagccaagtgttctgggggctcatcttggtgcaggtccccagggtagggggggtgtcctgatgtgtccttgagtgaggaagatggactcaggttcctcctgctccaccatcttgatcaggatctccagggctttcctgatgtatgatgtcttgcttccatatatttctaccttcattcatttagtagctcacaaagcaagtcatcataagcatctaggaagtgggactggaggtcggcatgtttttcagcccctgcctatgggccagatgcctactcccttccctcagctcactggtggtgtgactggatggtgcttctgggagttttgacaggagggaggaaaatggtctttttattctaccgtgaatgaaccagtccaacaaaacaattttgaggaagaataagactaagcttgttccaccagctgtcaaggcttattattaagctatggtgactaaaaccgtaatgcacacacacacacacacacacacacacacacaattggcagcctagaaaaaaatccaatacatacaggagtttggctttggctgaggtgccattataaaccatgaaggaggggcacctgggtggctcagtcagttaagcttcagctcggtcatgatcccaggatcctgggatggagcctcatgtctggctccctggttagtggggagtctgcttctccttctccctctcctcctccccactacttgtgccttctctctctcaaataaataaataaaatcttttttaaaaaccatgaaagaaaagatggactaagcaataaatggtactgaaaagttaacagtaaatccttatctcacaccatacaaaatgcattttaggattaaataccacatgttcacctctctctctcactctgaagctcctctaaaatgatagtaaaggaatttaaaaaaaatatttattcggcagagacacagagacacaggcaaagggaaaagcagactccccgctgggaacctgatgtggcactcaatcccagaatcttgggatcacgacctgagccaaaggtagacactcaaccactgagccacccaggtgttccaggatttttttttcttttgagagagagagagagagagagagaatgagaatgagggagagagagaggagatggtggagggtggtgaggggcagagggagagggagaatcttaagcaggttccacacccagggcagagccctacataaggcttggtctcacaatcctgagatcatgacctgagctgaaatcaagagttggacacttaaccaactgagccacccaggtactccgacagtgaaggaattcttaaaagcatgaacccaaaaggataaagagatgaaaagtggatggccaagtggtagctgagttagatgcagggagaaggtgtggaggtttaagccaggaagaagaaaggagatttgtaagacagaactctggggaggctgagaaatttgaagtgacagttatttctgaagggggtgattcagtatggggccaggagaaggatttttttttaaatatatttttaaagattttatttatttattcatgagacatacagagagagagacagacagacagacaggcacagacagagggagaagcaggctctatggagggagcctgacgtgggactcgatcctgggaccccaggatcaggccctgggctgatggcggcactaaactgctgagccacccgggctgccacaggagaaggattagatggaagtttttaagagaccacctcaccaccttccaaggagaaaactagacccttctttgtcaaggctgtgccataccttcccagcttaggatggaggcaggaatagttgaggagttggggcaccccaaatgctgacaccagggcccttgccttattaagctctgagaacagggacagatggactcccattccccaaataggaagtgggaaaatcctcccttgggtacaagggccagctcaagaggaaagagctgtggagacttccatgtaggggttcccaacaatttttcacataggaagatgctctgcctcacctataatgaggagaatgcaaatgagaacaaaaatacagggtacctgggtggctcagtcagttgaacatcgactctcgattttggctcaggttgtgatctcagggtcgtggctttgagctccttgtcaggctctgcactgggcatggagttggcttgagatttttccctctccccctgccccctcccccactcatcttcaataaaaaaataaactaataatccttttaaataaataatctatttcaaaatgagatctaatggccaatgagatgagcaaatattaagatgttctaaaaccaaatgttggaaatatttagggaaacctgagcttgtacacacactagggtagatcaatgtagtatagctacttgggagactgttcattaatacatagtaaagttgcagatgcccataacctatgtcaactctcagtgtggatacagaaaggcaggaatacaaggacatgcactgtggcagcttgtaatagcaaaatcatgaaacaacctaatgtgctccgggaatgggaacaaacagacatatagcttacactgtgggatagtctgagtgttaaaatgaatgaatcatgtaggggaggaaacattttccctttccttctaggttctttggctgatcccataattactttgacataatgcagattaacaggataaaaaccaatttcatttcataggtacagaaactccataaaaaatgagtgaaagaaataactaaagcaggaagcttttatacatatcagacaaagaaacaatatatttgtgtagaattgactgaacagatgggtgtgggttggggcagtaaattggtgacttaagcaggaaagggttcatgggaggatattgagtagttgacagagtctccagaagagccagagaaccagagtccagaactgaaccctgtggcagcagctgagtgtcagggcccctggtgggcactgccctcattgtcagcgggtggcggtgatcacagagcccaggtcccatgcctgcccctagctgccagtctgcaggccagctgggagggtgggaagccggccttttagcttttatggtgaaggagactcttcctcctccttggaagggatttccaacactgagcaatcaaaagaatgacaaatggccatgtctctatcgtataacttaaaaacacccaaagccatagcctagtttgtttggagataaagacatagtaaaagtataaaatcatcaaaatcattgaaatcatcgacggagatgctgtgcactaactagggtaataggtgcctttgagagggagggtaggggaaaagatgaaggtcttcagttatatctgaaatatttaatttcttttttaaaaagactttatttattagagagagcgagcatgaggaggaggagggggaaggggaagacacctctgtggtgtcttcagagggagaagcagacaccacactgagcagggagcctgacttgtggcaatcctaggacccttgaatcatgacctgagccaaaggcagatgcataaccgactgagccacccagcacccctgaaacaatgtatttcctataaataaaacctctgaagcaaagatgacaaagatgttaaaatctgcttatgcctgatggtgggtacatggacatcattgtcttccatgctcatatgtatgctacaaatatttcctaattaaagtcacttccataaatcaaaagtatgtgtcagcaactcaaggctctacagacatcttaaaaataatggttgaaatgcaaatgcatcctgtaccctccccggggcgtggacagttctgctcactagcacccacctaccttaccgtgtttcccacactagggtgcagcctccgcccccatcaactgagaactgtcagagctgctcagtggaaattgtgaggctaaggcttggcctggtgctcttcattgggaaggagtgattcatgtcatgatcgaaatcctaagccctggaatctgtctccctaggagttacctggttgggaagatctgagacaactactgaagagacaacaaaagtcatggaaaagttggaaaggttttgttaaaaaaaaaaaaaagttcaggcactgactctctggccagtagaagtgagtgagtgtgtctttttctatatatgattttttaaaacttgggatacaattgacatataacatcggacaagtttcaggtatgcattcaggtgtgttcaatatatgtatatattgcaatgtgattaccaccacggtgttaactaacacctctatcacatcgcataattatcttgtgggtgtatgtggtgaggacatttatgatctagtctcttagcaactttgaagtatatcatacagtatcgttgactataatcattatgctatgcgttcaatctccagaacttagtcatcttctagttgtaaataaatactttttaacaacatccttcgactctacgcattgcgtccccaaccccctggtcaccaccattctctctgtttctatgaacttgacttcctaaaattccacgtatgagtgagatcatacaatatttgtctttctctatctgacttatctcacttaacgccctcaagttcccatccacatccacattgttgcaaacggcaggctcttcttctttctcatagctgaaaaatattctaaagcatatatatacaccacatcttctttatctgtttatccattgaaagactcttagttgtttccatgtctcggctatcatgaataatgctgcctccaaaaataatttttaataataggaaatccatttcttctcgtccctccccacccaagtaaatggttagcaaatatctaaagactatggtttgaaaggataccataccaaaggattgttagcctgccagggttatcatctgtcttagtttggtctttttttcttttctttctttctttcttttttttttttttttagtttggtctttaatatagtttctagactagaatgtgagttcaataaatgttagctattattactcaacagcaataaagcaagaaacctatattaaaaagggggacaaaggacttgaatagacatttctccagagatgatacacaaaaggccagctagctcatggaaaaatgctcagtatcactcatcagggaaattcaatctcaaaaccacaatgagacatcacctcacatgcattaggatgggctactaatcaaaaccacagaaaatgacaaatcttggcaaggatgtggagaaattggaacccttgtacactgttggtgggaatgcaaactggtgcagacttgatggaaaacagaatgatgatccctcaaaaacttaaatgtaaaatcatatgatccaacaatcccattactgaaagagaattgcgaagagatattttgcacactcatgtctatagcagcattattcacaattgccaaaaggtggaagtgacaaaagtgtccatcagtggatgaatagataaataaatgtggtctaggcatacaatggattattactcagccttcaaaaggagggaaattctgacaccttctgcaacatggaagaagctggagaacattttgctcagtgaaataagtcaaacacaaagagacaagtgctgcatgattatgcatgtatagggtatctagagtagtcaaatttatagaagcagaaagtggaatggtggttgccagggcctgggggaaaggactggagagttgttggccagtgagtatagagtttgcatgcaaggtgaaaaactcttggggtgcctggttggcttagtcggtgaaacatctgactcttgattttggctcaggtcatgatatcagggttgtgagatcgagccctttgtggggctccacattgggtacggaggctgcttaaaagattttctctccctctccccttccccacacctcgagtgtgcatatgtgtacacattcacacacacacacacacacacactctctctctctctctcaaaaactaaaaataaaaaaaaatagacctaggggcatagttattccttgctccccagacttctgcctggagcaccttttaaaagaaagctctattccaaggaggaaattaagtccgcctaccagactgggtccagggcaagagggcccatgccagcgtgggactggggggattccacatgggggcgcattttgcagctcagatgtcaggagaggagcctggagaggaagcggtggtcggcttgggggagcactgcagaagggcatgtgtctagactgggtctggatgtcagctgtggggtgagccctgactgtacttggcctccaccggggctctgcaccaacaggagagccagagaggcagagttaagcctctgctcttcccccaagtcttgtaggtagcggtagcggatcataggtgctctgcagtggcacggccatctgcgtgcctcatttcctttttgtgagctgctcaagcacaaggggccctctctttccttcagcatcccctgcacacaggacagaacccagacaggccacaaatggttgggggctggctggagggctgacaagggggtggtggtcctatagatatttctaaggaaaacactccattttcttttttctttctttttttgttgttgtgctaaaatacttaaaaatttaccatcttaaccgcttaaaagtgtatacttgaataatattaaatgcatctgcattgttgtacagtcatcaccagcatccatcctgtctttttttttttaagattatttatttattacagagagtgcacaaatagggggagccacagggggagagggagagggagaagcaggctccccactgagcagggagcgcaatgcagggcttgatcccagggatcttgacctgagctgaggcagatgtttcactgactgagccaaccaggtgcccctcgtaagtctttttatcttataaatctgaaactttaaaacccattagccaacatctctccatctcccctcaccccagcccctgaaaaccaccattacaatttctgtcatgattttgactactctagatacttcatataagtagaatcataagtatttgtcttttttggtgattggcttgtttcacttagcataatgtcctcatgttttatccatgtagtagtatgttagacttttcttcaaggttgaataatattccattgtatgtacggaccacattttgcttatccattcatttaccaatgggtgcatgggttgcttccatgtgttagcacttttgaataatgctgctgtgaccacagatgtacaaatgtctctttaagattctactttcaaggggtacctgggtggctcagtgattgagcatctgcctttggctcagggcatgatcctgggatcccgagatcgaatcctgcattgggctcctgcagggagcctgcttctccctctacttccgtctctacctctttctatgtctctcatgaataaataaataaaatcttaaaaaaaaaaaaaaaagattgcgctttcacttcttttgggtatatgcccagaagtgggatcgctggatcatatggtagctctacttggaactttttgaggaaccaccatcctgttttctatagtggctgcattgttttatactcctaccaagagtgcccgagtgttccaactttttcacatcatcacaagcacttgttttctgttattcttgttttcttaaattgtagccattctaatgggtgtgaggtggtatctggtgcttttgatttacatttccctggtgattagcgactctgagcatgtttcatgcatttcatgtcatctgtatgttatctctagggaaatgtctgtcctattcctttgcctatttttgagtcagttcattttgttgttgttgagtttggggaattctctatatagtctggatgttaatcccttagagagttatggtttgtaaatattttttcccattctgtgagtagcctttctactctgtgaatagtggtttttttccctttatttttcttttcctcctacttgtgttgaggtatttaacacacagaaccatgtaagtttagaatatactacataatgacttgactttcacatattgtgaagagatagccacaataaggttagctaacacccatgatctcatgtaaatgccaaaaaaaaatatgttccttttccttgtgatgtgaactcttaggaactactctttcaacaatttccgaatataccattcagcagtggtaactgttgttagcatgctgtacatgacattcctaggaccttctgactgttcaattcccccaaccctacctctgctaaccacaaatctgatctctttttgtatgagtttggttttttttttttaatttacttttgagattctacatataagagagattataccatatttgtctttctctgtctgacttacttcacttcgaataatcctctcaaggtttatccatgttgtcacaatggcaggagttccttctttttttgtctgaataatattccactgtgtgtatgtatgtgtgtgtgtatatatatatacatacatatatttatatatgtgtgtatatacacacacatatacacagacacatatatatatttatcgatggatacttaagccatttccatgtcttgactattgcaaataatgctgccatgaacatgggagtgcatatatctctctgatatagtattatcatttccttaagatgtatttctagaagtgatattactagatcatatagtagttctattttaaatgtttttgggcaacctccccatttttctccgcactggctgcaccaatttacaatcccaccaacagtgtagaagggttccttttgctccaaatccttgccagtatttgttatctcttatctttttgatgacagctattctaataagagggaggtgatatctcgttgtggttttgacttgcatttccttgatgattaggaaagttgagcatgttttcttggtacatgttggctatttgtgtatcttctttgaaaaaaaatctattcaggtcctttgttcatttttaattggagatatatatatatgattttatttatctattaatgagagacagagagagagaggcagagacacagacagagggagaagcagcctccatggagggagcccaacgagagactcgatcccaggaccccaggatcacgctctgggccgaaggcaggcaccaagcccctgagccacccagggatccctggagattttttttattggatatattttttaaagatttatttatttattcatgagagacacaggagagagaggtagagacatagacagaaggagaagcaggctcctcacagggagctcgatgtcggacttgatcccggatcctgggatcacgccccgagctgaaggcagacgctcaaccgctgagccacccaggcgtctctaattggatatttttttgtttgtttaggggtttttgttgttttgctattgagttgtatgagttattttttgttgttgttgttttggatattaactaacactttatcagataaataatttgcaaatatttttttttcattctgtaggttgtagcttcattttgttgatattttcttttgctgtgcaggagaaattttgagtttgatgtagtcccactagtttattttttatttgctgcttgtactttaagtgtcatgtccaaaaaatcattgccaagacagctgtcaaggagcttctttcctgtgttttcttacaacagatttatggtttctgatcttatatttaaatctttaattcattttgagttaatttttgtgattgctgtgagaaaggggtctagtttcactcttttacatgggaatatgcaattttattgaagagactgtgttttctccaattgagtgttcttggttcccttgtcaaatattggttgcccatttaatgcatgggtttattcctgggctcttgattctgtcccattggcatatgtgtgtgtgtttcatgccagttccacactgttttcatttttatagctttataatataacttgaaatctagaactgtgacgctccagctttgttctttatcaggattgttttggctattggggtcttttgtggttccatataaattttattttattttttttaaagactttatttattcattcatgagagacacacacagagaggcagaggcacagacagagggaggagaagcagactcaaggcagggagcccgatgcaggaatcgatcctgggactgcaggatcacgccctgggccaaatgcaggcgctaaatggctgagccacccagggatcccccatataaattttagattgttctttatacatctgtaaaagaaatgctattgaaatcttgatagggattgccttgactatataaatagattatagattatattgttaattgttttaacaatattctttttgaaagataataatatattttttaagattttatttattcattcatgagagacccagagaaagaggcagagacacaggcagaaggagaagcaggctccatgcagggagcccgatgtgggattcaatcctaggacccggggatcgcgacctgagccaaaggcagatgctcaaccagtgagccacccaggcgtcccgagaccatcatatttttattttatttccttaataattatagttattttaatttttatgttaattgaaatgtagtcgacatacagtatatccgtttcaggagtacaatataattggcatttatatacattgaaaaatgttcaccacaataagtgtggttaccatctgtcaccaaagttattacaatatcactggctgtattccctatgcttttcatccctgtgacttatttcatgactgcaagtttgtatctcttaattttttcatctattttgcccatccctcccacatcccaccccttcagcaaccatcagctctctgaatttgaatctttctgttttttttggtaattaaaataaaataaaataatttattaattcatgagagacacacagagagaggcagagacataggcagagggacaagcaggctccctgtggggagcatgatatgggacttgatcccaaaaccctgggatcacaacctgagccaaaggcagatgctcaacactgagccacccaggtgctctagttttggtttattttttaaattctacatataagtgaaatcatatggtatttgtctttctctaatttatttcacttagcatgatacttttgggtccatccaggttgttacaaatgtcaaaatttcattttttatagctgagtaatattccagtgtgtgtgtgtgtatgtgtgtgtgtgtattggtttcattgattttttgtgtgtttttctattgtctatttcatttatccctgctctcatctttattatttccctacttctgctagctttagctttaatttgttccttttttcttgctccttaaattataaagttggattttgattcagaacctttttttttcttaagatttttaaaattgattttttcatgagagacagagagagaaagagagagaggcagaagcaggctccacgcagggagcccaacgcgggactcaatcccaggtctccaggatcaggcctgggctgaaggtgggggccaaactgctgagccacccagggatccccatctttcttgtttttcgatataagtgtttatagctacgatttttttttcttgagtaccactttcattatgtctcaaagttttggtgtgctgtgttttcattttcattcatctctaggtatttctcatttatcttgtgatttctttgatttctgggttaaaaaatgtatcatttccacagttttgtgaatttctcagttttctttgttcttgatttttttaaaaaaagattttatttatttattcatgagagacacacagagagaggcagagacataggcagagggagaagcaggctctatgcagggagctcgctgggggactcgatccctggaccccaggatcatgctctgagccaaaggcagatgctcatctgctgacacccaggtgtccctattgattttttaaaaaatattttagttatttatttgagagagaaagtgcatgcattgtctttaactcttattgttgaacagtatttctctgtatctctccaattctgtctgtttttacttcacagattttgatggtctgttaggcacaaaaatgttactgttgttacatcttctttttcttttaagatttatttattttagagagggtgagggtggggagaggggcagagggggagggagagaatcttcaagtaggttcccttctgagcatggagcctgatgtagggctcagtctcacaaccctgagatcatgacctgagctgaaatcaagagttggatgcttaacccactgagccacccaggtgcccctacttgttgcatcctcttgctgtattgaatcttttatataatgtctttcttggtctcttgtaatcttttctatttaaagtctattttgtctagttttagtatagcccctcttgctcttttttggttattatttgcacagaatatacttttccatactttcattttcgacctgtttttgtctttggatttctagcgagtctcttgttggcagcatatattgattgcatcatgtactttcatccattctgccaatctgtcttttgattggggagtttattcatttccacttaacataattcatgataagtatgaacttatcactgtggtattggttttcatgggccctatagcttttctgtgttttatttcttgcattcctgttttcttttgtttttgatttttttctttttgaagagactttatttatttgagagagagactgactacagggaggagtagaggggtacggagagggaaggggaatgaatctcagtctatgctgagtgagagccccgtgggggggcttgatcccccaattctgagatcatgacctgggttgaaacaaagagtcactcaaccaactaagccacgcaggtactccatttttttttctttttgtagtgaaaagtttaaatttctgacttcctcttttgtaaattctatagctattttctttttggttactctggggattacatttaacaggaagttatgatattgtaacttaaacgtatagcagcttaacttcagtaacatacaaaaattgctccattagagctctgtcctcaacccttttgatttgtcactgtcacaaattacattaaatttaaaaataattaaatacattagtattactttatacattgtgtgcccaaatacataatcattcctttaagtgtattagtctcccaatttatgtggaaaagaagttttggagttatataccaaagttatggtaatataaacttatacattaataattgttttctcctttaaatgtattattctcttaaatcatgttgaaaataaaaaatactgggcatctgggtggctcagtggttgagcatctgcctttggctcaggtcatgatccagagtccggggatcgagtcctacatcgggctccccacagggagcctgcttctccctctgcctatgtctctgcctctctctctgtgtctctcatgaataaataaaatctttaaaaaacagaataaaaagtaccgtcactaaccattgttataataatactttcttaaaaaaaaaaagattttatttatccagagagagagcacaagcagggggagtagcaggcagagggagagggaaagcaggctccccacggagcccaatgcggggcttgatcccaggaccctgggatcatgacctgagccaaaggcagatgcttaactgactgagccaccccagcatcactcaccttcatttttgaaagatggttttgccagagacccttcattgatttttttttcttctttgcccacttcgaatatattggccaactgtcttctggcttctaaattttctgatgagaaatctacacacaatcttattgaatctcccttgtatgtgatgatttgcttctcatgctgttttcaagattcgctttgtcttttgcttttgaaagcatgattataacgtgtctagttgtgggtccttttgagtctaacttgaaatctgttgaactttgtggattcttatgttcatttgttgcactcaattcaggaggttttcatcatggtttaatatctctttgcccccttttctccttctgggactcctatgatacgtatgttggtccatctgatggtgtctcataggtcagttacactgtcttgtttttcaatcctttttctttcttttcctcagcctcataatttctattgtctttttttttttagattatttatttatttattcatgagagacacggagaggcagagggagaaacaggctccatgcagggaacctgacacgggactcgatcctgggagcccaggatcatgccctgggctgaaggcagcactaaaccgctgagccatccgggctgcccaatttctattttcttaaagtttgtgaattctttcttctatctctgcctttgaatctgtctagtgaacttttcatgtcaattactgtgacaaaaaactccagttttttttttttttttaggtttcctaggtctttattgttatttccagttttcttcagttttcttgactttctccacacattcctttaactctttgaacacctttaagactattgctttaaagtcttttttttttttttttttttaggacagattatatcgaattatttttctcttttgaatgggccatactttccggtttctttgaatgccttgtgactttttttttttaattgaacactagcatttgaatctaataatgtggtattaactctggaaatcagtttctccccctccgcccagggtttggtgcttgttattggttttatttttagttgttataggctatctctgtgctaaggatcaaactgaagggggcaaatgtaatgtctttttttctttttcttttttaaatttatttatgagagacacacagagagaggcagagacatagagggagaagcaggctcccccagggagcccaatgcgggactcgatcccaggactccaggatcacgccctgggccagagacagatgctcaaccgtgccacccaggtgccccaaatgtaaggtctttaaggtcttttctgagtccttccctcagcatgtgttatcacttgctaatttccctcaatatgcacatttgcccacctcttttctcctcagccatcacaagcagcaatcagcagagcatgatccccaatattcagagatgctgtgccttttgctgtggaagctgctccagaaaaacctgcgaactgcctgccatttggagagtgctaagccctgaaattgagtgaaactgcaatttaccacccctgccttcctcgagaatttgtggttcttcaacagactccagggctgcaaaatatttacttagatcctgccgtgcaactgttgtgaaggtggggagagcttcctggatagagctttagcatcaatttcactctgccatcttcccagaatcttcttccattccatctgtgcaggacgatgaattcttgagttatcagtgtgactggacacagacttaatgtcaatatagcctgaagaccacagccccattttgcagttatgcccccacctcaccacctcaaggaattcaacacaaaaaatcaggttgtaggaattgctaggaaaccatgtagttctggcctccatactatcaagataagtgacaggaatgaaggaccactgagattgacgtgtgggtctgctttgtgagaaaggccaggaaaccaatttattgagcatctactatgtacgatgttggtgatggtgtacttagtactgagatggtgaggagtcaaggagtaagtgagctcctgggtctctcggtggtcacatgaataccaagtatatgttcaggccagtgtcatttttaggaggactttggtgtctgtagagggtgagagtatacatgtgggcttaagtttttagactgatgagatcaggagttatcagggtgaagagatggctgcaagtagacctaagtagagcaactagaattggacgtggtaacctcaaataccaatcactggctacttgttcttcccacctcattttctgggtcagaaatttgagagaatcttaaagccaaatcataatgtgtatagcaaagagttaccttatgaaaacatgtgatccaaagcagactcaggccagaaatatttactacctaaaggaaggcttagacacctagtatatttgtaatgtgtcaaactaagccagttttttaaagatttatttattcattcagagagagcgagagagaggcagagacacaggcagagggagaagcaggctccatgcaggaagcccgatgtgggactcgatcccgggtctccaggatcacaccccgggctgcaggcggcgccaaaccgctgcgccactggggctgcccaaactaagccagttttaaatacattctttcctcgcgtagttttgggtatggatcacatgatcttgtaagagacttggaaagtgggaacaatgcagcaaacatattctttttatatttggaaggtcagtggaaagggggaggtttaagtccctggcacagagcaagcactgagcaaatagttatgaccagcttcagcttgtggctgcaggacagcttttcctatgcactgttcctagcagctgatacctaccctacctttgtcagtgtctggcatgatagattatactacttgcccttgattatgttaaaaaggcggggtccgtccaagcacgaatatttaagtgtatgctcataatgagcagagctaaaaggaaaactttttgccttttcttgctcccaacagactccaaggtggtgggttgtaaggttctattacctagagaagaggatctgaaaaagaacccaaacgtttgggaaattccttctcttaatccaaagcattcctttttttttttttttttttttaaatggtttactcagggttttattcagggtaatttactacagtgggggatcagatggaagatgttctacggcagttgcatagttattctctacaaaatccaagttcacagatattatggaggggacatgcagaagggcattgtagtgagattaaagggttcacacgtacctcaaagggcttgcatggacctgacagctaacttttaattagatcttgtggcaccatcggtgtatcaggaaggacacattattatcttaacagattcattgaaagctaaaacaaacctccccctgtcctggaattggtgggcatttcttatgtaagtaagtattaacctccaacgggcccacaacatacatccccaagagaggtttctgagcaaacatgaacaagatggaggggcaaagatgaagtcagtactgtcagcactcctacaccgttatcactgaaattacttacaaaatgtcatttgagtaactgtagaatatgccactgattataacaattgtatttaaccaatcacctactgtgtagacttatttacttcctgctaatagcttatgactaaatctttgcaaacatcttaaactatttccttaggataaattatcagtggaatttctggagccggttaaagggtatttaatcatcacttaatttttttaaatttttgaataattttaatttacataagagctgcaaagatagtacagaaaattcctgtatacttttttgaccagcttcaccagagcattctttaaaaagtaaaacatgcccatcctttacatattagcacatttcctgtatttttactccaaagtaaaatgatgaaacctatggctctgctgccatttcaggtccaccaaatgcttggggatttctttttaaaaaatattctatttatttacttagagagagagaacacacaggcacacagagggagaagtagacccctgctgagcagggagcccaaagtggggctctatcccaggaccctgggatcatgactaggcagctacctaaccaactgagccacccaggcgccgcttcttggggattttaaagaggtaccaatatctcattctagtgccaagagattgtatcacaaactagaataagtatataaggctatcagttgacctggaaaactgtgggccagccacttcaccacttagggtcttacccgcctccccaccccccatttgattctccaagatcctcagggaatttctgcatcagggactatactcttattgtcccatccataggtaggtagcagatagctccaacaggatactgataaagatcctcttgggagttacgtcagcgatgtccattttttgcaatgtattactaaggtcacacacgtagatgatatgcaattatagaccaagagatatattatgcaaatagcagttatgaaattattgtgccttcttggtatcccatccctacctccccaccaaacgtcagccttgtaggagaaaaataagaaaggaagcattgagtgagggtccctgaaaacttcctcaagctgttaaagaatgtcctttaatgtacatttttgccagtcattgttattcaaacatgtaaggagctagttgatgggaataatatacaggtaggttagggaattcaaaattttgggattttgaatttaaaatgttttggatttaacagctcaaattctgtgcattgtgagtctcccagggttgccggtctcagagaatacattctaatgcaccatgctagaagggagccgctaaaaaggctgagcaagtatggacaaagctcttcactgatactcctcatgctgtgggatggacgcaggctgccctgaattacccaggtcacaaatcaacaaccgcgaaactctgtggctatccttattaccccctgtatgattgttatttgcttagaaaaaacatgcaaataaaaggaattatttcattgccaaataatttagcagcaaaggggtaggactagaattcaaacctggagatgaagcatggaattcagagggaatatatggcaaagtgtctggagcctacattgacctgtctgcagatgccagtcactagtcctcctggaggcaggctcgccactacctcaggtagtcacctttcttttgcagtgtatgtgacatctccttaacccttctgggtatgtaaccatgagcatctgctgaaatatgctacttaagaaagagaaagggcatgcttaacccagaggatcacccaccacatgcttatgttttacatatttactaattatgcaaattagcacataattaaacctcttcatttcccaaattgaacctaccttacaattagctaaaatagtggaatactcactggctgacgagaaaaaaaaaatcttgtttttctgatttggttcatctgaacaaagatgcatctttctaccacttttagcccaatgctgatttcaagctgtgcctctgagcagggaggacaatagtgtctgcagccaattttctgaggttgtagttcttcaacttggcccccaccctagttttccaaccaaaacaactttttctgaagactatttaagcaaaacccaagaataaggggaaatcatgtttggttgtttatttaaggaacacaaaaaagtgcatctgaatgtttttctttttttaaaaaacaagttttcaattcatcatatatgctgcctcagcactccaaatgcagtctgaaagatggttcaaagacatccactggtttctagacaaattaagattactgaatttgatacaagaacatatgaagtttcttcttcttgagtggtgatgggcacctcaccctcattttctcagaactacctgcataccccctgtcctcccttctgtgcacactcttgcccattccccgctggtgacccataacacacatttgggagacaattggctaggataatctaagttttagaacctgttttttttgtttgctacctgcaaaaagctaactggccttaggatcaaatctcactggagtcatgctctagtcaaaagagctacaaatactaaacagtcaagcaacaaagcaaaatcaacttctgcttttcatatttcctaggcgagattggggcttttaaaagaaatctcatgaataaagacaaaagtgagaattaaaagcattctagttgtcaaagaagaaactcacaatttaattccacttgttccatggaggaaaaaaatggtataaatggaaattattttatttttaggttttgatgtgggtcctaacctaacaagtgttttgctaaaaccaccataaacgttaaaactagtaactgccagtgttctttaggattttacaaagtgagatgttccaggttggagctactgtttcctttgattgcaaacgcattcccacaagtgcttctcaggccatgttcaatctcgcttacccgtaaggaccaagattccactacatgtacgtactctgatttgccctgattcaatgccccaggattggagcttttaggctagatgtgcctgcacaggaagcagttttcaattctttttcacgacttacaccagaacaaagaagccataagaaagttgctgtgtgccaaacctgcgaggaaaacccttaacgtacaagagcaactacttatttttccacctctgcagattttgtttttaaaaatcaagctacttcgtagtaaaaagtcaaaaattttttgtatgatagaggagtgtaaataaagttccataaaccagtatacatgtttatgagccagtaattttaaaaagacaaaaaaaaaaaaaaaagctgcatgaatcctaagtggatatgtaaataaatccactccaggtcagagatattctaagaacaagtcttaaattcttaatatagcaaggtttagaatgaaaatcagaaactgaatggcagcaatgctagcaggcagtacggtactccacattacttcctacaagagacagaggaggggaaaatgcacaattctgattactcttttcacatttcagcatctcagaacttcaaggaaagcagggaaagctaatctagaaactccctctgctcattatcattgctgaagaatgttttgggaatgacagattccctcctccagggccaggctgggtgccagagagccccactctcccaagcagactggcttagtgaggaagtttgactaaagtcagcaagcaagtggcctctgaggttctggcttcagagtctggcactgtggagaaccagtgtgtgaggggattccagacccctctccctatgggttgtgttggttacgaatgctagcacttcagtcatttaaaaaccaagacctcctcctctctcccacccaactgcaggaaaggagaaaatcattaagcatttatttttaggtttctgcagtgctattaaaagttcaatcagatgtaaaacctaacagacagcccaaattgttaggattatctcaagggaccctgaattagatattgaaagttgacacaaactgaaatgagctggacttagctggtggttcgatctcaccacatcaatagtcacttctgcttcgttccaccgggagtggtcccatgccaccctctcaaggagcacgctgggcagcagcagggtggctgttttctgggaagctactggttttgccatttgcttccagattcgcacagactataacaaactttacatgaaacactgttgagtcctgagttgggtgacagcccatggaggaaggggccgagttcattagggctcttccctcctttgcgtggtgtcatacatggcctccggctttttcttctgttgcttgactttctgcttctttttcattggtgaccccttctaaagtcttcttgcccatggctttactggcctcttcctgaggaagaaataagatatcaagagggttagagaaaaaactgaaacattcaggtaattcctggctcctcctgactgcttatcaggtctcaaacaggagagcattacagtggctttcctggggctgcctggttgggtaagtcagagcagtgctgacaacagtgcatagtggacagctttcacttttcttcggtgggaaggactagcttgccacagggagtgttgtgacaagaggactggggagtggaggatgaactcaggacctgaacacaaccttgctgtaggggaggtgatgaagtaaaagggcattgacggtgggccttccctatcatggcccactgcccgggaaaatggaagtctcaacaaatatctgaaaagtatctaaaaaaatacttgatgtgtctgatttttaaaaactagcaagttttcctagtctctagggaacttatttttctcatccctttcacagacatgcagtgcctcataactctgcacgtctggtgagtagaacagcccattcttcttctggatccaaactagtctcagatcagatcataaatcgtcttccccgttcttgtgcctcttaggttgtctatctgaccctgtgccctatgcttaatcttgttgtaacaaaaaccaaaggggcaagatcagtttttgatgtacctgaagggaaaggcagttctgcacatacctttgcatcctgttctgcaaacttcttaaacatgttggcatatatcctgcggtctcgctcattgtgctccttagcctttttttggcacatggagatctgcagtcgtgcagccttattctggggattcacttccaggactttctcaaagtcgcccttggccgactcaaactcgttcatgagcagctgggcttcacccctcctgtacaagcccttctcgttggcactgtctagtccaagcgcctagggacagatggtctacattttagaaagcatgaatgtaacttttgttacatgtggacatgtttgtggacctttcaaagaaattcagtatttaaataacttcccaaacttttctggccaaggggactggaaaaagtttactgaagtgacaagattcaaggtaattaaatactaatcaaagtagaaccaactatatccaaattaacttctgtatttaatgcaatttccattaagattccaaggggactggggaggagcctattgagaagttcattttaaaattcaatggaaaaagcaaatgtccaagaatggctgagaaaattttggaaaaacaaaaataatgagaggaggcttgaccgaccacagaaaaaaaacttactatggaaccactaaaattaaacacactgaaattaaaccacactatgaaaaaaactgaaattaaaagatggactgcttgtctctgggcaaagaggttatggaacagaacaaagcattcagaaacaggtttgtgtgtatatataataagatttaacagggacaaaagtgggaatgtcaatcagtaggaaaaggattaacttcataataaatggggcctacactgtaataaatgaacatggaaaataagagaaatttttacctcatatcaaaacacaaaaaattctagaccaagcatacttacatgcatgcaatctgtcccatcaaaatacaatagggttatttttaattagttttttaaaaaagtacatctagttggagtagtttttgaaagtactaaacagaattatttctattatcttagagtgggggagacctttctaattagaaaggaaaagacagattcaatgaagtaaatgtacagactgcctcaatataaatcaatctagttgaaggatgtgagcaggcaattcacagaagaaatgcaaaatggctggttatgaaaaactgtatgatttcatcagtaaccaagaaataaaaatgaaaataagagttttttgttgccggcaatattggaaaaaaaaaaaaaaaaaaaaaaaaagaaccaagataagggatgtctggttggctcagaggttgagcgtctgcctttggctcagggcatgatcccagagttccaggatcaagttccacatcaggctcccctacaaggagcctgcttctccctctgcctatgtctctgcctctgtctctcaggaataaataaataaaaaaaaaactatggataatattcagtaatcctattttttgactccatattttcactcctagaaatatggtctgcagaaacaatcccagaagtatacagaagtggcctgtcaaactggaaatgtgccattggcatatttgtttttccttatatgtgttgttgtaaaataaaagcatgttactctgctaaaaaaaatgtataaaatgtataaaaaaaatgtatgtatatatcttctatgtaagtagttgcaagtctatcatgcttaagccctgaaaggcttaggttaaatctgttattacattgaacctgaggagttgatgttcaatttgataccaaaggccatagatttaagtaaagtcatggatgaaaataattttaataacaaaaaaaatttttttttaaagtatgcttcatgcccagcatggagcctgacacggggcttgaactcacaaccctgagatcaagatctgagttgagatcacgagttggatgcttaactgactgagccacccagtgccccaattttattaaaaattattcatagtgtattactatagtctatgcatcaggaaagcctgactgtggggcacctgggtggttcagttggttaagtgtctgattcttgatctcagctcaggtcaggatctcagggttgtgggatcaagccctgcatcaggatccttacttggtggggtatctgcttgggattctctttccctctgcctccatcctcgtatgcatgcacacacactctctctctaaaggaaaaaaaaatcttaaaaaaaaaagtttgactgtaatctcaatctttctgaatttcccaattcataatgagaaacaattccaagggcagcccgggtggctcagcggtttggcgctgccttcagctcagagcctgatcctggagacccgggatcgagtcccgtgtcgggctccctgtgtggagcctgcttctccctctgcctgtgtctccgcctctctctgtagctgtgtgtctctcatgaataaataaataaaatcttaaaaaaaaaaagaaacaactccaagcaaacaaatgaacataacaaaacaaaatgaaaaaccctccaccccttggctacaaaggagcaaaagatgaccaaatatgaagatggagaaaaagatctggaacatctcaagtccagtccacacacagacactctaccttgtcacagcactcaatagctttggtgtattctctaagcttcaggtagcacatggccaggttcaggaaggcggcaagcagaaatgactcagaagcttttgactccttttccgataagccatattccatctctaaccacgatacgatcttcccatattgaatcactgcctgcatgtacttgcctccctggtagaaaaaaaaaagctagtgagaatttgttgtacaggctctgggtcaggggtacaagagaaatgttagctcaggcctccctaaaaaaaaacaaatcatcaaagtgaaacaacctctcctactgaccatggtatttgatcatttctttttgctcttgagagatagccatcctggcccctttctccattctccttgcagcgccagtgctttctgagctggtttgggacagtgaattatagaatgctgttctccagcatgtaccatctcatctttttcagaggggacagttcttccagcaggagggcatcaaggctttgggttacattctttggtacaagtatttatcagactttcaaaaggttggtgagtagtttttttttttttaagattttatttatttattcatgagagacacacatagagagagagaaagagagagagcggcagagacacaggcagagggagaagcaggctccatgcagggagcccgatgtgggacttgctccagggtctccaggatcacgccctgggctgaaggtggcgctaaaccgctgagccccccaggctgcccggtgagtagttttaaactctatcactaatttacttgaaggggaagttacttttccctcatctcctgaggatcagcactccgtagtagagactgcattctggcaagtgccagctgtaaacacagcaaatcttaagttacctaaaccaggagttgccaaactttttctgtaaaggggcagataataaatattttaggctttgcaggccaaacaatgtctgttgcaactgggtcaacagtagtgcaaaagcagctatagacagtatacaaatgtgcttgatccctgaacaacacaggttggggttgggactccccaggcagtcgaaaatctgtgtacaacttatttcaaaaatgatttacttttattattttatatattcattttttcatcatgacaagtacattctttaatccccctcacctattttacccatcccccccagccccctcccctttgactgatggagtcaaaccatcagtttgttctctatagttaagagcctgtttcttgtctctttccccacccctttgctcatttgtttcttaaattccacatatgagtgaaatcatatggtatttatctttctctgactgacttatgtcacttggaattatatgctctagctccatccatgtcattgcaaatggcaagatttcattcttttttatggctgttattccattatatatttatatcttctttatccattaatgtattgatggacacttgggctggttccacatcttggctactgtaaataatgctgctataaacataggggtgcctgtatccctttgaattagtgtttttgtattttggtgggggtaaatactcattagcatgattattggatcctagggcaattctatatttaacttttgaggacccaccatactgtttttcacagtggctgcaccagtttacattcccaccaatggtggaagagggttcctttttctccatatattccccaacatttgttgtttcttgtgttgttgagtttagccattctgataggtgtgaggtaatatctcattgtggttttgatttgtatttccctgactctcccaaaacttaactattaacagtctactgttgactgtaagtcttactggtaatagttgatcaacacattttacatgttatttgtatcagattttatttatttattcatgagggacacagagagagaggcagagacataggcattctgcctatatcttctggagagaagtaggctccatgcagggagctcgatgtgggactcgaacccgagaatctgggatcatgccctgagccaaaggcagacgctcaaccactgagccacccaggtgtctctcatatacagtattcttaaagcaagcctgaaacaagaaaatgttattccgaaaatcataagggaaaatatatttatgatagtgtactgagtctatcaaaaaaaagtctgtatataagtaagtggacaggtgcagttcaaacccatgtttaagggttgcctgtaaatgtgtgtggctgtgtcctgatagaatcttactacaacaggctgtagtttgctgacctctcatctacagacaagggaaatatatagttgaatagtatccaacataaataaccctacaacataaatcacatagatgtcagtcagctaactacatgagaaaaatctcaagatatttttgctcttacctgattagtagaattttaacaattatgaatagcaactgtgtagtcaattcaggtgaattaattatatatatgctccatacaagaaattatggggctgagacaatgtgtttattgccattttaagatgaaagaagtgacagctggtaaatacacaaaaaagtacaggtgaggaatctcctctgaaggagatgattataagactgagaacagatgacacatcctacctagcatatggcataattggagccagatcctcaaaggtattatatccaatgtctgagccatgtagtgttaagatgatgtcaggagaatttactgtagtcaaagcagtgtatacacctcaatgtagaactgtcttcacacatgcaccccaaaggtcacccaatgacaagagaaaaacccagagcagatctacaagaatgttcctgttctaaaagacttcaagtggctcacagaagaaatggctccacttgtagaagcagccttgatgctgatttttggtgatgaggatgggcagaccagttccaagtggaaggcttaagtctgaatcaaaggaaagttacatcccccactgaacatcccgcttcacatgtgacttgtttagagaagacttactgaactgtgttatcccctgtgccctcaattcatatggtgaaggcctatctccgtgatgatatttggagatagggcctttgggaaataattaggttcaaatgggatcctgagaatggggccctcatgatggacttaatccccttgtaagagacgagagaacttgcttcctctctctctcccttgctgcaagcaccgaggacagttcatttggggacatagcaagaaggcagccatctggaacccaagaagagcactcttacaagacatcaaccctgctggcaccttgatcttaagacttccagtcttcacaactgtgagaaataaactcctgttgtttatatcacccagtctatgagattttgttatggcagcccaaggaaatgaagacaacacttttattttttgtcagagcccactactcctttttgggacactacaaaaaagaaagtcctcacgagttgtcatttctttctgtccctgtcttttctcttgggatggcgagcaatttgaggacagaatcacgttttatccctttggaatatccaaagatactttagcacaaagaggcccttactgaaggtttgctgaaggaagattaagatcaaagatataactatggaattttcaaaaaagattttattcatttattcatgagagacagagggagagagagagagagagagagagagagagagaggcagagacacaggcagagggagaagcaggctccatgcagggagcccgacacgggactcaatccttggtccccaggatcatgccctgggccgaaggtggtgctaaaccgctgagccacccgggctgccctatggaattaaaacattatcattgggagcaaaaatggagaagtgggtagacatgaaaggtattgtttcatttaggttaggtaagaaggactgttctgccttagttccttctttctccttctcaaatgtacctattactttttctgattatctcctatgtattattatagggaaagaaaaaagctggagaagacagtgacccatgtcttataataatggtaggttttggggcatttgggtggctcagtcagttaagtgtctgcctttggctcaggtcatgatcccagggtcctgagattgacacctgagtcgggctccctgctcagcggggagcctgcttctctctctgttcctctccttgatagtactctctcattctttctctcatgctctctcaaatgaataaaataataataatggtaggttctaaacagaatagcagggagctatggtttcaaaaaaacaagcaaacaaaacaaaccgaaaaatcaaaaccaaaaaactaagtaataggcttcatagtaagttccttcacgttttttctttttcttttcttttttttttaatttttatttatttatgatagtcacagagagagagagagaggcagagacacaggcagaggggggagattgctccatgcacactggagacggtgtgctgggtggttcagggtcttcgagcatctgccttcagcccagggcgtgatcctggagacaagggattgagtcccatgtcaggctccctgcatggagcctgcttccccttctgtctgtgtctctgcctctctctctctctctcatgaataaataaaatcttttaaaaaatgattttgttcatttacttgagagacagcatgcatacaagtgggcggaggggaaggggaaacagattccctgctgagctggagccccacatggggcttgataccaggaccttgcaatcatgacctgagctgaaggcagatgcttcaccaactgagccatccaggtgccccaagtttctttacgattatatagcattttaatttcttgaaagctctttcatgtatatcatacttttatttagagttcaacttccaatgaacaaaaatcttgtttcatggtatttctgcttctaatgtactaaacaaaagttttcagctgggggtgattctgctccctggggggcacctgacaatgtttagagacattttttcatggtcacaactgcaaggagtgtgcctgctactggcatctagtgggtagacccagggatggagctaccacgtatcccataatgcccaggacagcctctcaccaaaacagaattatatagccccaaatgtcaatagtgccaaggttgagaaatcgtatcctaaaatgtatgaaatggacacctcgttaggactttttttcattaagcttaaaatcctagagttatgggatgacatgtttctaaattacagcactggcttcttggttcagcaaagtcaaaacatagcaaagcttggttcctctgaaaaggtttcagcagtccatcaaggatcctttacgagcttgcttgagaaatgcttttttccccaaggagcacaagggggcgcaagaaccccatttcatggcagcgtcctcagacttcataccactctgtctccaagacagaaaagagaaacactaaccaagtatgacagctagtgctcttgtcctgcagaacactatcagctctgagggcaaaaataatgtctgtttaattggcttgcacaaggcctggcataatagcatgttgtatctgttaattattttcagagacaaatgaagagtcttttgcctttcttttctttagtgttcagaggttgatatgaggagtttacaatctaaacagtaaaattattcccattttacaactgagtgcaattcaacactttactaacaggagaaatttacccatttatgtgtaaaccaaaccgacagattgatgaaaatgggtctgtaatgtaccagatggcatgaaatgtagatttttattctaccccatccctgctctcacccacacatctggactctgtgcatgtgcacaacgtgccaagtcaaacactctggaaagatgaggcccaggagggcagagtggcagattgaaacctgccctgaatttttaaaagggaatgcgtataggaaacaatctaccgaccattttgaagtcttacatctaaaactaggatcactgctgggattttttttacccataatttgaaggtacctccagggaagtttctaatagtacaaaatgttcagagacattctgggagaaaagtcttaggtcagtggttttgaaccttccattaattttcccccaaaagacaaatgttttgacagattttgtctatcaaattgcatgttaaaaataatatgttccatatgtgtgactgctgatccagatttcatccaaagatcagtaattttaagagggttcgtaatattatgaaatacaaaaatcactactgcaattgtgatgcttagaagcaacaaagttaagtaactgtaaggacactgaagcattgctttctgctgctgatcactaatcctggccatctcactgtatgtgtccgggacacagctatacgacacgtggctttctttgccacattacttcattaccaataatgttccctaaagttctgagtcatcagcaaccaattagaacttctgaatagctgagctgttttactacacagagttgacagaattccagtcaaatgccaaaaaccccaactccccaatccccaaactattaatattctatttataagtttgggaaatataaaaaatacagtaaggactttatagactctaggaaacaccactcacaacctatagtcctaagggattttgcaaaaagtattttattctagtgtggtatgtatttgagtctacaaataactcatgtggaatcttacttaaataacttagaaatatccaatatatttcaatccaaatttaaaaagatcaaacttgctctcaagacttttgaaactcacagaactttagcaagaaacttctctaatccatcacgtttttttaaaagattttatttatttattaaatatttttatttatttattcatgagagacacacagagagaggcagagacacaggcagagggagaagcaggctccacacaggaagcccgatgtgggactcgatcccaggactccaggatcacgccctgggcggaagacagcactaaaccgctgagccacctgggctgcccttatttctttatttgaaagagagagagagcatgcactcgagcagggagaggggcagaaggagaaggagacgcagactccactgagtgtggagcctgacttggggctcgagcctatgagacctgagctgaaatcaagagtcggatgcccaaccaactgagccacccaggtgcccctaactccatcaccttacacacacaaaagtaacctctttggaccttaaatggctttaaatcacttggtgccataaagcctagttctcccaatttggctcatgccaccattccccaaagctttctggtgattcacacattactttagtataactataaagtatagtataatagctataaagagatgtaaataattatatattatctataccaatacatttcaaatttgtttagctacaacccacagcaagaaacatgttttcaattatgatcccgtacctactcacacacaactgaacaaacttaatgaaacaaaatctatctttactaataggtctgttctcacagtctgaaaaacaataaccacacatgttggcccctggctgtctgaattctgtcttgattatatagtcttacataattctctagttgtttcatgggggttaacactgcttcccctccctccagaaaaggttgtcagtacaatagccagtctcagagcagacactccataaagacttgctgaaggacatttaggcatcactgctttagactgctgaaaatatcatccaattttgttcatgggctgcagtggcaagaaaaaaaaaagaaaccttgacaaaacttcgttctttctttttttttttgttctttctctctcttctctaagccaagccctttctgctggatatggagaaggtacttggttgggtgtggagaagaaatggacagagcattctgattagagctgaataaagtgctgttttcttttatacctggggggttaagatctaagtgaggaagtatcacattctgagaggtaacaagaaagggctttcgagaagcaattaataacaagtatcattcaggagtttctcaagattcctcacaaaaccaagtatggcagggattatcttggccactagagaaaatgaacattctcctcctgtcggtttcttctgggatctgtgcaagttctccttccttttgtcatatgccttagtggtttcaccaagacagtggagaggaaaatgatgtgaaacttacctccactaattctcacttactaacaattattctgtacattctttgtttcattccacaaacacttgagtgccaactatggaccaagcaagtaaccttaggccctgggtgatacagtggtgggtaggccagcaagacctggcctgcttttatggagggttacaatctacagcagaacgtgtacaagaggcatctgtattctttttgtcatgttaatccattctttctcaccatttctaatactgaaaatgacagacttgcaaaaattcaggcttatttttatccaaaagggtgctgatggaattcagagtatggaatattagcacaattcactgacacttgaataaattattgagatggaaaaagttgtacaaggactcacataccttgaagtacacagttcccttctctttgacaatggcagcttgctccaatttttctttggtgtccatctcccaggattctttggcctgttatgtaaatttgtaaaaacagttagatgaacagagaaggaaaatgcatcagttgatgcctgtaagaagagaggctgcttctaggatacacacacctcagaacacactggcttttaaaactgcaccattgcccattcactgctaggctggagctcaccttccgtgatgactgagctgctgtctgacccatgctgcctgagaaggaggggcaggcaaaaatacagtaaggaacataagctgtaatgtgctgttaaagagtgcacctttggagctgtgaggagaggacaaataataaaacccagtgtcccccccctgccccaactgccattacaacatcagcaagttgtttctctcaagactcagtgtttcaaactctacaatgggaccactatgtagtcaagtcatggctgcatattcacacagaattttttaaatgccaggtcacattgttgtctctctactttgaaataaccaggtatgcactaaagtgtccaaactcagtcaacctgcagacagatacctaggggatttcaagtaatacataagagggaagataaagctgatgtagaaatgttgcaaaggatttcatgaccatttgcttttggatcatgtgtattatttctctccaccattagagaaaggaatccagagataacttcactttcattaagaataagtggatttcaagggagcatcaagagtcaagagaacaatctgggatgctttagggaaaaagacagtggctgtgttagtgctacttactacacaggaattacgaaactctagtgggtaactgtgaaattctctctattcaaaaaaataattagtgatgttttcctgctgccacccgccccaccgagtgaataatgacagttactagtctttctggcaaccttatgttgcttctaacaatttagctctgttagttaaaaatctagtaacaagggccctttgcattttttttatatggagttcagtcttttcagagtataaatacattcttactactatgaggcagagatataaatcatgttgcttccaacatcacactttcacatggtttcaaatatatggagcagtgtttcatgaacaactccttggagcaagaggtgcatgcaggcttgcttcctgcacacaacagtgagaacgctcctcaatgtccactgaactgtggatgggaaggggctgtgggttacttgattaaatggaaacaggaaagccaaaggtctaaataaccatatgctaaagattattttctctccctttaataataaaaaacactgtgctatgaagacagctttggaggatcagcgctgagctggcaggccttcaggagaggtaactggacaattagcgatggtcatgacaacagcctatgtttactctggggaacacggagtgtgaagggtatgatcaggaacatcattgttgggggaaaatcccaaagcagtcttccctgtcttagtccgaagttacagccctacaggacaactgtttcctgactaagtctaataaaatgtaaatagtcacatttctagtccacagcttaatgtacagagagcatagagacaacattgtgggaatttaaaaaaggtattcaaaatgcagttcttgaaactctccgggcagggtggggtcgtggtgatgcagggggacttcgttggatgtgatggcatacctagtgcagacacaggctttatgtgtgactggtgaagctgctgatgggagcctccagaggtaggcctgggataaagacacgcgccaggaggtatgccaccccaggcaacagacagactctttttttacacttgggtgtgtggaaaaaggaaaggccagagggtcagcaggtttgtctcttttgtccctggttacagagtttgggggcccaggaagacctgcactttggataacaaattggagccacagtgaaggcctctccatgactctggagaggggtatgatccattcaacaatggaaaattgcaccccactcccccaaggagctgcttggcagaagaatgtgaacctttttgtcttcaacccaggaaaaaaagtacagaaagaacaagtctaggaacaaataagggaacaagtcttggattctacccaaaaaactaaaactaaaaaaaaaaaaaaaaaaggctgacacgtaggaacaaaataagaacactgagctcctttgctgtgtatcagctgtgcgctatcagctctctcgtactctgggagcagtgtcaaagacaagagacaaacttggtcacgaaaagcacaacatacgaataaacaccatccatccacaccacttaatgatatccaattgtcacttatagggagctggtggagaggaaatctaccatgatttcagagaagcgggtattttcccaccttttcgaagctcttcagtgtcacttcatatataagctcagcattaggctcgatgccaaatttcggcttccctgcctctccaaaaccatatctgaaacagagagtaaaaacaaaacaaaacaaaacaaaacaaaaaaaaacaactttaaaaagaactgatgtatttccaggcactgcctttggtattttgaggcatcacagtagtacagagctctcatctggacactacacacatcagggaccctgaagacaaaccagctgtggatcagaagatacagtgccaagtgtcgctctgtggctcttgaagaaaccaggctagatttagttttcttttctccttcaccagcacatgtaatgtaacacctgtactacttgggaaatcttccttgatgtgattttaaatttcactgccttttcctctgctgatttcatatctagttctttgtataaaatagccattgtctggctatcaggacttttccccgaagctttatcagcagcacagagaagacaggcactgtgattgttacagtgctgttcattagaggctatattttaataagcttttaactttaaagtgcagtctccctccagtagtatcacttccagtcaggtaaatagaggaagggaagaaggctcacacatcaggaaggaaattaatcttcccagtatttctgcaagacatttaaaagcacaccagaacacacaaatgatagaacaaatgtataatcataaagaacagccctggcaagctctaacacctcatcaagaaaaatgctctcatagctttgtggctatcacactataaaacactacatctgttagccaaaacttaccaaagaacatgactgaaggtatataaattgcttttctgtttttattttcttccaggtcattgaaggtctttaaacaaacctagagcattcaaaaagcacatatctcctgtaatggcaattctggtggcgttgtctgtctggtccaatggtttcccagcattcagtacaatgcccagcatatcatcatgaaagtgttcactggaatatattctgttcccatctgtttcaatgctaaactactcttgagtatagggaatactactgcaagataacttagtaaacccaaaaggatggcaaaaccagatggatgctaaaacctcccattttctctggggcaaaatgactgggggtggggtgggcagagaacactcatatcttgtggcttataccaccctctttacctcttgcctggatttttcaggaagaaaatgcttactcacctctgctattacacaagaaaatgaaagctggagccagagagaggtacagagatacaaagagaattggtaggaatgaggtgtggtagttttaatagcagggcaaagggtattttcagcgaagaaatcaaagaggacataattaccagtggctaattttaggcagtcatgactagttttctacttggagctcttagacctatacatctatttggtttttaccatttggtagatagcaaacattccttaactgttgggaactagatggataggggagtccttgcagatcatctgtactgacagcatgtggtatttggagccctgtgctaaacaggtacaaacccaataattgatagtctgacacttgccttaggttagtgactgttgacaggggtgattttaatccccacccctgcaagagacatttagcagtatctagagatttagggtttgccacaaccacaggggtgctactagcatttagtgggtagaatatcctacaagccacagaacagcccccacaaccaagaaatatctggcccacaatgtcaacagtgctgaggatgagacaagctgccttaggggcacttgtgaattgaagtcccaaggctggggggggtggggcggggagggctgggtcaaggaatgcaccaaactgtcctgattcatcatcaactggattaaagaagactgactgtagaccttatatctacaatctctcctggtttcgaatggagagattccatgaagatttatgtgaagcacaccaccccagggaggtgaaagcccacaagccaagctgttttgggagcatctatcctgacttccaagctatacagacagttgtctgacttatgtcagattggcctgggtaaccaagggcccacggcacacaaattcatctgactgaaagacagaacgccacaaacggaattcccggacttagcccaaagacgaaagctgggttacagtaacagaaggaatctagtattaatgttggtattaatgttcttgaattaacggcagacagcagagatacaaaacgtatctgcacatgaccatgaaggcttcatgtgcatacaagaagtaccacaagtgcttatcgactgcttcatttttacagataaagaaactgaggctcagaagggagtgtttctggacgttaacacaaaaagtcagtggcagagccaggatttaaattcagactctgtgtgtccccagaaaactgtttatttttaaacccacactgcctcataattaaacatcatggctgttggcagcctgtctttttgtttgggactggtgcaggacagaaacacaaggaaagggagcaaaaacactgtaactagctgtaccttacctaaaacaaacaacaggtcacagtattaaacactgtatataagacactcttctgttgagaagaaagaaaacgggttctgtggaagtgttttatgagtttattacgaaaatatcctaccaaggagtctctcagagtcgcagaggtgtgccctgaacattttctagagaatgaaacgcagatgacgtgagacaactatagagtgtgcatttgcagcagccacatgtacagtgacactcaaatgcagtattccgtgctgtgtggggatctgagcaagacaagtaagcccactgcgagcactcacaccgcttggtgtggggatggtctacctatatggctagtcttatgtagtgaacctacgcaaagccttacaccacagagtgtgcattttatattactcctcaagagtaatcttgaagagagtatgttcctttctaactgtgatgagttatttaccatgagacatatgaaaaaacttatacctagaaatttattaaaacttgattacttttatgattgaaaatattttaaaaatttatcctatgttaaaacagggtttcctttttcttgtagtctgagggtaaaatagaatagaaaaatagtcaccacagcaataacagctaatgtactgagagtttatgtgtcaggcactctgcaaagttcttcacattcattagacctccacaactttatatggtagatactgtagaacttaaacctgaaagcatacagtggacataaataccactctctttatatgagtctagaactataattgtagaaagctagattaaaaataatgagatattacctggatatggaggagaagctctctctatgctctactggagtaagaatagttccttctagaataagagaaataagttcccctgaaggtgaaatacaactatagggtaaatgtaaataaaacacactaaagcaggaatacagtagtggaaaaaggatgacagagaaaaagaagatatgaaataaatggtgcctccttgaaggctctaaaacagatcaaggtatagagcatttggagacctggccaaacccacccatgagaagtaggatcagagctcaagttatgagggcaaaggtgaatatgccactggattacttctgaggctcctaaaaggcaagcaactgtacaaaaggcatgatggtacctattggtaagtgcaagccatccagattctcaataactcaaactctagggactgaaatccaaggagctagagtgggaggaaactccagataagcagatgcactttcatgcaaacagaatcaaaacaccctggtttctctcaagggtccctttctcaagatagaagggttagattggtataattttaggtctaaaaataataccaaacatgttttcataagagagactgttagtgtctgatagttctaagctgggaagtgctaatggatatccttatgatgggaaaaatttaggcaaaaatgagtcatctccgctgcctttagattcaggaagaacactttttttttttcagaggctctgtataagaacaggtggcacaaattcaagtggtaataaatcatccaaatgtttcttctacttccaaccctcacatgttttactacctcccacctaatttagagaaaaggaaagagggggcctagagaagcacatgagatgagccaatagcttcctgtcttggcaataaagcaggcaaaacaaaacagcaaaacttgcctgtcagtcctatccttgacacacaacaatcaagtaaacaggcttgcagatctttgtgatactatatggcctattaattcactccatgacttaactgtagactgatttgtttccaccgttagcattaacttcactgaaaaaaactaaaatgttgattgcaaaagcaaatgtatctgtttttgtttttttaaaattgaagtatagttgaatacaatgttgtatcagtttcaggtgtgcagcatagtgatttgacaattctgtatattacactatgctcaccataagtacagttaccatccattaccatgtaatatcagcacaatattatttactatattccctgtgctgtacctttcatccctgtgattgattttataaccataaatttgtatctcttaattccccctttgcatatttcacctaacccccccaaaccctctgacaactagcagttccttctctgtatttgattgttttgtttgttcatttgttttgttttttagattccacatataagggaaatcatatggtatttttctcagtctgacttctttcacttagcataatgccctctaggtctatccattttgtcacaaatataaaacactgataaaagaaattaaagatgacacaaatggaaagatgtgtcatgcctttggattggaagtattaatactattaaaatgtccatactatccaaagcaacctacagattcaatgcaatttctatcaagataccaagagtattttttaaaaatattttatttatttattcatgagaaacacagagagagagagagaggcagagacacaggcagagggagaagcaggctcctcgaagggagcccgacatgggactcgattccgggtctccaggatcaggccctgggctgaaggcagcactaaaccactgagccacccgggctgccccccgagagtatttttcacagaactagaacaaataaccctaaaatttataaggaaccacagaagactctatgtaaccaaagcaattttgagaaagaacaaacctggaggtatgatactcccagacttcatgatatgctacaaaactgtagtaatcagaacagtatgatactagcacaaaatagatgcatagctcaatggaacaagacaagagagcccagaaataaacccacacttatttggtcaattaatctatgccagaggaggcaagactatataatggaggaaaaaaacagtctgttcaataaatggtgtgggggaaactgaagagctacatgcaaaagaatgaaagtagaccaccttcatataccacacacacacactgaaatctccgtcctttaggtaacttcactgtgtatggaactggtatgctccttaccgtggtccaagatataaaatacattgttcttcccgttgcattttctccagggctttgtcaattccaattggaatgtcatggtcttctccttccccaacaatgaagaccacatctctgcaatcaaacatcctgccatcacagcggccttccaggtggactgaaggagaggagacaggtctgtcaataaaggagctccgcagggcttgctaatttagggaagggataaaggcttatttcccctttctcatttcatccagagacaaatggggtatgtcctgttgacacttagtctacccagtctgaaaatttaagggtaatcctatttttttctaagtttaagcttgtaattatcaacaactgtatcaacaagataggctgggggcacccgggtggctcagttggttaagtggccagctcttttggctcagatcattatctcagaggcttgggctccacactcagcagggagtctgcttgagaattccctctcatcctctccctccccgactcaggctctaaaataaataaatgaattttaaaaaaataataagatagcttagtggatactaaaacaaagtggaaacacaggtttaacctactatatgacagatttcctcacctgtaacacaggatcaagaaatgctaaaatatttgatagataattatcaaggtgtcacaaatttaatatcaagtatatagcgacttaaacatttatgacatcttgacttcagatgcttggaaaaaaagaactaaatgactatttccccaaagataaacaaaggttaactgcataaagaagctcttcttaagagttctaatctcattcacaaataaatttgagtaaacagaaaacccaaagccaatgtcatcaataactatatcatagctatagcccttagtggagtgataactgtaaagtgtgaaggaattattagtctactataacttcacaaatcaaattattgaactatctcttcttaaatgttaagaggtcaatttcttggggcctgattacccgttctactcaaactcactcagattattcccagggtaatttcatattagacaaggagcttttattttatgtttcttcaagacaaaataggaaaaacacatttagacacatttaggtctgtgtatttttctcgatctattgactttttttctaagataaacaactctgaatctttccatttatttttcatatcattctcttccatttaggtctttgattcagtaagaaaaacggatggctcatgcaatagcacagcagtcatcaagcaatgtagtaattggtctttcctaagaaaattccttattctaatttctgtaatataatggcctagattgaaatgtaacaatttcctaaaacacttcttttctactgctttctttaactttaccttgcttaagacattgcttactcattttgttatacttgtttcatgagacaactattagtttacaaatacaaattcaattccaacttactctacttttgaattacatgatctcaaaggtcctctgaaattctataattttataaatccatgacccagtgatatagttctcgatataggccagaaaccaagcttcaaagctaattcctgcagcttatcatttgatcatgttaccctttaagcccaggcctgaaaaattagagaaactttgaaaagtaaacagtggtagaatagacatcaagagccatgatgtcacctagacatttatgcttcaaagctctttacccttttctgatttactaggattaagaccttcctgatgtgcttccatcacagatgtaggatggagtttaagcaacttgggccaaattggagggaggcatgaccctccaaacaaaggtaagaaatacagtggctctcagggtggagttgacatataggaatttggctctatgtcccacagtcataagtgtagatgatcctaacagtcacttttggaatgctctaggtaaaataaaactcaaccaacttacagcacatagaaaattcttttgaattagaaaatattttcaaaataaattcaattattttcaaatacatctagagaggttctgaaaggtgtctaaagcttaagacatttttactaaaataaaagctgttgttactaaaggaactgagagttctgaaaagtttatgctctaaaatactttaaaatctgcccaagatattgatggagactcatgtgatgatacttttcatgaagtatcataaaaacaaaaacaaaaaactgctgagcaaagtgcatttcagcttatgaattatggaatattctcaagtattgagacttatcctagtacttcacaacttagctgacagatttttctgtcagaggtttattgttagaagtatcttcctccctaaaggagagtacatttagtggaggaggaaactatcagtacattcattgtggtttttggttgatcaagtttgaatgttttcaaaacaggaaatccagagactctgcaaaggattcctgcctgtgtgtcagtttcctaggctagtttacagcttgattcatgtacttgatgttaaaattatataaataatttcagaagttctttttatggggacaacccatcatattagaggggggaaagattggctactaatcaacatgttaggaaagatcagtgaagcaagcaagctgaaaaaacaagttcaaattataaggaaagtaagcaaactatgatgaaaacagctagcctaagagagacaataaatgataaaactagcgtttatggccacctggtaggaaggcaaaaatctgcaataactcttgtacttactactttattatatgggctaaattttttttctgttaaatctaactcttctaagttggagttgaacactacgtacagtaccataaaaatcttaaaccgatacatgcacgcgcacacacaagcatacacacacacaccagttcatatgtatatataaaaccactaccttttaatctggaatgtcagagtaagagaaggtaccacagcctcagggagtatacagcccattgattctttacatctataagtagcaaaggctatctctcttaactggtttctaaactcagaacactggtgtgacaagttctacaagactgctgacaagaactcacacagtaccctggagccccagaaatgagcaccatggactgccacagcagaggccccccttcatggtgatagatgtaaagtaaacgtgcctggctcctacaggtccggtgctcagctttttttgttttttgtttttgtttgtttgtttttaattgtctcaacaatcgataccaaaggaaaccgtagcaactctggctaaggaagacgtgtggttgcttttgaccttgcatctcttagtgcaaatactcacttaataaatatttaataataactaacatgactcactgggagcttggcctctagggctcaggaggtctgttgctaattccaaccagcatgatttacgggaagtaaatgatctatgacgtgcccaaagagaataaaagtacatacaggatgcttctacttagggcttttttggtagaggaaaaaaaatacacaagttaaaaaggaacattttctctggacttaaagtctatgtaacttggaggggggaggtcctccaaatcccatgaagtcaaaccaaatgaaattacccgagctttgctgcgcaatccgagtgtaaccacatcaagtaagccgggtctgctgcaaaacatcacttaaactggagctctgacttattgttctcttactgccctagagcaattttgttttgaagagcacagaacaccctgttctgaatgtggctggcacatgaactcgatgtgctgacagcaatttgtactctgattaaaataggggggaaaaggaaagagagtgtactgcagtaacaaaaactggaatgcaagaacccaaaaactgtagaatttgtattttaggaagcaaaactgagaaggagactccataacctaaaaacaacaacaacacccaaaaaaaccagtgctgtaagtgctccagcctagagacgctagctctgctaagtgtctgcttttcccttttctaattatagtagctggtgtctgatagctttgcactcattcccaaaacaattactgggtcatggggatctgaatgggaatgctgtaatggcattactactagacaagaccagtcatctcgccagagaaaaccaggttgtgacaggttactcccatatggcaagggttttctctgctgcctaatccatgccaaatgagtttctgcctgcctaatagagctgaacatccaagagacagtggattcttaatgaccccctgaaacggcaaatgaggaaacagagatggatttctataatcaagagaggcatattcatcactgattagaagagaaactgttcccatcaagcatggtggtcaaagtcccccgcactgcctcccccttccttggcaccactttataccgtgggagaggaccaaataccagctgacagaactaaggggcagatgctacctacccaggacagtcaggcaccccggctacctgaatagaagaatccatgcaactggattatagattttcatctgaataggaggcacatgcacagtgataaactctaccccaacacaagccctcatcactcccctctttacacagggacagcactttggtcggacgtggactccagtatcatcctgccgctttatagtagtggctttgggcaaggtcatctaaattatctgaagctcagtttcttcaaccacaaaataattccagctaactcattgttgccgagaggattagatcagggcccagcagccggcattccttcattttcacgtccgggatctcctgtgtgagaccactgttatctgcttggatgcacagagatgaacccaatggaagttagctaggattattttcctgcaattagtggtaatttagaccagattaaacatgttttagaacctggatacaagaagccactgaatggctccagggagaacactgttgcagtatgaatggaactaaaagtaggtgaggtgaaggccatgtcttacacttcttttgtacctcataatgtctaccacagagttcaaggccagaaagttaatatttacttaacaatgagtttgaaacagggccttaaggaaaatagtagtaattttcactcataggaattttcctgtttgaatattggtcagtactcctattttttttttttaaagattttatttatttattagagacacaaagagagagaaaggagagagagagagagagagacaggcagagggagaagcaggctccttgcagggatcccaacgtgggtctccaaggtctccaggatcacgccctgggctgaaggtggcgctaaaccgctgagccacaggggcctgcccagtactcctatttttaataaattccaagagctatttaaagtttttactgatatggagcttttgtcctttaacactattttaaaataaatgattcattggctggattttttttaaataacaaaaaaggactatttctatgaggattttattttacctgaagacttgaatatgcctttctagaagaagctacataaacaagatatttaaaagaataaacactgtccattttagaccaagtgccatactatatttttttgtgaaaacatataataaagtggtttcaagaatttgctttcttactggaaaaaatttaccaggacattcacaaatacttcaaaagcatgtgaaaaacaaaaccaaagaaccctcatagctctattagatctcaacatgtacatacatgaactaatttctctattcaaaattgttggtaccattttgtttttgatttatctatttattgagagagagagaacgcatacctgaggggtagtggtggtggtagagaagcagagggagagggagaaagaattatcaagcagactccacgtccagcatggagcccaaagtagggctcaatcacaccaccctgagatcatgacctgagccgaaatcaaaagttggacacaacaaaatgagccacacaggtgccccaagaaaaatcattttagacaattttgcctcccctctccattgcccatctgcaccacattttgttaaaatgatccagagactagttctagattgttatcattatttttaacattgtatttttgccatttcagggatctgttaagttaaatgcaactttactgacacgggaagtactctttttgctcactaatgttgcttatgccttgaagtcttcacttcttggctttattttttgtgttattttagtatatcctacagtattttttcaaaaaggatataattctgcatattccaaaaagttgattttgttcttaaaggatgaactgagtatacagctctaggttcaaaatactcaacagttgcgggcagccccagtggcccagtggtttagcgccgccttcagccgagggtgtgtgatcctggagacctaggatcaagtcccacgtcaggatccctgcatggagcctgcttctctctctctctctttctatctctcatgaattaaaaaaaaagaaaaaagaaaaaaaaaaaacaccccatagttgtaatactcaaagcgatgtcatgtagtatttagtgtcatgaataaatctgatgtcattctgattctcattcctttgctcagagtttgttcctacctggaaaagttcaaaattttcttttaagctgtggaattaagaaattttaccagaatgtatctaggtgaaaaagcactctttactgctgtaggacactctcaactggccctttcaacctttgaagctcttctatctttaggaaagtttctactattacatgtttaattagattcaaatggtctttgattttttcatccctatcttctttcttccaccttccatatctttgggttttctcactctatgttctgagagatccctagactaccttttttatatcaccaattcagaactctgggactgcccattttgcctttcaacccttcccctgaattccagttttgataataatatttttaatttccagaaactttatcttcactttcctttttcagagaagccaggtttttgacttatgaatttaatgtcccgttatatatttctgaagacagtaattagtatcttatttttttttcatttttcatttatttcagagagagggagagagagcatgcacgtgtgcacatgggggtagggggaggaacaaatggagagggacaagctgacttctgtcctgagcgccgagcccgacatggggcttgattccaggatcctgagatcatgacatgagctaaaatcaagagttagacccttaactgactgagctgctcagtgccccccgccccgcccacccgcccttgtagtattttaaaaattctcttctatttcttcttagtccatgttggtgcttctttttctcacggtacttggtgatgtttctttgttatctggtcatgttataaaggaaggattcagtaagatcaaatgattgtcgttatctggcacagtttttcttagtggttagatacatttccatggtaggcttttccccaaagaggtgggctgtttgtgaagatgtctgcgtggagagatatttaccagaaataccagaaatatttactgagcatttactatgagctgagcatgatgtgcacatgaaggctggggatacctttccccagcggtgatatacaaaaaagtcttcaggagcaaaacacttgagcctatttactattgtgcagagctttttcacttttcttcacattcaaatctgctttaaaagttcaaagatactttatgtcttttttctctaggccaaggcctaacacatggagtcttctgaggcacatccctattttaacttggaaatctggccttactgactttagcccaggagcaaagacacagccagaccctagagtaattctcaatccttggctgcaaattagaatcacctggggagtttaaaaatttgtgcctggagttccagcctgtgagatttaagattcttatttaactggtctgggcatcaggatttaaaaaaaaactccccgggtaattctaaattcagctaaagttgagtactgctactaaagtttactgccccagctgttccatattgttttataacaaccatgatgattgccccatagcctgctttggctcccttgcaccagccgactgtgtgcttggagttctgcccaagtttgttgagaatggtatgtacctctccagagaacttctctacacctgttttgagttggatttcctgagtttagtttccatcagtctaattttatttactttatatattctagaaattcttcataatttctgatccacttcttgcattcttcctattttccagcatgattatggatttttttactcttttatgaaatcattctccaaaccccttgcctgtctcttattcactgggatctgaatagcaaaaggaggtaggaaggaagggtattccaacaaactgaatcctgcagatggctctgcttgaaatgttcacatttgaaaacactggcgattgcattttttgcattcaaatatggtgaaagcactgtagggcaagacggccacatacagccagcattttgatgtgtctgctctaagcactgaggttaacaaatcaaaaatgtgaaagacagggggcttggggaaggaagagtggtagctatttagaacctgaagtcagtgagattagatttctaagaaagcaaagcttaaaggtaacaatgtaccttctactgccaactaaagtatgatgactaaaatatccatcatctcaatgtcaattagactaccttagaacactgactttttttttaatggaaaaagaacaaggttgaataaaattacaagatggtcatcttaatcgacataagaaaaagcacactggaacagaatctaaaagttgatttgcaattattaggatcctaacagagagggtaaaaatttgaggaggaggaaccctggctggctgagtcaagttaagcacctgcctccagctcagccaggaatctacttctcctcctccctatgcccctccccctgcttgtgtccatgctctctcaaataaataaaatctttaaaaatatttctttgaggaagaataaatcctgtcaactaacataagtttctcccttattccaaatacaaagtaattgaagtaaaagatcacaagtcagaaaagccttttgatttcagtccataactttatttttcaaaaaccaaacaaatatcctagagaaatacaacttaagtacgattagtattaagagctatagaattgggacccctgggtggctcagcggttgagtgcctctggctcagggcgtggccccagggttctgggattgagtaccgcatcaggctcccttcagggagcctgtttctccctctgcctatgtctctgcctctctaactgtgtctctcatgaatgaataaatgaatgaataaataaataagtaagagctatagaattaatttgaagactgttgttcaacaggaaaacaagacaacaaggaaaaattaataatgggttctaggtcaaccctggtagagccaaaaggatttgctaatgaattagatgtaggatataagagaaacaggagtcaaggatttccttccttaaatctatattcaggaagcaaaacaaagtatataagcagaataaggagggtagaaaaaaagaaattaattgccctgtgttacatataaaaagattattaaaaaaaaagattatcatttctgttttatagatgacaaatctggatgcccaagctagtcaagtaacttgtctcaagtcataagaatatcaggtactgattccaagattcagaaaccaagtctaccacttgccaagcctgtgcacccctcccctgaccactcactgtacctttacatagaagtgacaggcactctgtaactcttgtgtatctataatgatatattatatgatggatcaccactgtctcccattctccttcactgcagaactggctttgaatctaagtgtacaggtgacgctattagaatagggatacccgtaaggaccaagaagactcccaaagaacaaggtgatcatagttttggacagagaccacttttaagtcaaccctctgtcctcctcccacacacagcaaacttgtttcaaagagggaaagcaggacaccttacccttgataagtgaaaatataatatagttttataaaaccaatttgttccagtaaaccaaaaaaggtttttggggagaaaaagtaaaaataaacaatttgtttattaggaaagtatagcctaacaatatgagagacaacaatcagtcattaccctttcttaagatatttggaaacagaaaaaagtaaaatgagataaagaactattcaaatacttttaaaaaccattgatagtagttactcttcatacagaaaggaaggggtcataagagaaaaaaatgcaggtacctgctcatttgtgcagaagaaatacaggtggtataaaccaggaacttatatgactggtgaccaatggtaggtaggtaggatggaaggtggaaataatgaggaaatgggaacaggttagtagagatgagggggaaaaacacttctgtgtatatctttttgtatagtttagaatcacggtaatgtttcacctaccccaaacacaaacagtaaacatcaaccagagtgtgtgtgggaccctaaatggaacatagatgtaaatgaacataactgcattataaatgaacagcataaccacactgaagggagtgaggaaaaagaactaacctaagttggaaagcagttgttttcatgtatgctttaaggctcatgactaaaggaactgtacacaaatatttcccatttttaggaagcttatttttcacaagatgtgggttagcaattctgaaactacgttctatataaactataattaagcagtaagcaaatatattgtggataatgagagtgaggtttctcactgctggagaaagctgttttaaataagcaaagggagaaggtgagagtgaacctgtggttggattggaaatagaagggttaggatgtactcatagtttgtaatatatatatatatacagactagtaaagaataaatttgattgtgtatatttatgcagattgaggcacacatatttcctacatccatctacttgagaggttctagaaacaataacattccatagtatgagtatacctagcactcagatcttggtttctaaatactattctctaataaaagaaatcagattttctttaaaaatagctgattccagccccagggcaaatgagagcatcctgtaccaaaagtaaggaagtactgaggtgcctgggtggctcagctggttaagcatccaactgttagcttcatttagagtcttggtctcggggtgtgggactgagccctgggttgcgctccatattaagcacagtctgtttgggattctctccctctgcccttcccccagcttactctaacataaataagtaaaatctttttataaaataatttttaaaatgttttttatttattcacttagagaacgagagagagagagaaagacagagagagagagaaagagagagagaaaatgagcagggggagagggagaagcagactccctgctgagcaggaagcccaacatgggcctcaatctcaggactccgagatcatgacctgagctgaaggcagatgcttaaccatctgagctacctatgcaacccataaataaaatctaaaaaaaaaaaaaaagagagagagagagagaaataaaaaggaaaaattaaggaagtgctttaaaaaaaaccacaggaggtatgttgaaaagcactttctaatgaccaaacttgggacaatttgagcaacaacataaataagatagcaatgaataataacctacagaataaaataaactcccatgagtccatactattataaacaactgaataaataggggaggagaaacccctccttatagcagaattccaattacattgaagaaggaacaatggaaatagaaaaatcaccattaggcaaatactacagttataaccgttgcatacaaaagtcatccatggggaaaaaaaatcattcatggatgctaaaatcactgttaaggtgtaatgtaaaagaagatcttgggatcatccatctcctagtagttctctcccaatgagatacttagaaaggcaaaaataggaaattttacaaagcagaacttggcagatcccaccttaaccaagggacccaagttacatcatcactatcacatgtctcctgataatgattgaactgagaaaggcacactattgcttatatgatatttttccaaaaaatgtgtaacttcaatctaatcagacaaacccaaactgaagtatattttataaccagacggttgtcttcaaaagtgctaaaataatgaaaatcacagaaagactgatccaactgtctcagactggagagactacatatcacagtagatcctgaatctgaccatggaccagaaaaaggacatcagtgtgggaactgatgaaactcacctaagatctgtagaacagttaatagtattgctccttgttaatttcctgattttgataaatgtactgtggtgagggatgatgtgaacattaggaaaagcttgaagcatataagaaaattctctgtactagtttcacagtttgtaagttgaaaattattttaaaacagaaagttgaaaataaagattcccactgaaaatactactaaaagcaagatctgatttaatttagcctgccccaaagttaactctgcagtggtagctttgcggcattgtttataactgggaaaagtttttccttttaatttggttaccaaaatcctccagtttagaaatatacattataaactgttgaatctgaggagtaactgtaacatagggaaaaatctccatttttgtatatgcctgaaatttttcattaaaaaattaaaatgtgtagtatagataatcttttcacgtacttgctaaagataattttctatcatccttgtgactttcataaacatttagaattctatcatggaatgctcagtgctagcaggacctacaggatcactgtaaagaaaggaagctaaagcccagagactcaagggttagttagagtccgctgaagccagaatcctctctctgactactggtctatgtatttctctaacatctgagctcctcttcgtttattctaaaacttaccatgaatgatagctacctaaacatttcaactgcaataatatagtaatactatttataattgtttccaactaaatgaataactccatttgaactaatcttccagactccccaaaatgaaacacgggtctcaaataataaatactacagtaaagataagaaaatcaaccattctagcttactgttccaaaggaactctaacttatttttatttttttttaagattttatttgagagcaagagagagagagagtgaacatgaacagggggaagggtagaaggagagggagaaggagactctccactgagcagagagcctgatatggggctcaatcccaggaccccaggatcatgacctgagctgaaagcagatgctcaactgactgagccacccaggcaccctggactctattttaaataggccttttataatagttcatattgccacccttgtttagtgctttgattgttttcttagtggaaatatttctgttttctcacaactctcctttttaaagtatttcagctttatgaagcaaatgaatggcatctttcaaacatctatccacgcagaaagcatctaccgaacaccaaatgcatgtaaggccctgtaggtgatgctggaaacaaaaagatgaagaaagattctggtcctcaaggtgcatactggggaaatgggtaaacactgattacagcataaagtggcaagtgatgtacataatggtatacagaacaggctctgggaggaacaaagagtgactgggtatcccagtcctcgacagtatctccttattcccaacacagcaaataaaaacacagaatagctttaagtcatccagtaaatggcaaagcaacctgaacccagatttcctacacagaatagaatgaacactattatcaattatgatctaactaaaataaactttttgaccttgaggaaagccagtgagatgggtttgagagctctgaatggcattataatctaactgctctgtttagaactctgtactctgtgcaatttatataactttcctgaactcattttcctcatctggagataataaattttatctcgtaaggttattttaagaaataaatgaataaatatgtaaggcagctaatatagttgctggcacaccaaggagtccataatagacttgggacttgatggataagattaccttttcctcaccttctgggtctgcagaagctcgcacagtacctggcatgggcatgctagataaatatttaccaaataaagtcagtattaaataaatgttgaatttaaaactattctcgggctatattcaattgtttattgctataaatagatttttagaaagaaacctcccttttctccctataaatggaacccaatttttaaggaccagttcactgtcacagcgatacttactttctactgttgctccttcatttgggtttgaatatccttctcctttctgtttgattcttcggataatgcctccatcttcaaataaatcttctcctttgaaatcaaggagctcaatctagaaaggaaaaaaaggatttggctgagaaaagaccaaacagagccaatttaacatacttaaaaacaagggcaaccaattctcctttcattttacaaaataaaactcttttatatttatctatgtatctcagttattggaaaagtaggaaaaaaagaacactgcactttcaatacctggaaagagccttcatgtaatgataatgtctaggactgcatcctgtgggactgcagtgcaaagacagacaggaaacactaggagggctgccttgtgggcaaaaagccagagctccaaggtgctggcccagaactattttgtcggactctaaaggccaccacctttccagcccagattcatggaattccctttttaaatgtaaaaataaatcctatgaatcaggcttatggacaactaaaggtgtttttttttacctaattatgatgtttcaggcatttcctcccttcattttttaagtcagatcttgacaaatatatatataattcaatacaggatgaataacattatcaccacctacagcttctaatgaagaagtgagatctgtgacaaacagtaagcctgtataacatgaaaatatcttacaatgtggtttcagtacatttcaacacttacctcccacatttccaacctgttttctggtcaattttgggtatgttatactcacaccactgaccagaacctttatttctcaagcctggtgtcttttgtttatttggatataacttttctgtgccagaaacacgtttctaagaaagcattggcacacaccccttgggtttgtgggaaacaattcaagaagccaagctccaaaataaataagtcggatctgatcctcaatagcaagcttagctccttgttccactgcctgttgcttcagagccagcactatagtagaacagatgctaaaaaggcaacatcacacacatacttacctcaaaaaagagagttgcattcgagggaattttagggagactgccagcagagccatatgcatattctggtttgcacagtaaatggcagatctctccttttttcatggtggccaccccaatgtcccatgccttgataacctggcctaagagaaagaaaaaggtggttgaaagctgtaggccatatttaaaaatacttaactgtcataaaacacaagttcaaacaaatttcctattctctttacattacacactcaggaagtaggagctacagaagaaccttgtaaaagctaccaagaaataaactgtgatttttgagggtgatcagagaagattccctattgagaaggatgaaagttgttatcaacttaaaaaatttttccactataataatcagggcatttttctaggtatagatagaacaaaaatagtatggaataaaatggaatttgtcctaaggatgcttataatttagttgggtagacaaaaataacaaacaactggaaaggtataaattgcataaaaggccccatgaacgatatcttctcaaaatttaataaaagaaaaaagcatttttttttttttaagcaaaacagtcatgtgtccttttgtcaaatcacaagaactactgaactcagaattttttttttcctacttccaggaaaccaaaagttgactttgctccacaactgtagaagtatattatcctatatagttgaaattatatcttataataagcagtctcaaatcctttgggaaacaataaaaatgtaggtgacttaaagggataaaatacaaaaatgaggtactatgtcaataaaaaacgtaaggtctgattcaggtaaacaatgaatctcaatggaaatgaattttgaagaaagctgttatcctgaactgataacgggtagtaggatattagagagtaaggggaactctatacctaagtaggtaagtagggatgcatttaagcatctgcgacttaggactacagcttgtcttcattaagtattacaatttttcaaaagatcagatacttattttagttaaaaatctgaaagttatatatgcctattattaaagcacacacaagagagaaagacataaagtgaaagggcatccattccctccttgtaagaaaccactcttgttcttttatatccttctggcgtatgctgtcactttttataaaaaatttaagacacaaatgacggcatactatacattcaactcagcttttcattttattttttttattattttttttagtaaatttttttaaaatttttatttatttatgatagtcacacagagagagagagagagagagaggcagagccacaggcagagggagaagcaggctccatgtacccagagcccgacgtgggatttgatcccgggtctccaggatcaggccctgggccaaaggcaggcgccaaaccactgcgccacccagggatcccgcttttcattttatatatatcttggggcacctgtgtggttcagtcagttgggcggtcaactcttggtttcaggttaggtcatgatctcagggttgggctccaccacagtgggcacagggcctgcttagaattctttctctgtcccttctccctgttctccacccctcaataatatagatcttgatctttctccatcagtagaaaggagaatatgcattttattttttttatttatttatgatagtcacagagagagagagagagagagagagagagagagagaggcagagatataggcagagggagaagcaggctccatgcaccgagagtccgatgtgggattcgatccgtgtccaggatcgcgccctgggccaaaggcaggcactaacccgctgcgccacccagggatcccaagaatatgcattttagaagttaaaagtgcaccctgttttaagcttagactacctggattaaaataacaaacccttacacatgatgtacaaattatttaacctctgtgcctcagtttcttatctgcaagatgtggataataatagtgcctgccatatagctgttataagaattattagataaaatgtcaaatgcatagcatggtgcctgggttaataaagaacagccatcataattgggggtgcatggttggctcagtcggtagagcatgtgactcttcatcttggggttgagttcaagcctcgtattgggtatagagccatcattatcatcgtaaatacaaacagatctacctcatcctacatggtggcataatatcccagtctctctccttttgagaaacatattaacaatggtattctaaataaggatatttgttcatatatgattgtctcctttgttctagtatatttggaaggtaaatttctagaaatgcaagggtgatgtgtattttcggtttgatagatatattgtccaattgcccttcaaaaatggctacatcgggatccctgagtggcgcagcggtttggcacctgcctttggcccagggcgcgatcctggagacccgggatcgaatcccacgtcgggctcccggtgcatggagcctgcttctccctctgcctgtgtctctgcctctctctctctctctctgtgactatcataaataaaaaaaaaaaaaaaaaaaaaaaaaatggctacatcaatttatatgcttacacatgggtctactgtgaaaacagtccagaatcatcaggcaaaatgttaaatctgttgttgacaggttggctttcctgtcacttattctttccaaagattgctaggttttagactgggcccttgagaaccttttttttttttttttttttaaactaccgactctgaaattttaagatatactccttcaagacatcttcatgttgtgggggttactactgtacatttgttcaagatagttagtcaagggcagccccggtggcgcagcggtttagcgccgcctgcagcccagggtgtgatcctggagaccctggatggagtcccacgtcaggctctctgcatggagcctgcttctccctctgcctgtgtctctgcctctctctttctctctctctctctctctgtgtgtctctatgaataaataaataaaatcttaaaaaaatacaaatattctctctccaaaatgctctctgaaaaaataaatcatgttaaatattaataaataaatcatgctaaaaaaaaaagatagtcaattactgaggaacaaagatctagctattaagaatacaaaggtggccatccccttcttccttccaaggatcatgcaatgtagtatggctagtggaagagaaagatacatgcactgtttttgttttaagcaaagcatggtaaacactaacacagagtataaaaaagggggcttttgcttttgcttttgggtgggggttggagcaatcagaaaaagcttgattcacagataagatctacactaggccttaggggtcagaaacattagcctgtcaattaaatccacaggaccctcaacctaaaaaagatcatgcctgtgcctttgcttttttttctcatttgagaacataaagcttctttttcattgagctcccaataccgaatgaaacacactgagcaaagagccagagtggtatgaacaaaggcatttaattctaaaattgccaacccagggactcttaaaaagtatttctcctttgatgtgatgagtaccaggtgttgtacggaagtgttgaatcactaaattgtatagttgaaactagtattatactgtatgttaactaactggaatttaagtaaaatatttttaaaaagaaaaaaaaagaacttcccccgatcaaaaaaaatacaaaacaaaaaatactaaatatatactcatcatagaatgcctggaaagtatagaaaagcacagagaataaaatttaaaaccttggctatcccaacatcaggcataaactgttaatttcctggttcatttccttccaaattatacatgtacactttgtttgcatttaatatttttaattccacattcttaaaattctggccacatttggttttgtgatctgctctttacatttcacactgtatgagcatttttcttgttaaaagacagtatctgaaaaatgacctttaataattatatactgtttcatcttttgattataatttcatcacttcattaataaacacttaggttctttcttttattttactattataaagtttttttttaaattttatttacttattcatgatagacagagagagagagagagagagagaggcagagacacaggcagagggagaagcaggctccatgcagggaacctgacatgggactcgatccctggtctctaagatcacgacctgggctgaaggtggcgctaaaccgctgagccacccgggctaccctattataaagttttgatgaataattttgcacctaaaaaaaaaaacaaaaaaacaaaaaacaattttgcacctaaatcttcatgtattttttttccctccacagtaaaagcctcttacctgacaatcagaactatagtggctgggttaatttaaaatgttgcttcaagtgaggaatcaaaaacgaacatatacatacctcaaatatttttataccttaaaacatatcaaagtatattaattcactaatctttgtcacaaggccaactccttgtctgtgagtgtggctctggtgataaagagttccacaccaaccttactgtatacatcatacttatgatgtatcatttcaatctacaatgtgggtttctttaaagtggactggaaatcagaagatatttgtaaagcaatcagcacaaagaatgcttctggtaaaaatgtgttctgaatggcttacttgttttcgtcttttacccactcctaatttaagagcaattttttttaaagagcaatttaaaaatgtttttagcaattcaccttagtaatgtctttctgaaaatgttcaagttttcatagaaataattcctctttgtttctacattaagtgttttatgtacaatctaattaaattctagaattacaaaaaagtacagtggacatgaacacgtttcagctgattcttaaagtctgaggaagaaaaaagcagcccctaacatttggaaactacttgacactgacagctaggcctttatgatgtctgaagcaggcctggggaaaggtagggcatgctattctcccattggacataaacaatctcacaaaacatcaacatcagccaaggtcattgtgagaccatgaaaaagtgagacaaaacaaaaacacttcaaaattttgtctgaacaaaaaataaggtcattgtgcaacctacaaaataccaaacatccccctctcctggctgacaggagtgactgctgcttctccagcaggtgtaactttagtctcttatctattcagccttcctcttaggtaatatttactaagatacccaaagaatcagctcacatcctaacaatatcccatccagagcaaagaccctcttccctaaacccttccccaaatcacctaatacaagcccaaatcctgtaataaatccttttggacactcttagtgaaataccccacaattcctatgttcattttccctccctacagtgagtaataaacccaacttgttcaatgacagctgtgttctgtggctggagggcattgacaaggcccacttaaactggctgaagcagagtgtagcaccacaccacagaacaggaaaccaccagtatcactcaacatatttgcaaacagaatgaagagcatcatcagtctggaattggttaagcaagcttctaccatacttccttaggtgcaattcctagaaggaaaattatagggtcgaagtataaacatttttaagattcgtaatctttaggatcttttgatctttaggatcataattatatacaccaagaatatagaatttatccttacacttgatctggacttcagttatattagctcaaaaacaatttatcaatttcagagtcctatttcatttgtaacaatatctgaaatgaaaaaaatatatttaaacaaatgtataatgtagttattccttttttttttaattttttatttatttacgatagtcacagagagagagagagagagagagaggcagagacataggcagagggagaagcaggctccatgcaccgggagcctgatgtgggattcgatcctgggtctccaggatcacgccctgggccaaaggcaggcgccaaaccgctgcgccacccagggatccctaatgtagttattcctaggctcaaatgctttctatatatatctgactataggcaattggaaaagtttaaaagtatacaaaaagcccagtataaaggcaacgaactgtactattttcttccttctgcaaagtgtaatcaaagaatacattttaaaatataaaattttgggtcacgtgggtggctcagtaagtatgtgactcttgatttcagctcaggtcacaatctcaaagttgtgagactgagccccgtgtcaggcatcatcaggctttggactggatgtggagcctgcttgggattctctctccctctctgcccctccctgcccactccctctctaaaacaaacaaacaaacaaacaaacaaacaaacaaacaaaaaaccataaaattggggcacctaggtggctcagttaattaagcatctgcctttggctcaggtcatgatcccagggtcctgggatggagacctgcatcaggctccctggtcagtggggagcctgtttctccctctctctctgcctctgcctgccgctccctttacttgtgctctgtcaaataaataaataaaatattttttaaaaactcatttaaaaattttataggttcaatgtaggttcatcaattttaacaagtgtatcactctgatagggtgtgttgtaaaggggcgagggaaggctatgcaagtgtgaggatggggagtatatgggaaatctataccttctgttcaattttactgtgcacctaagagtactctaaaaataaggtctattaaaaaatgtatcaacacattttaatgaaagcaaccagtgtccatcgatagatgaatggataaagatgtagataaagatggatatatacgcatacacacaatggaatgttaatcataaaaaagaatgaattcttgccatttgcaacaatatggaggatctagaagatgcaatgctaagtgaaaaaagtctgtcagcagggcacctgggtggctcagttggttaagtgtctgattcttgattttggctcaggtcatgatctcacagttatgggatcgagccccatgttgggttctgcagtgggtgtggagcctgcttaagattctctctctctgccccacccctccccctctctaaataagaaaaaagacaccgtatgatttcacttatatgtggaatttaagaaataaaataagtgaacaaagggaaaatacaataaaaaaccccccagactcttgaatatagagacctggtagttctaggagggaggtggatgggggtatggggtaaaataggtgaaggggattaagagtacacttatcacaaggagcactgaatgtatggaattgctgaatcactatattgtatacctgacactaatactgcatgataataatactggaatttaaataaatagatttataaaaataaagggaaagaattttaaatcatgtaacacattttaataaaatatcattttaatttaatcatggaatactttcaaactatagtgaccactttagaacattttaaatttttaaaaattgtggtaaaatacatataaaatttaccatcatgaccatttttaagtgtacagatcagtactgttaagtatattcacattgttgtacaaccagtctctacaactttttcatcttgcaacattaaaactctacccattgaacaacttcccatttcctcctgccccaagtccctggcaagattttcattctactatttctgtgaatttgattactctagattcatctagatataagaggaatcatatagtatttgtcttttttccaccagatattctacacccaatgtggggctcgaactcacaaccctgagatcaagagtcacacactctacccactgagccagcaaggtaccccctatagtgtttgtctttccatgactggcttttcttagtgtatcctcaaatttcattagtgatgtcacatgtgtcacagtgccctcttttttttttttttttttttaaggctgaataatattcctctgtgaacaagtgtatgacaatttatccattcagctagagataaacacttgggtggcttccagcttttggctataatgaataatgctgataacaaacctgagcatatacctatctttttgaaacactgctctcacttcttttgggaacatatccagaagtaaaattgctgagtcatagggtaaccctatgtttaattttttgaggaactgttatactatttcccatcatggctgtaccattttacatttctaccaacagtgcacaaggatttcaatttctccataaccttgccaacacttgttattttcttacttttttagaaaaagattttatttatttattcatgagagacacagagaggggggtgggagcagagacaccggcagagacagaagcaggctccatgcagggagtccgatgcaggacttgatcccaggactccaggatcattggcacgccctgagccaatggcaggcactaaactacagagccacccagggatccccttttcttacctttttttgacagcagctatcctgatgggtgtgaggtgctctctcacttcatttttttttttaagattttatttatttattcatgagagacacagagagagaggcagagacacaggcagagggagaagcaggctacctgcggggaatgtgatgcaggactcgatcccaggaccccaggatcatgccctgagccaaaggcagacactcaaccactgagccacccaggtatccctcccactgcagtttttatttacatttccctaatgaatggtgaagttaagcatcttttcatatgctagtaagccatttatagatctttggagaaatgtctaggttcattgcccattttaaaatgtttatttggggtttttccctgttgttgaattataagagttcaatatgaattctggatattaactctttgtcagaaataggatttacaaacaatctttcattctgtaggttgccttttcactctgttattgtatcctttgaagcagttttaaattttgatgtccaatttatgtattttttacttttgttgctattgcttttggtgtcacatccaaaaaatcattgccaaatacaatttcatgaagcttttcctctaagttttcttctaaaaaaatatagttttaggtcttgtgtttaggtctttgatccatattttaatatatggatcatttgtatatatggtgtaaagggtacaacttcactcttttgtgaatatccagcttccccaaacatcattcattgagaagactgtcctttctctactgattggtccataaaacatttaaaggtatgcatttgaaatatgagcatacttaaaatattataggatggaagatatatggcattatacagaaaaacactttttcatatgggaatagaaaagaaggacaaaaaagataaaatgttttcattgtaaaagggttttctttcaaaacataaaagctgataaacacttaaatataaggctagtcactagcaagtttcagataattaaaaacccatctgattcattcctgctttatcttcattgaagatttccaggacttagtagcaatttctgcttggtattctaactctatgtgtattttgctaatattttctatttaaaaaaaattccatatcattaaatataatattgagaatgtcttccttttttcatattagataaagcaaattagtttttcctatttttccctcttatgaattatttgttttaaaaggtcttataaaagggctctgataatcatctctactccctaccaaaagtatctgattatgaattgaactatttacatcttaagattcttttaaagtgttcatatgtcttctgttatattcatttttgccatttctctaattactaagaaaggatgccttggtggctcagcagttaagcatctgcctttggctctgggcgtgatcccttggtcccgggatggagtcccacatcgggctctctgcatggaacctgcttctccctctgcctatgtctctgcctctctctctcataaataaataaaatctttaaaaatatataaataaataaaaataaacttttcaaaataggaatccaacctgtaatatcaagcatataacagcaaatattttttttaatttttttaaatttatttatgatagtcatacagagagagagagagagagaggcacagacacaggcagagggaggagcaggctccatgcactgggagcccgacgtgggactcgatcccgggtctccaggatcgtgccctgggccaaaggcaagcgccaaaccgctgtgccacccagggatcccaaatattttgcttttgataaacctattaactctatcattcttgtaagaaaagtatctgttgtacagcaggcactcagtgaattctgctggaccagaacctactttatttttgtacctgatttgagctagttttaagccttaagatctaatataactccgaagagattgcttgagtttgaatcctggccctaccactttattgtataactttgggctaattactttatctccctgtatcatagtttcctcatatgtaaacaaaaaaacagaaccaaatgaaaataaaaatggttaattatggtaggtacctaaaccataaaaaaaaaaaaattagcaaagtggatttcatcaaaattaaaaacttgtgttcctttaaagaccaattaaaatgaaaaggcaagccaaacactgtgagaacatagttggaaaatctgataaagtgcttgttgtgttgagcataactaactgattttttttaaataataaaaaatagggatccctgggtggcgcagtggtatagtgcctgcctttggcccagggcacgatcctggagacccgggatcgaatcccacatcgggctcccggtgcatggagcctgcttctccctctgcctatgtctctgtctctgtctctctctctgtgtgactatcataaataaataaaaatttttaagtaaaaaaataaataaataaaataaaataaaataataaaaaataacagatacttcacaaaagaaaatatataaatgcccactaagtgcaggaaaagataccctcaatatcactagttaacagggaaatacaaacgaccaaaatgagataccatttcatgcccattagaatggctaaagttaaaaggactgaccatactaaggactggcaagggtatgaaaaacttaaactctcatgtactgctggtgcaaatgcaaaatggtatggcaatgtcttataaacatacacttactatgtccagcaagtccattctcaggcatttactcaaaacacatgaaaacatatacccgcacaaagacatgaatgtgaatgctcataaaaacattgtttcataatagccccaaactccaatgtcgaatttctgaatgtatgaacaaattgtgctatttctatactgtggaatactacttggcaattcaacattcatgaatctcaaaatcattatgtaagtgaaagaggtaaataccaaaaatgacatatgattccattcatatgaaattctggataaggcaaactataataacagaaaccagactggtgactgcatgggccccaaggtccaggaaggacagagactgcaaaagaacatgagaaaacttttcagggtgaggaaattggtccatattgatggctggtagtagttacagaaatattaccaaattcaccaagctttacctttcttagaggggtaaatcttactacaggcaaatgccacctcaattttaaaaaactcaaaaattcttagaacaaatgttaatatgactgtcacctaacagatactaaatagattgtataaagaatccaaaaaatagggatccctgggtggcgcagcggtttggcgcctgcctttggcccagggcgcgatcctggagaccctggatcgaatcccacatcgggctcccggtgcatggagcctgcttctccctctgcctgtgtctctgcctctctctctctctctgtgactatcatgaataaataaataaaaaatctttaaaaaaaaaaaaaaaaaaagaatccaaaaaataataataggcttggtgtgacaataaatggtgctgggaaagttggacatccacatgcagaagaatgaaactagaccattctcttacaccacacataaagataaactcaaaatggatgaaagatctaaatgtgagacaagattccatcaaaatcctagaggagaacacaggcaacaccctttttgaacttggccacagcaacttcttgcaagatacatccatgaaggcaagagaaacaaaagcaaaaatgaattattgggacttcatcaagataagaagcttctgcacagcaaaagaaacagtcaacaaaactaaaagacaacctacagaatgggagaagatatttgcaaatgacatatcagataaagggctagtatccaagatctataaagaacttattaaactcaacagcaaagaaacaaacaatccaatcatgaaatggacaaaagacatgaacagaaatttcacagaggaagacatagacatggccaacaagcacatgagaaaatgctccgcatcactggccatcagggaaatacaaatcaaaaccacaatgagataccacctcacactagtgagaatggtgaaaattaacaagacgagaaacaacaaatgtggagaggatgtggagaaaggggaaccctcttgcactgttggtgggaatgtgaactggtgcagccactctggaaaactgtgtggaggttcctcaaagagttccaaatagatctgccctacaacccagcaattacactgctggggatttaccccaaagatacagatgcagtgacacgctgggacacctgcaccccgatgtttatagcagcaatgtccacaatagccaaactgtggaaggagcctcgatgtctactgaaagatgaatggaaaaagaagatgtggtctatgtacacaatggaatattactcagccatttgaaatgacaaatacccaccatttgcttcgatgtggatggaactggaaggtattttgctgagtgaaataagtcaatcggaaaaggacaaacattatatggtctcattcatttggagaatataaaaattagtgaaagggaataaagggaaaggagagaaaatgagtgaaaatatcagtgagggtgacaaaacatgagacacacctaactctgggaaacgaacaaggggtagtggaaagggaggtgggtgggggttggggtgactgggtgatgggcactgagggggggcacttggcgggatgagcactgggtgttatgttaaatgttggcaaattggactgcaataaannnnnnnnnnnnnnnnnnnnnnnnnnnnnnnnnnnnnnnnnnnnnnnnnnnttccaacatatattttttcctcttactctaatatgctcattagcataatgcagcacagaagattatattaatgtatagggcagatggctgatattacttcattatagttttgttttgttttacttcattattgcttaatctcagtagtaagagtgtaggtatgtggagaatccaaaatgatgggtttctttgtttcgcttctcaaatctggggaaagaatataacagataggatttttatcttcataattcccaatcatgtttgtcacataccaagaacacccaaaccaacttcattgaagtagccctctataagaaatcatcagaccttgataagggtagttaggggaggagcaaagccttggtgtgcttggatttactttgaagaactgaaagaaagaattctttcatccaccaaatctatcccttcccaattttattgataatatatttgttggagggaggcggggagggggaaaaaccagaacttctactatggaagtatattggagaatcctgagtccttattttgacttcttttaaaatgaattatgaacacagttctaggaattcagaacatgtaagatttatttatttattattttgtttttaaagatttatctatttattcgagagagagagagagagagagagagaaagagagagaggcaaagacacaggcagagggaggagcaggttcctcgcaggagcccaatgcgggactcgatcccggattccaggatcacaacctgagccgaaggcagccacccaactgctgctgagctacccaggcgtcccagaacatgtagtatttagttaagaaaactaaaaaaaaaaaaaaaaaaaaaaaaaagagagagagagagagaaagaaaactcaagaaaagaaaccatcatctcttcattctaatttgtgtaacatattctgaagtggtaataatcagttgtcttattcagtttttgtctttccagatttcctgaggctaaaaatgatggtaaagcattatttcaaaaagtctgtatacaggaatagtaagcagagttaggacccaaactgctatagaacagtttttgccattccactagaaagccagtcaataattctaatgctataacaacgtaataaacatgtgagtgcttactatgtgctaagcaatggcgtgcaatatcttatttactcttcaatatacaaaagtatatactatcattatcatgattttacaaacaatggaggtagggcacagagtttaaaagatggtacagaaagaaagacacatatacacacaactcaggtaaagctcaaatgtatatggatgtacatatatatggtatgtgtatttttatggcaattttctacagataaactgtcacaactctattttaaatacaaaagtcacaacagagggatccctgggtggcgcagcggtttggcgcctgcctttggcccagggcgcgatcctggagacccgggatcgaatcccacgtcgggctccctgcgtggggcctgcttctccctctgcctatgtctcttcctctctctctctctgtgtgactgtcatgaataaataaataaaatctttaaaaaaaaaaaaaaaaaaaagtcacaacagaatccccaaattagtgtgactttccactgaaatatttctatttattcccttggtagaggtgcaatacaagagatcaagagagctcaatataaaatcacttatattacttttcttcattttgatcaaaatcctaggaaacagaaaagactcattcatcatagggtagagaaaatgggagtgtaagttctcagcaatttttttttcttaacaattcttaactcttcttacaaagacagctgctgaaagaaggcatcttattttaaatccatcaacttcttcaagacagaaattcaaagggtagagtaagggtttggggggcggggcagtgggaacaaagatgtctaagatttctgatgaggccatttactctgaggtcatctaaagtaaatactgatgccacactcatgctgttggccctgaaggttcacatccctaaatcaacaaaaaagagacaaattctaatttaactgtcagccatcatctgctttattaagaaagaatctgtatttgattttgatttgtattgtattgagacacaaagattaatctcacaggaaccactgattcactaaaggcccaaaggagaagggaacagtggcagagccaagtaccagagcttgcaaagagtacagctggacaggaagcagaagtcacccagacatatgcctgagagtaccagggaaggcagcacagaagagaggcagaaaagagcttaattccacagttcctcacttgctatttcctttcccagatccatgcttaactaacaattcatctaagatggtaaaatgagaaaaaaaaagggggggggggatgatagtcaatactgagccacggtggtagacagggggattactccttttctcccacacttaatctgggaataaactagaaatctgttatatctgtaacagataagaattaaaaaaagattggtaattcagccactacctttcaataagccatatggcccacaaagttccatttgatgtataggctattattgtccttacaagactttaaaaacaaacaaacaaacaaacaaacaaacaaaacgctaaattaactaaagctatttaaaagcatttgaaaataaatcagtatttttttctaattaattagtttaaatcacatttaagacttgaaaatagggcagcctgggtggctcagcagtttagcctgtctttggcccagggcgtgatcctggagtcccaagatcgagccccacgtcgggctccctgcatggagcctgcttctccctctgcctgtgtctctgcccctctctctctctctctttctgtgtctctcatgagtaaataagtaaaatctttaaaaaaaaaaaaaaagacttgaaaatagtggttttccaatcttttttcctcaagacctcctttacatcttaaaaactgaggaccccaaggagcttttgtctatttactgatatttaccacattaaaaattaaagttatttaccaattcactgaaaaatagtaataacctcattatatgttaacacaactttttatgaaaagtataatttttaaaaatttattagtgagaacagcattttataaatttacaagtgtaaaatgtgtctaacttaataaaagacaaccaggttctcatacctacttttgcattcatctgttacaaatttggtttaactctaagaaaaaatccaaacccacaaaaatagatagttggaaaagatgggagtactttaacagccttttcagataattatgattataatcatctcatatggcatcaaagttggacaagtgcacaagctgcaatgtgtaatctgaaagcatatcaatgaatttttcatatcatattacattaaaatccactggtctagcttgcacaatgaatggatcttttagtcaagagtgattttgtaacagcttgtattgggaaaatattgattcactaagttagacagatcttccaaatgttaacacatttcatcatataatattttatttatttatttatttattataataaatttattttttattggttcaatttgccaacatacagaataatacccagtgctcatcccgtcaagtgcccccctcagtgcccgtcacccattcacccccaccccccaccctcttccccttccaccacccctagttcatttcccagagttaggagtctttacgttctgtctccctttctgatatttcctacccatttcttctcccttcccttctatcccctttcactattatttatattccccaaatgaatgacatcatataatattttaaaaatcacattcgttgatatccacggatctcatcagaagtcttttaagtttgaggaagttgtcaggctcccagtggcagatacaaatttcccaaaactgtaatttttatttgaaaactcaatggtaagacatactgtcagttgtcttccttgaagtgacaggctcacttcattcatttttttaaaattgtatttatttattaattaatgagagacacacagagagagaggcagagacacaggcagagggagaagtaggctccacgcagggagcccgatgtgggactcgaacccacatctccaggatcacaccctgggctgaaggcggcactaaaccgctgagccaccggggctgccccatttcattcattattaagaaagtatctgccaaatactatataatcaagtctaaacaacgacagtttgcccttttaaagaaaaatgattattataaaaaaaatgcactcaagttaagtgcacaggtacttcgtgagataaccagtacactcgggtatgcaaaagtgctccatgtgtgcttccccatctgtcataaaacagcaaaacaatgtgaaactcaaagatcaggatttaataaaatcagtattttttatgctttgtcgaggacaccaagtgaaactggcttcctttctgatccttatttacacagtgcataaaggcagcgaagcatatacgattgctagcataggctggtgccaccgcctagaattgcaccagggcaccagcagcctttaccactgcagcttgtgcaccttcagtagactttactgccaacactgtaaacagataaacaacatcttagttttattataaaaacagtcttgacattatggacctcctaaaaatccaccagctcctctgatccactagctcctatgtaatataaatggcaataaatccaagcaaaacacaactccaaaaataccctcttacctttgccaagactaaagacaaatggttcatttcgatcatgactggaatcaaacttctttccatttgacaatttccctttgtaatggacataaactttgtctccaatcattggtgtttcctcactattccccactcttttgacaatctagaaaagacaaacatcaagaaaaaggagctgattttattctgatcagagatgcacaatccattccactttacctacagatttactaataattacctgtccttcctaaaggcctccccgctagttctcttaataaccctcactgttagaaaatcgtcctatgctactctcaatctttaatgctatatttaattttactgccaatcacactattccctcaaaataacataataatataaccccagagggcagcctgggtggctcagcagtttagcgccaccttcagcccagggtgtgaacctggagaccagagatcgagtcccacatggggctccctgcatggagcctgcttctccctctgcctgtgtctctgcctctctctctgtctcagtgtttctcatgaatggataaataaaatcttaaaaaaaaataataacaaaaaattttttaaatttaatttaattttttaattttttaaaaatttttttaattttttaacaaaaattttaattttttaattttaatttaattttaattaaaaaaatttaaaaataatataacccaagagatcctgactcatgctttgacactaaaatctctcaaaacacagagctagttcatatacaaactgaattagaccaaaaagattagactttcaaaaacattcaaaaagggggatccctgggtggcgcagtggtttggcgcctgcctttggctcagggcgcgatcctggagacccgggatcgaatcccacatcaggctcccggtgcatggagcctgcttctctctctgcctgtgtctctgcctatctctctctctctctctctcaatctgtgtgtgactatagtaaataaataaaaaattaaaaaaaaaattaaaaaaaaaaacattcaaaaaggagttgaaagcaaacttacaaaggtgagattttatttacttccaccctttgctaaaaactttaccttttgactagattccactagtttggtttaatttcaaaaagctcaatttcctggtataacaggttatactttttattatgtgaggaatatttactgtgaaaaaaacagtatcactgtatagtttgatatgatactgaatagcttgttttctagtaaagcaaatgccaaaaaagctccaggctgaaaaatagctagctgtcataaaatccagtatatttattttgttcttggcagagcagactactaatgcagttggtcagttctgggaaaagaatatcaaatccaagcatgtggtggcataatttattctgtcaatcacctatgccaaattaatcatttttattagataacagaggatggtagctaatgtccaagaatcgtcattttagggaagagtctgaatttttatataaagaattcagttattcactcctaaattccttaagatgtatcctcccagccccaccctcatatcaccacataaacactgtaagcttatattctacaattttctagttcaaaagtccagatattctttaaaggaaaagaatcattatcacagctccaccaaaaacctgttagaactaatcattaatgaattcagtaaagcaggaggatacagaatcaacacacagaaatcagctgtttttctacacactcataacagggatatatctgaaaaagaaataatgaaaacaatcgagaaatgcaagtcaaacccacaagatactacctcatctgttagaatggctaagattaaaaagacaagaaataacaagtattagtgaggttttggagaaaagagaatactcgtgcactgttggtgggaatgtaagttagtgaagccactgtggaaaacagtgtgaccattcctcaaaaaattaaaaacaggactaccatacaatccagcaattccacttctgggtatttctctgaggaaaacgaaaacactagctcacgaagacatatgtacctcctatgttcattgcaacattatgtacaatagctaagctatggaaataacctaagtgtccacagagaaacgaatggatgaagaaaatgtagtatgtatattatatacacagtgaaatgttaatccagccataaaaaaagaataaaatcttgccatcgtgacaacatgaatggaccttgagagtattacgctaagtgacagaaaatcctgtatgatctcatttatatgtggaatctaaaaaagctgacctcacaaaaacagagagtagaaggttagttgttaggggctctagactgggaaaaatgggaagacatgaagagttactttaagtagatgctttaaggatacaatctagtcttgattcagctccacaatgtaattttattacttttatagtaataaaagacatgactacagatgaggcactctgctaaatgctttatataatctcaataactatatgaggtgggtagtattattccaattctacaaatgaggaaatctcaccacagagaggttaactaaaatgccctaggtcatataattagtagacctatttaatcttaaccaaaagccccatggtgctagacagggataaattataggatttaaaaggcttaggatcccaaaatgtttcttacaaacctaaaaatcttatcggatttactccctggaataatacagggctggaggcatattggggactatgttctctgtatgggtgcatggaaaagatgaaagagaaggacttaaccagagcagggagatgccgaggacagcctgcagatatctattgtctctagaagcatcctggagttcaggataggtaattcatacaggttaagaagccctatggagggatccctgggtggcgcagcggtttagcgcctgcctttggcccggggcgcgatcctggagacccgggattgaatcccacgtcgggctccctgcgtggagcctgcttagccctctgcctgtgtctctgcctctctctctctctctctgtgtgactatcatgaataaataaataaaatcttaaaaaaaaaaaaaaaaaaaaaaaagaagccctatggaaaaagacagcggtatataactctaagacataaaacccctatttccagagttgaaagtccccaaaatttggctttgcatgtacgtggcaagctaacagtaaaacgtatattcagaagactcaggcacaggaagaaagctttcacataagcaagactagacaaactaaaaaattcccatttgctgctgctgctgacacaaggaaatattgaaattcagcttagtgatgatatttagaacgtgtaagataatcttttcagcaagaaaaaaaactatacaaacttgtatgagtaacaacagtgtaggagaaataatgacctaatatgactaaatttatttaacctctctcagctccactttatttacttacctggaataccaatatataccttccataaataaaatggaaagttcaagaggtgctctgattatctcacaagaccattgtgagacacaaataaaaacacacatgtagatgtgattaattatagagtgaaaaagatatagtgtgttttaatgaggaaagctaattcaaaggtaagatatattctctgatgaaatctcaaaaaataccttcactgcacaaataacaatttgcatgtgaaaaaaatccctttgaactttagcaagttaccttttctttttcctctaagtcttttgaattgtcaccaattagctttaatatactgaaatattatgttaaaataataacccatgtgtacgctctgagaactgggagacagagccttctagagtcacacataacttggatctggaccccattcatttacctggctgggcctcagtctcaccatctataatttgggatttttttaaaagattttttatttatttattcatgagagacacaaagagagagagagaaaggcagagacacaggcagagagagaagcaggatccatgcagggagcctgatgtgggactcgatcccaggaccccaggatcatgccctgggccaaaggcaggcgctaaaccactgagccacccagggatccctccatttttaaaatataatttgggattaaaacaaacttcaagtcatgaagatgaaatgaaaaatggttgtagtgtttagcacttaggtaagcctcaataaacattattgacctccaccttccagccaaaagaaaaaaagaaagatttttataaattatccttccagacagcaaatttccctgcatgtcattcatccttgtaacctcacctttaatactcctctatctttttttgaggtgatatcctctccacgttcagccacagctgctgctgggttttctccactgttcttggcaccttcatcagtagtcattgtcttttataagcaagaaaacctgctgagaagaaacatattttaacttagaaaaatagcactgctatgaacatctgaaagtgcccctacatatgtatgggctttccctgatctaagatttacatagggccaataaagttaaatgctgaaaatgaaagcaaaaacacttgtcatgagcatgtattgatgtcatgtggtatgtacataaaacaccatccaactctttaatttcccatccagcactggtcccaaactagagagcagtacaaatcaggtttggtagtgattatattccttaacattattacacaccgagaagcagtactttagaactctgaaaatgtctttttcctatagtcatatttttgacagagaattaagaacttatcaagtgatctgatttttttttttatttatttatttatttatttatttatttatttatttatttatttatttatttatttatgatagtcacacagagagagagagagagaggcagagacataggcagagggagaagcaggctccatgcaccaggagcctgatgtgggattcgatcccgggtctccaggatcacgccctgggccaaaggcaggcgctaaaccgctgcgccacccagggatcccaagtgatctgatttttaagatgacaatatacaggggcacttggctagctcagtagttaagcatccaactcgatttcagctcaggtcgtgatctcatggatcatggggtcaagtcccacatcaggctccacgctcagtggggaatctgctggaagatcctttccctctgcccctcctgccacttgtgcacactcaccctctcactttctctctcaaaaataaataaaccttttttcccttttaatggcaatatagcatagtggtaaacagaacaggctttagaagctgacagaccccagtccaagtcttagctccagcaatatctgtccaacacctgcaaacttaatctcgctgagcctcaatttcacatctgtaaaagggatggagtacattgttcatggagttactgtgaggcattaatgagacaatgtatgtgaagagattagcacaaatcataacttagaattttaagtatttatcatgcttattatgggtcctctttggagctacattttttatctcctgctcaaaatatctacagaatgaggttcttccctagcatggcagttgaggcccttcacaatctgatcctaacttatctttcagaggtctagcttccaccactttcttttactttctttcatgcagctcatgctcgagccaaacgagagtaattcctaactaaagcaaagcccactgctttcccatctccatgcttttggcctctcatcttcttctccaaacactcctccctcttcaattcttccttcatcataccaatcctgaccctatacttggaagttgtttgcacttttctgtgctatcatatatttataagaagacacactggatggatttaaaagaaaccttgagagcaagggccatgttttgttcatattgagatcctctagaatgcctccacctctcagactgctaaaacgaaaagagcaaggaatttggagctccttacaagatgtttgatgttggctatctctaacttttcgaagccttttctcccacctatgtaattgggataatatctactttcacagggtgatcttctggattaaatggtataacgtgtatttctagaagtatacattctgaagtgggctcttactatcagtcacccaaatgacaagcactttttcatgcatggcaaaccaaaccaatgggccaatcaaacaaaacacacctcactgtctgctgccatgattaattctacactgctctcctggttgagcggggaaagtcaagaatgaatcacttctatagctattccctattagactaataatgaataaagctcccctaaagtcaatatggaataatagtacactgctgtgttttaaactcatttccaattgacctaaatttatttcagtgtcaacaaagacacaaatcaaattctgctgtgcccaaaaatcttcaaagagaacaccaaaaaccaggggctaagcccctttgctttattttctagtacagtttataccaaacacaaaagatccaaatgcttggctcaggataagggagaggccagaacaaagcattctcaaacaaacaacaacagaaattaagtacccagctgtatatgatgctaggctagataattaggaaaattacatgaacagggttggttccaagcttctaatagcctactgcttttaacagatttctctaatgcatgggtacttgtagaaggcacctaaaacagaggggaaaagatcttttaaatatttgggggagtcatgaatcatatttctggaaaaatacatttacacaaagaatttcataaactgacttcatagataaactgacatctatcagtagatccctggcaaaaccctgaattaaatcaatgagcaaattaaaataaccaggttgaaggttattagggagtaggacaaccacaaagtctcaaagtatgaacctacagattatttaataaaggaaaaacactttccaataaagtgatctgagaggtacccttagcatgagtggtttgcatcaccaaactgtgtatcatcaaagtaacacaaacggctatcaccatgcctcctgatgtgacataatgggaagtagacatatagtattcccaccaaaagtatttatttaacctgaaactaatcaagaagaagacaaaatcagttgtggaatgttgtatgaggcaattgacctagatgcctcaaaatgttgttatgaaagatccttcacccccaaaaagataaggggcctatcctatttaaaggagactaaaagacgcctgggtggctcggtggttgagcatctgccttaggctcaggtcatgaccccaggctcctgggatcaagtcctgcattgggctccccttggggaaattgcttctctctctcctgtgtctctcacaaataaataaacaagatctttaaaaaaataataataaataaaggaaactaaagatatacaacaaccctgggtgctgggttaggggaatgaaagtgctataaaagtacattttggggagaattagaaaaacttggaaaaataagactgtacattagattattattactttacaacattaactttctgaagtgtgatacagtattgtggtcttatgttgaataagatcttcattctcaggagacacaacctgaactatttaggggtgaggtgtcatgatggctgctacttactttcaaatcatttaagagtgtgtgtgtgtgtgtgtgtgtgtgaacacaactaccacaaaaaaaaaacaaaagttttgagaaagtattatcacacatccaaagacaatgcctttctttttaatgctcatcaattgaggatcagctacatttttaaatgaaaatattaccaatcaaaaaacattttcctggggcgcccaggtggctcagacagttcagcatctgacttgatctcagctcaagtcctgatctcaggctcctgcatcaggcttctgcctcaggctaagttggcttgagattccgtcccctgtgcccctctccccattcccaccccagtgctgcttacaagcatctctctatcaaatgaacaaatgaatcttttttttttaagtattttcttttggttctaaccctaccctttgtaaataacagcatgctaaaattcaataaacagagaacttctaagttgagttacctttataagtctcatttgttaaaggaattggctttaacacttcaagggatgcaagtaatctcacacaaaaattctgagtagtatggagtccatacgaaaaggatagcacaagtaattgaagcacaataataaaaaacaacaaaatgttttcaactttcaaaggcagttaaatctggaagaacagagaaataaaccgaacttttcaagtctctttcattaattccagttatgtcctttggggtacagatttttataagcaaacaaaacaaatttttaaaaccctttttccttgatctagtgttatatgaaaaaaggcagtaagatgagacaattcctaaaaaaacctataagacacactgagaaaatttcactttattcataagaaagccttttcttctttcccctactctaggtttattctggatttaaaatcactatgtagctatggatattaatctatgataaagctcactgttctgaactgtccatagggggtaaactgctacacaggtacaccagagagggaacacacagttctgttatggacatgccagataaagcaggcactctccaaagtgcaagtcagcaaacacctgagacataacagaaaaatgagaatacgcttaaaatttcaccaacagtgtactgaaaaattcagttaacataactgtcatatccaccaaatgagaaatcattttaaagcattatccactacttccccatgtatattattcactgtgttgttttctgttaaaatataggtaacttgtatcaaattatcctactaaattttcagaaagaagacaaaagaaggatataagaattggatactttgtcagtggcacagaaaattagagtagcattctaagtaccacagatgcctgggtcataaaggctttcagtctcctgaaacgaaaacaggaaagaaaacacacaaggaaagatgtataccacaggacttgtaactaaatgcaataattcatcttaattaaaaaataatacccatgtaaggatgaactggaaagccctcattgactttcaactccatgcctgtcaaaacattcaattccagggatgcctgggtggctcagcggtttagagcctgccttcagcccagggtgtgatcctggagtcctgggatcgagttccacatcggtctccctgcatggagtctgcttctccctctgcctgtgtctctgtctctgtctctctctctgcctgtgtctctgcctctctctctcggtctctcatgaataaataattaaataaaaaatctttaaaaaaacaaaacaagtccaggaacatggaagtttcaagagaagttaactatttgtagacaagacatacatacaaaaaagaaatacgcatgcaggacagactatacatctgtatgaaactgcacactacatttagccatctactttcccccagttaatgtccttcctccacactggggaagggatagggaagatgatgaataatactcccacacatgcccatacattcttttctccttaaaaaaaaaaatctatgaaaagatgtacaaatggtcaataagtacatgaaaagatgctcaacatcattagtttttagagaaatgcaaataaaaatcacaatgatatatgtaaggggaaaaagtttcccctttttcccttccaggttatttgttggtctaacaattcaattacgtaagacagattaacagggagacccccgcctccaatattttgcactatggaaatcccaaagataggaagcttgcagatactcaagcaactgaggcttataaaccattcttagctaaggaggtaggggtctgggacttcaaaggggaggaagacaattcacaggaagatgggaggcgcaaatgtttggtaaacaaatgtttgtctgggccatgcagataaatcttttttatataaaaagttatctctgagggatgccttggtggctcagcagttgagcatctgcctttggctcagggtgtgatcccagtcccaggatcgagtcccacatcaggctccctgtgaggagcctgcttctccctctgcctatgtctctgcctctctctgtgtgtctctcatgaataaataaataaaatcttaaaaaaaaatgtatctctgatattagctctcatcctgttacagtccctccaactaaattattttaggcagttacaggagaggtaaaaacaaaataaaacaaaaaccacacaacaacaaataaataaatctcttcctgagtctgttagacctcaactgccatcagctcaaaataatccacatgccagtggcatattttggagtcatatattctgctcccctttggataccttcacacctattacaatggctattatcaaaaaatggaagataacaaatgttggggaggcttaaagaaactggaaccctcatgtattgctggtggatatataaaacggagcaccctctggttcatcagaatgttccatacagaattaccattatgatccagctattccactcctgaatatatacccaaaagagaaagcagagacttgaacagcaatcttcatagcagcactattcacaatagccaaaaggtggaaatgatccaaatgtccataaacaaaatactgtatttatatgctattaaaatattcagccataaaaaataaaatactgacacatgctacaacattaataaaccttaaaaacattatgctaaggtgcaaagaaccagacacaaaagggcaaatatcataggactctatttatatgaggtatctagaacaggcaaattcatagagtcagaaaagtagaatagagattactaggagctggaggagtggacagttgtttaatgggtacagagtttcttttttgggaaggtgaaaaatttctggagaacaaaagtggtaataattgcacaccagcgtgaatgtacttactgtcactatattgtacattaatactgatgaaaactataagtttcatgttatatatatttaaacacaattaaaaaaagaaaaaagagggaatcctgggtgactcagtgggttaaatgtctgccttcagctcaggtcatgatctcgggagtcctgggatcaaatccccacatcaggctccctgctcaatggggagtctgcttctctctctcactctctccatttgcccctcctctcacccccgctagagcactctttctctccctctcaaataagtaacatcttcaaagagaaagaaagaaataatgaattctgagcccagagcagacagaaattaacaggtcacccagacttgacttccctctttaatcctcctacctttcccttaacagaagatgcttggtcatttgcaacatacaaaatgctgaacccaggctccagcaggaactgctgtatcaattcttcagggactcaaggcagacacttaaccaatggagccatatataataatataatataatataatataatataatataatataatataatataatataatataatataactacaaactacttcctccttcattctatctcttaaatacatataatgctttgctacactcgctcttctccaagtagttactgaagacaacaaagttaaaagtaatttgtaattacttctgtcactgactacttggatgaattactgtcctcaaatattatattagtattaaaacaaaaaaaaatctatcagatcatccaaatgccagaggctgaaagacagtactatattaatcaactttctccaagagggccctggaatcacaggaaaaatctgtaaagctctaaaggagctgaaaaattgaactagaagacagctgagatagggggagggggcaaagagacgcaaagtgccttctacacaccagctctaagaacagctcctcccaagggagcctggggtcaggatcacaaaagcaggaatgggccagagaaattcattaagcagagaaccatgtccagggaagagaggagaagctgtgtctggattgttcctggcataactgcacaaggtggctcctattctttacagaggatgtaagcatattccttattcttggggttcagacataacaccacgatatattgtggtatttgttttctttccttaattcctgaggggccttgatatcctggtctttaattgctgaaaagtcatctttggggatctcagggaagttcctacgatttcttttccttcagtgtctgtcctctacctctaaaatactagacaaactgtatacatcttggttttatccttcacatctctttttttttttttttccttcacatctcttaagcaggtttctaaacatggaataaacatgagaatcacctgggaagctttaataagccactgatgcctgcactctactcccagagaatctgtatttaattggtctgtgttgaggccagggcaatcggtgttttttgtttgtttaaggtttattttagagaaagagagagtgtgaggaggggcagaaggagagggagagagaacctcaagcagattccatgttcagcagtggagcctaacacagggcttgatctaaggaccctgagatcatgacctgagctgaaatcaagagtcagacacttaacttactgacttgagctgaaaccaagagtcagatgctcaactctctgtggcacctgggtgccccaagggcattagtgtttttatttttattttattattttttaagattttatttttttattcatgagagacacagagaagcagagacatagacagaggaagaagcaggctccctgtggggagcctgatgtgggactcgatcctgagccacatcaggatcactccctgagccaaaggcagatgctcaaccactgagccaccccggtgcctcatacattagtgtttttaaaaagtatctcagatcattccagtaagctgattggttatcagatatgtccattatttcatctactctgttcaaaggatcttttatttttaaaaaaagattttctttatttattcatgagagacacagagagagaggcagagacataggcagagggagaagcaggctccctacagggagcccgacgcagtacttgatcccagggccctgtgatcacacccctagctgaaggcagatgcttaaccactgagccacccaggcatccctcaaaggatcttataaagcattgttttttatttttgtacactcttattatctgattacacatttttcttatatgtctttattttgtggataaaattatttctcaagtatttagggattctacttagatgagacatctatgaataagtatttggctgaaatttttttttcattttttggcagggaattgctggttatgtgtatcccctagtatctcccatgggcactgggcagtggtaaaggttgaaaggttaagaaacggaaatgaagaaagacagcatactgtgaattacaagttaagtagaaagggcattcataaagatgtgaaagtgacaggtgagccagttgatacttgtattaggtttacaaaaggaaaaggtgaaatgctttaagtaaaagggaaataaagaggaaaggaccagaaagacttaaatacataggtgaaagaatcaagtgtggatttgttcatcaattaaacatttatagatcatttaagctactgctaagttaatcacagggctaaataaaagtatgctgaagtttttcctcaatagaatggtcatgggagtgtttaaataaaatctggcaaattcatgctacaaaaatataatgcagtctttgaaaaggatgagataaatctagacagtagagaatcatttagagtctaaacaccagaaacatccaaacagctgaattaagattttgtaaatgctcatccactgaaaaagaataccattgtaataaatgaagtgtattgttatggtacccagtgcccagtgatgacttggtcctctgggctgtttaaaaaaaaaaagtcagttgatgatatcacagagggataatacacgtgacaatgtgttatattgtaattacacgcagcaatcaatcatggttcccagctgtttgtagattttggtgtgtgcaatcattttacagcactagattacaaattacatgaatattacatgcttgatttttttatcattgttttttcttagagttaagatagctaaactctggaaatattaatatagaacaggtaaggtcttagccattccagataaaataaccttctaataatgacattaaaagatgaaagatgcccaagatctattaagcaaatggtgagttgaaacaatttataatatcttatttttagaaggaaaatagtatatatatatgtttgtgtatattgcttatatacaaaaggtttggaaagatacctactattaaaacagccaataaagctacctctggagaatgagatctgggaggataggaatagataggaaggaatttccacttaaattttattttagatcatttaaatagttgaacagtaagcatatatcactttcatgatcatttttaaacttaggacaaaaagatgaagcacttcatgtttccattcatcaggactttttattgttactgctcaattgaattcaaaaattttggagtgtcttcaatgcagaggaagaaaaatctagttgagcaaagagtgtaagacatctagaggacagtcagagagacaaagcctgaactcagagaaaagtgtggatgtttgttgggaagttatcacactctatgtggaaattaagataaaagtatacagcaattactactaagtaaataaaaccatgttctcaaacttctaatgtccaagcctcacttctgattactagaacccttaccaatacagttgaacagtttagaaagtgcaaaccatccctgaagaagccagcaatattccaaatgattaattaaaaagctctctcagtacttcaaaagcactagttctctcattcctttaataccgtaccattgttcaaataaaattacttactgctctttcacctcctcgcgtaagcatctgaatccttctctggtactttgactttatgcattgcctcttggctgtcactagctgtagcctgctccattccaagtcatgacatcccttagctgaaaggtacatctgatagatatcactggttagagttgtggtagagactgccagtagttctcaagtctctttttctccacttcttccttcttaataaaacccctattttttttttaacaggatacaaagcttcccagaaaaaagcctcagtgtcctaccttgcagctaagtacaaccatgtaattaaattcagtctactaggagataaggtaaatatatcttgaaaggaacaggtagccagaacgtcataagcacacatctgagttaaaagctgaaagaagccattcaacaaatagctactgaatacctactacctgccactcttctaggcaatggaggtacagcagtaaacaacagaaaaagatttctgtctcctcacaaattatgttctagtaagggtagacaggagtaagcctctattacttcatgttttgttcatatttcgaacatgtttcctcatgtctttgacagaaaaatctaatttctacctgtgccacagggcagattatcaacttgggttgactcataggatcaaacagtttgcttccaagtctgctgatcatttctgagaacaagccaatgaggtaacatgacaaagatctataaaccctgtataagcggacgtgtcctactcatttttgtacccctatcacctagtgcaagtgaatggcataaaagaggcactcaacaaacattaaaatgaattgtgattttcaaaagcagccaaaataaaaatggtaagatactggacactagagtaaggaatcagtgctgaaatgacattaccagttgactatattctttccccaaatctactctgaaaaatctagagaattatactccacttcagtgttagctataaaaaaagtaaaaatattctgttctaatcaggaggggtaactactaaaaccctgacaaaattagcatatctctgaagtgcactgtaagtatatggctgtgcatacatacacatagcagattcatcttattaattatatcagtttggcttaaacatgggcagccaagaatagaagactacacctagctgtcaatctctgagtaagcattaaattgcaactggaggaagaaaaggtttagagagctggaatgcagacagaaaaaactaggataaaaattctatatcatattgtatcctcatataatattgtcttattaaagcactgtaatataaattaagcagattcaagatatggtttgcttacttgctttatctatttatttatttttaaagattttacttatttattcatgagggacacacacagagagaggcagagacataggcagaggaagaagcaggctccatgcgggagactgacgtgggacttgataaggctccatgcagggagcccgatgtgggactcgatcctgggactccaggatcacaccctgggccgaaggcaggcactaaaccgctgagccacccaggcatcccaagacatggctttaaatatattcttttcaaggtccattattatgttcaagagaaagactatgagaaatagcattttgtgtctgtgaacaaaaccttacgtagaaagaacaaaaaccttggctaccttaaatccccaccataaaagtgtggaaggagaatagcacttgaggacagagaagggaaagagtggtactctcagctttgaggtctagaggactctgtttgagccctgggttatgagaacaagtggatctttcttcccaaaaaaaattagaaaaaaaaagttccttctactgtgttaggtaacatattaacaaattccagagatcagaatgtagacatgtctgaggggccataattctacctaccatagatgcctggtcatccaatcaaaatcctaagaatttctcccaaacctagaattctattgacttcctcccattttatctttagggttcttgtaacattctttcccatcatccagttgaacaatgttctaatctgagagtaaaattaaatttaacattttatatgtatcattctgaaaattcctttagaatttcagaaagcccaagttagaacactttttacagtttatcagttttgtcacaagttaaaactgtaagtaaatttgataatacacaatgcatattttcccaccttaaacttaatcgctgaaaaattattttaaatattgaatcctgggtggctcagtcagttaagcgtctgtctttggctcaggtcatgatcccagggtcttgggatcgagtcctgagtcaggctcctttgctccatggagagcctgcttctccctctccctttgcttgtgggctctctctctctcttaaacaaatgaatacaatctttaaaagaaaaaaaatttctaaatcatgactgcttttttgtctttttgttgtaccaattgagaggttagggttttaagattttatttatttattcatgagagatacagagagagacgcagagacacaggcagagggagaagcaggctccatgcagggagcccgatgtgggactcgatcctggatcccaggatcacaccccaagccaaaggcagatgctcaaccactgagccacctaggtgtcctgagaggttagatattgaaatccccaactataattgtggatctgtttctcctttcagttctatcagtttctgatccagatagtttgaagcttattaagtgtataaatattcaggactattaatatcactttatcacaatgaaattatcttctttattcctcgtaatattctttgttctaaaatctgttggtatgaaattaatatagttattccaactttcctgactagtattagcatggaatatccttctcaaaccttttacttttagcttatttggattcttagtatgaacagaaggtttcttgtaggcagcatatagctgagtcttgttttacccaaactactaatgagacctgccttttaactgggttgcttaggtcatttatagttaatgtgattattaatatagattggtgtaaatttaacattttgctgttttctatttgtcacctctgttctttgttcccctttttatctttttcttggatctctgaacttacagtttttataaaatatggaaaaatctggccattgtttcttcaaaaattttttctgcacctccccctctcctcaagactacaattacatgtattttagaccctccaaggttgtctcatagctttctgatactctattcattttttccctatttacttccttttattttggatgatttatattggtttggcttcaagtttactaatcttttctcttgcactagtttgctgtaaatcccatgaagtatatttttcatctcacacactgtagttttcaaatctaaatgttcaatttgggtctttaaaatatattatatacctgtagttgacattctcaatctttccagtaatatatggaatatagtcataataaatgttttaatgtctctgtccactaattctatcatctgtgtctgttttgacttattgattttcctcctcagaggctgtatttttctgcttcattccaagtctgatatttttttattggaagccaaatgtgaattttaccttggtgaatactaaatattttcgtgtaattataaatattaagctttgttctgggatgcagttaagctatttggaaatagcttgatctttctgaggtctgtttttaagctttgttagaagggatcaaagcagtctttaaggcatttgccccactgctgaggcaatacctttctgagtattctacccaatatcctatgacatattttcctctctggctattgggaacacaaactgagatacaatcagagattgttccctataatccttttgggttgttctttcttggcattgggtagcttccataaaatacatgcactatcagtacttgtctgaagacttaattaagagagactccacagacctatagagttctctctttgtgcagctctttcctttcttaactataaccaccctggcctccttggactccagctctgtctcctcaactcaaggaaactgctgggctcccctcactttacactgcagcctagaaactctctctagtaaactaggataattatagggctcatctgtttctggtttcttggtgatcattgtcttatatgctgctgcctcttgtccagtgtttgaaacttcatatattttttctggggtttttgtttgctatgtgattacagctaagggagtaaatcaatctctcttaatccatcttggccagaagcataagtacatgagtacattttcaagccagaaaaaggagacagagtaaaaaaacaagaaagcacaagtattacaaatggagtttcaggtaggagaaaaggtgtttgataaaataaacactgtttagaacaaattttgagtctgaagtttggagggataggctttccatgacattaaaaaagtcaaaggagggatgcctgggtggcgcagcagtttagagcttgccttcagcccaggatgtgatcctgaagccccaggatcaagtcccacatcaggctccctgcatggagcctgcttctccctctgcctgtgtctgtgcctctctctctctctctctctgcctctcatgaataaataaataaaatcttaaaaaaaaaaaaaaaaaagtcaaaggaggcacctcggcggctcagttggttaagtggctgccttcagctcagatcatgatctggggggtcttgggattaagccccaggtcaggttccccacttagtggggagtctgcctccctctctacccctcccctgacttgttcttgctcgtgtgctggtgctcaatcttgaataaacaaataaaatcttaggggaaaaaaaagtcaaagcccacaactgataacaaatctatctccaaaaatggcaggtactttttttttgagatggcgttcaaaattatggttttgtgtatattttttaaaagttggataattgcactctcttttttcctttaatccatataagaggtaattgttttaagccttgtaagaatgaaaaaagtagggcagcccgggtagctcggtgctttagcgccaccttcggcccagggcttgatcctggagacctgggatcgagttccacatcgggctccctgcatgaagcctgcttctccctctgcctgtgtctctgcctctgtctctgtgtctcttgtgaataaataaacaaaatcttttaaataaaaaggaatgaaaaaagtgtggctctacatttctaagggacattaataaaacacaatttttataaatctgaattaaaactatttttccccttcttttgattaattcagctgaaaactattcagtaaaaatcaccttaatacttaaaagtcataatgccacaaaagttggcttgtgattgacattaatctttagtctataaaacttgcttttgttttacaaccacaattggacacctaattataacctatcatgtatctcaatatactgaaattttattattgcctaaattggaaggaaagcccccaaaccatttagaatacacacatacactgtagcagcacttaaaaaaatcatatgaagagcagtctatcatcaagccacttggtttgattctctgtatgtctaatttaaacttctaactggccccagcaccatttgcagatatccaccctaaaaaagcatatggtatcataagaaaataacatatacagatgcaaagaaactgacagaacgcaagaagggcagagaaggctattaaagtgtgttgcttggatgactgacttcctttcccccccctcttattttctatcaaagtggcttctgtcgctcagattgcattatttggctccttgccctcatgctactcagctgccctttattccagctatcaacggcaattatacaaactagccagattcccaaaatttcatctaaaggttctgagtaaaatcctaagctgggatgtaagggagggcttttaatgaagagtgaaaaggcagaaaagaaactgaaggaagctaactggagagagaaaggaaaatcaagaagctgaatattaaacctgaactggctcattctatccataatatatccttaccttcacacactcttcctgggaatttagataacttgggtttttatctacagagctaagagttgcctcttgaattcaaaatttattctattagccaaaatttagttaaaattataaaatttaacacagtaatatatttttaaaagtttgagaaataaagaaaagagaattcaccataatcccaacattacaatgtaagggtacttctttttttttaatcgacattatttttttagagcaaaaatatgtaaaatagccaaaaccaccttgaaaagaacaaagttgagagcacttacacttcatggttctaaaacttactacaaaactacaacatagatcaatggaatagaactgagagctgagaaataaactctcaatttatgtccaactgatattcaaaatggttgccatgacaattcaatgggagaaaataagagtcttcaacaaatggtgctgcgacaactagaccctcacaagcaaaagatcacaaagtttaataccttcctcataccatatacaaaacagtttaatacattcctcacacacgtaactcaaaatggatcaatgactacaacgtaagaactaaaacaatctaccctcctagaagaaagcatagggacagtgaatcttcactgaccttagattaggtaatgatttcttctgtgaaactaaaagtacaagcaaaaacaaactgataaatgagacttcatgaaaatgaaaaacttttgtgcttcctaggacaccatgaagaaagtgaaaagacatcatacaggatgggacgaaaattttgcaaatcacatatctgataatgggattgttatctagactacattagcaacttggagtctaggagagagggtaaagaaagaaaaaaaggtggatcttgagttcacctcctatcaaggacacgccaagccaataactacttgtgataaaactcactctgaaaacgacctaaagactggcagaacacagctgaagacctaaggagaagaccacatcaagacggggaagtgagggactcctgggtggctcagtcaattaagcatctaccttctgcttaagtcatgatcccagggtcttgggattgagctcccacatgggttccctgctcagtggggagtccgttggtccctatccctctgcccttgcactctctcgcttgtgcattctctctctctcaaataaacaaacaaaatatttatttttaaaaaagattttaattacttactcatgagacataggcagagggcaagaaggctccctatggagagcctgatgcaggactcgatcccaggaacctgggatcacaactgagctgaaggcagatgctcaacaactgagccacccaggcgcctccaatttaaaaaaatcttaaaaaaaagaggaggagggcagagacacagttggtgaaccaaacccccagggctgcaacccacagcaggatagctatcacaggcatggaggagccaacaaccccctggcacaactactgctctgtcatacctggtgggcagccctagttgagaggtactcctccaagcatacctccagattctctccctgaagagcaagagacctggccccacccagtagcatgcccatactacagtggggtctctcagctagccatgggaataaagggaagggggcaagccctgaccaccagtgtacccacaagtagaagtcagtcactccagacagcagggctgagggctggccccatccactagcacatcccccaaagctacagctgggccattcggcagccatgcacacagcagactgcccaccagtgtcccaccctccccagagggtgcagcccatcattgtgaacagccaggctgaaggtcagcatgcccacagcaatcacagcctagccacaacaggagagcacatgcagccaatacaggggacacccttggaacacctggttatggtgatcagaggggatcacactatagataccacagaatatcttctatataagaccattactttcagaccaggagatgtagctgacctacctgatagagaaacacagattcaaacaaaatgcagggacagaggaatgtgttcaaaatgaaagaacaagaaaataaataaataaataaataaataaacaaatgaaagaaagaaagaaagaaagaaagaaagaaagaaagaaagaaagaaagaacagacaaaaccaaaattaaatgacagagagataagcaatctgttgatagagagctcaaagtaatggtcataaagagactcaccagccttaagggaagagtgaatgaagtcagcagaaacttcaacaacaaaatagaaatataaaagagaactagtcagagttgaaggatacaacagctaaaacgaaaaatacactagagggaatcaatagattacaagatgcagaagaatggatcatagatctggaagataggaaagtggaaaccaatcaagctgaacagtgaaaaggaaaaagatttttttttttaaggaaaaagaattcttaaaaaatgagaacagtttaagggaactctgtgacaacatcaagcaaattagctttcacattatagaagtccaagaaagagtagacaaagagaaaggggtagaaaatgtactcaaagacacactagctaagaacttccctaacctgggaaaagacacagacatccaagtctaggaatgaaagacagccccagataagataaatccaaagagatccacaccacggcacataataattaaaacagcaaaagttaaagaaaatcttaaaagcaggaagagaaaagcaaacagttacatacaagggaaactccataaggctgtcagctgatttcttagcacaaaatttgtaggctagaagagggacatgatacattcaaagtgctgaaaggaaaaaaacctaaaaccaaaaatattctgcctggcaaggttatcattcagaattgaaggagaaatagagtttcctagacaacaaaaattaaaggtgttcatcactactaaagcaaccttacaaatgttaaagggaattctttaaaagaaaattatgaaaggaaaaatttcactggtaaaagcaaacatatgttaaaagataggagatctaggtggggaatgggtgatgggcattaaggagggcacatgatctctctatgtctctcatgaataaataaataaaatcttaaaagaaaaaaaaaaaaaagcatccctgggtggttcagtggttaggcgcctgcctttggcccagggcatgatcctggagtcccaggatggagtcccacatcgggcttcctgcatggagcctgcttctccctctgcttgtgtctctgcctctctctgttgtgagtaaataaataaataaataaataaacaaataaataaaatctttaaaaaaaaaaaaggagggcacatgatgtaatgagcactgggtgttatatgcaactgatgaatcactgaactctacccctgcttgtgctctctctgtcaaatgaatgaataaaatcttaaaaaaataataaaataaaaaataaagacttctaaacaggagacaaagaaggggattacataatgataaaggggccaatccaaccagaggatataacaattgtaaatatctatgtaccacacatagtgcacataaatatatgaaataaataataacagatacaaacggagaaattgacaggaatacaacaatagaagactttaacaccccacttatatcaatggatagacagatcatccagaccaaaaaaaaaaaaaaaaaatcaataagtaaacaatggctttgaataacatatcagaccagatggacttaacagatatatacagaacattccatccaaaaacagcagaatacacattcttttcaagtacacatggaacattcccagaatagatcacatgttaggccacaaaacaagtctcaataaatttaagaagattaaaatcaaataagcatcttttccaaccacaacagtatgaaactagaaatcaattacatgaagaaaactggaaataaacacaaacatgtggagactaaaaaacatgctataaacaaacaatggatcaaatgaaatcaaggaggaaaaattaaaaatacctggagacaaatgaaaacagatatacaatggttcaatatctttgggatgcagcaaaagcagttcttagagggaagtttatttgatacaggcctacctcaagaaacaagaacaatctcaaataaacaatctaaccttacagcaaaatgaatgagaaaaagaacaaagtagaagaaagaaaacataaagatcagagtggaaataaatgaaatatagactaaaaaaccagaaaagatcaacaaaaactaagctggttcactgaaaagataaacaaaattgacaaaactttagtcagattctttaagaaaaagagaatccaaatgaataaaatcagaaatggaagagaagttacaaatgggaccacaaaagtacaaaggattttaagacactacaaaatgaaaaattatatgccaacaaattgaacctagaagaaataaattcctagaaacatatagttgtccgagattgagtcaagaagaaatagaaaatctgaatagaccagtattaggaataatattcaatcagtgatcaaaaaactccccacaaacaaaagtccaggacagaacagatggcttcacaagttaactttataacatatataggttacagtatctatccttctcaaactattccaaaaaaaaaaaaaaatagaagaggaaagaatgcttttagatttattctacaaagccaaaattaccctgataccaaaccagacaaagacactacatactgcaaaaaaaaaaaaaaaaaaaattacagactaatgtccctgatgaacataaatataaaaatcctccacaaaagattagcacattgaactcaaaaacatattaaaaggatcattcaccactattaagtgggatttaatacagcaatgcaggatggttaaatatctgcaaattaaccaatgtggtacaccacattaacaaaatgaagaataacaatcaaaataataaaataataaataaaataataaaataataaatattttaaataaatttttttaatgggcaaagtattcaaatagacattgctccaaagagatatacaaatagcaatgtcatcttaatagggcagcccagggctcagtggtttagcgctgccttcagcccagggcgtgatcctggagacccgagatcgggtcccgcattgggctccctgcgtggagcctgcttctccctctgcctgtgtctgtgcctctctccatgtctctcatgaacaaataaataaaatcttaaaaaaaatcatcttaatagatgcagaaaaagcattcgacaaaattcaacatccattcatgatagaaactctcaacaatgtgggtacagaagaaatatacctcaacataataaaaatgacaaattcacagctaacatcacactcaatagtgaaaagctgaaagcttttcctctagagtcaggaccaagacagggatgcccactctcaccactggaagtcctagccacagtaatcagacaagaaaaagaaataaaaagcatccaaattggtaagaaagaggttaaactgtcactatttgcagatgacatgatactacatatagaaaaccctagagaatccaacaaaaaatctacaaaatcaacatacggaaatctgttgcatttctatatactaatgactatcagaaaaagaaattaagaaaataattgcatcaaaatcaatagtataccttggaatatattttttaaagattttatttatttattcatgagaaacacagagaggaaagagaggcagagacacaggcagagggagaagcaggctccatgcagggagcctgacgtgggacttgatcccgggtttccaggatcacgccctgggctgaaggcagcactaaaccactgagccacccgggctgcccaacctcggaataattttaaccggaatattagctataagaggtgagagatatgtactctgaaaactataagacatgaaagaaattaaagatgacacaaataaataaataaaaagatataccatgctcatggattggtagaattaatattgataaaatatccagaggcacctgggtgaggttcagttgattaagtgtccgactcctgattttggctcaggtcatgatctcagggtcctaagttcaagccctgcatcaggctctatgctcagtgcagagtctccttgtccctctccctctccctgcttgctctcagtctctctctcaaataaataaaatcataaataaaataaaatgcccatactacccaaagcaatccagattcaatataatacctatcaaaataccaacagcattttccacaaaactagaacaatcctaaaatgtttatggaagcaccagagaccccaaataaccaaagcaatcttgagaaagaggaacaaagctggaggtatcacaatcttagatttcaaattatactatgaagccatagtaatcaataaactatggtgctggcacaaaaacaaacacatagatccatagaacagtatagcaagcccagaaataaacccaaggttataatggtgaaattaatctatgacaaaagaggcaaaaatacacaatgcagaaaagacagtgtctttaataaatggtgttgagaaagctggatagctacatgcaaaaaaataaaaccagaccacttttttacacgacatagaaaaataaactcaaaatgtattaaagacctcaatataagacctaaaaccataaaacttcttaaggagacataggcagtaaactcttggacatcagcctcagcaatattcttcgtttatgcctacccaggaaagaaaagcaaaggcaaagacaactaaaacatcaaactaaaaagcttttgcatggtgtaggaaaccaccaacaaaacaaacaaggcaacctgctgaatgggtgaagatatctgcagataatctatctaataaggggttaatatgcaaagtatataaagaactcatacaactcaacatcaaaaaaccaatctgattaaaaactggacagagaatctagaaatatatatttttccaaagacgacatataggttgccaataagtacatgaaaagagctcagcatcacttatcagggaagtcaaatcaaaaccacagagacatcacctaacatctgtcagaatggctattatcaaaaaaataagaataacaagagctggcgaatatatggagaaaatggaacctctctgtattagttgttgagaatgtaaattagtctagtcactacagaaaacagtatggaggttcctcaaaaaactgaaagtcagaaataccatatgacccagtagttctatttctgggtatttattcaaagaaaatgaaaacactaattcaaaaacatacaagcacccctatgtttattgcagcattatttacaacgggtaagatatggaagcaacctgaatgtctattgatagttgaaggactaaagaaaatgtggtgtatatatacagtggaatattagctataaaaaaagtgaaatcatacattcacaatatgtacggaattagagtgttatgctaaattagtcagaaaaagacaattaccacgttttcacatttatagaatctaaaaaacaaaacaaatggaaacagattcacaaatacaggaagaaaaaaaaaacctgatggctaaaagaagggaaggggctggaaagaggtgaaataaatgaaggggattaagaagggcagacttccagttagtaaatcagtcacagggatgaaatgtacagcataggaaatacagtcaataatactgcagtaactttatatagtagtagataactacacttatgctgagcatttcataatatagttgtcaaaccactggattgcacagctgaaactaatattatgtcaattatacttcaataaaaaaaatctacaacttagtaataaagaaaacaaccctattaaaaaatggacaggggcacctggctggctctcaagagagtgtgccactcttgatctcaagattttgagttcaagccccacattgggcatagggaaacttaaaaacaaaatcttgggacacctaggtggctcagcagttgagcatctgcctttggctcagggcgtgatccctgagggctgggatcaagtcccacattgggctttttgcatggagcctgcttctccctctgcctgcgtctctgcctctctctctgtgtctctcatgaataaataaataaaatctttaaaaaagaaatcttaagggaagcctgggtggctcagtcagttaagtgtccaactcttgatttccgcgcaggtcatgatcccaggattgtgggatcgagccctgcatcaggccccatgctcagcagggagtctgcttgagattctctctccctctgctcccccacccccacccaactcatactctgtctaaaataaaataataaatattttaaataaatattttttaaatgggcaaagtattcaaatagacattgctccaaagagatatacaaatagcaaatgatcacatgaaaagatgctgaatagcactagtcagtagggaaatgtaaatgaaagccacagtcagatatcactccatacccaccagtatggctattaggaaaaggacagatgataacaagtactgacaaagatgtgggaaacgtagaaccctcatgcattgttagtgggagggtaaaatactgcagctgctttagaaaacagtgtggcagttcctctaaaagttaaagttatcatttgatcaacaattccaagaaaaatgaaaacatatgtccacacaaaaatttgtacatagatgtatgtaacaatattcataatagctaaagagtagaaacaatccaaatgtccattaactattgaatgggtaaacaaaatgtggtatattcatgccacatattattattcagtaatgaagtactgacaacacgctacatgaatgaaccttgaaaatgttatgctaaatgagacacaaaataggatgtattgtatgattccatctatatggaatgtccacaaatccatagagacagaaagtagactggtgttcttttaaggtaatggtagaagtagaagtgactgtaaatgggtatgagatttcttttagggataaataaacaaaatgctcttaaatgggataatggtataactgcacaattctgtgaatatactggaaatcactgaattatacactttaagatatgaataccatgctatgtgaattttatgtcaataaagccattgaaaaaaatactctattgaacagatgaacattaattattaacatacattgcttccaatgtatctattctacctaacactgctgtgaacatttttgtgcctaggctttgatcatatataattaagagtatggattcttggggtacatggggggctcacttggtggagtgtgcaactcttgatctcagggttgtgggttcaagccccatgggtgtagagattacttaaagttaaaatcttaaaaagaaaaaggaaaaaaagagtacggattctttaaggatttatttgagagaccgggagagcaagcaagcacacatacacatgcattgagaggggcagagggacaggaagagaatctcaagtagactcccagctgagtgtggagccccaaggcagagctggatatcataaccctgagatcatgacctgtgccaaaatcaagagtcagacacgtaaccaactgagccacccaggaaccccaaagagtatgaattcttaaacactgcttcagtgagaatcttggcttgagcagtgatatgagcgacgcctgggcaagtcactcaactacttcatgcctcaatttctccctctatcacgtgaagtaacagtagtcacaccccttggattctaaggatcaaataaagtaagggctttgcatggtgcctgtcacatagtaaactttcaacattagtagttataattgtcattctggtttgtattattttctttttagatttttctttctttttttaagattgattgattgatttatgagagacagagagagagagagaaagagagagagcggcagagacataggaagagggagaagcaggttccatgcagggagcctgacatgggactctatcccaggtctccaggaccacaccctgggctgaaggtggcgctaaaccactgagccaccgggctgcccagatttttcttttttttctttttttttttctttttttagatttttcttttttaattgggatataacttacaaaaaatatgaaatgatacacgaatttgcatgtcatccttgcacaagggctgtactgatctttcctgtatcgttccaattctagtacatgtactgccaaagcacacgctctgttattttcttaagatgatttccggaagtggtgtcactaggtcaaaacccatgaacatttatgtgtctgaatacgttttgccaaaccacatttcaaaggaggtgcactaacttttgatgccaatagtaaatataggagagaaccaaggtacccatgccatcatcaacactatgttacagtagatttgttttgttaacaatgtctcactttgcttatggcccttagcatcttgaaacccaacagttttctatgaatcctacataccatgatgagtacttaactgaatgtgaaatctgtgcagaccctacactgggagccacagtggaaactaaaatgagtaaggccaaggattttgtgtgaggcaaagcaaaaaaacattttaattcaagataactgtgattaagtatgagagagttacaaagtatttataagggtagggaaaagatggcagtttataaagcagggaaaagagggcagtgttccagctggttcttgaagaatggacattaatttcaactggcaagggtgtggcaggagtaaaatcaaggctggtggaagaacacggcacattccagggctgtggcttgagtacaaagttgctagcggggagaaaggtgagacaaggagacacagggtgctgctctagaagcacaaaaaggaccatctaaaacacagccagggactacgtgagctgagggggagggtttctcacagggcaaatagcatgcagaaagacacaaagacgtgaatcatcatgacccatccaaggaaccgcatgtaatccaatttggctagagcagagagtacatgtggaaaggatgcagatgatgctaaataaataggcagaagctgactgtgaaggactttgtgtgccagaataaagcatttgaactttattccaaaggaaatagagaactgaagcattcttaaggaaagaagtgacaatcagactagcttaaaaaaaactactctggcaaccctccaacagcttcccagctcacacagaataaaacccaaagtccttattacacttaacaccctacatgctggtcagcggctctctctgaaaatattttcctatttcccctcctctcactctgtttctgccacaccagccttcttgctataccccttccaacatgcctctcaccaagacttctgcacttgctgttccctctgcctggaactctcccctggagacacacagtttgctccctcagttaagtttctgttcaaatactttcttatcagagaggccttccctgttacccaatataaaagaacaagaaacaaaagcaatcaactctatcatttttctcctccacttgccacctggcacatatatttacttgcctattgcttgtctctccttacgagaattagaatataagctccatgacagagcctctctcaataaccctgtgatatagaactgttattgccacttccagatggtgaaattaaggggcacaatattgccagtgaacaatggaaccaggcacaatgactcctgagcttgcaactctaacccatttcacatagtgtcagaggtcctgactttgatactagatcatttcctgtgaataggctccatcctgacaagttctatgacagtaaaaactctgaattcacactatgtcctaaagagatatggattcttaccactggttattagtcaagtttcaaaagccaggaaacatttttttaaatgaccaactaaaatacacaaggtatctggactttctccagcaataagctgtgtttttttgtgtaggacccagagagattaaaacaagatgaaacaattttatgaaactaaaaggaacatagcataggacaccaaaactactttttcaagaccatttttcaagcagaatattaacttctggtataaaataaactccatctttaagataatcattacaattttctgaggttatcaccaccaaaggaagaacacagtatctacctggaaaatatcaagtaaatattgtatcatatgcagatacatatcccgattctttccctactcctcagattactaatttcttcttccctgattattcattcaacctagctcccattattgagacaaccccttcccaaaatgtaatcctcaatgaacacctttttctgttaactacttcataccagaacttaccactcttaattccagctacttcctctattataactaaatctactaataacttctcttttttctcttctgcagtttttgatctctaatcacccgatcatagatacttcggggcccttttatatccctacctttttaaagaaaatcaacttttcaaaattggcctcttttctacttcattaatctgtattatctggctactttcctaggcttacaactttaatatattttttctctatcttatcaacaggacctgtcaaatgttcacggtgtttcctacttccttactttccaaattggtatctatcaccatattctgggttttcttcatttccttcctgaattaccagagttctccagctgacctatttccagcctactcactcacttccattcattctgtacatactgccagtaaagcttctctcacacacagtatactcccaattcaaggactttatttatttatttatttttaattcaaggactttaaatagttctccagcacaacagatccaaacttctcaaatctgcacactcagggccttctactgcttcagaatgtcactaataaatgtttaccttaaacattctaagacaaatccccaggaaaccaacatcttgatctcttctatctgaatcagtgcaatgtatactataggtctgaagaccaccatcttccacttgacttccatcaggcaatgagaatatattaatctatcatttcctaaacatctcaaattactacaggaaggattcattttcaaaagttgaactcctctaatcagcaaaatggaagtgtgtacagttatcagaaaataacacctcatatatccctagtgaaagtacaaagtagtaaaatattttaaaggtgaatttgctaacatctttaaaaagtttaagtgcaaaatattcttcagcccagcaatacttccaggaaattatcagtattctcacagaagaagaattatatgcagaaggatattaagcacaacataactccaacagtttaaaacaacaggacacaactcaaacttccttactggaagtaaggaacctcaagatcaagacctgatatttacataaattatgaaatgttcaccataatgagtagtttaccacctgtcagcatacaaagttactacgtcgttatggactatattacctatgctgtactttatatcccccgatttattttataactagaagttcatagtttataatccccttcacctacttcatccattctcctgccccctcctctccgataactaccagtttgttctctgtatttatgagtctgtttcggttttgtttatagatcctacctaaatgaaatcaaaggtatgtgtctttctctaacttagcatataataccctctaggtccatccatgttgcaaagggcaagatttcattcttttttatagttgagtaatattcatgtgtatcatgccttctttatccattcatctattgatagatacttaggttccttctatattttggctattataaataatgcttcaatgaacatagtggtgcatctaccatttcaaatcatatatatatattttttaaataatcagcattaaattttcacttttttatataactttttaaaaagtaatcaacattaaaatttcacttaaaaagagaaagagaaaaatgcattgttctaagaatccgcaatagtcctaactaaatgtacacacaaatgtttcagtgcctagatggctcagtcagttaagcctctgacttttgactttgactgaggtcatgatctcaggttgtgagactgagtcccacatctgactttgtgctgggcacagagcttgcctaagatgctctctctctctcccttctcctctctccctctcccaaaaaaagaaagaaaaaaaagaagcaaaaaaccagactcttttttttattattatttatttaagagagagagagagagagcacacacaagcttgtgagcttggggaggggaagaatctaaggcagactgagtcaaaatcaagagttggatgcctaactgactgagtcaccagggtgccctgagaaaccagactcttaaatacagagaactgatggttgccagagaggaggtgggtgaagggatgggtgtaaaaacatatgaaagggattaagaggtacaaaattccagttataaaataaataagtcatgaagatgaaaagtacagcaacagagaatatagtcaataatactgcaataactttgtatgtatggtgacagacagatctccacttattgtggagagcattgagtaatgcaatgaattgctgaatcaatatattgcacacctaagggacacctcacacctcctctgacacaaattttttaaataagttaaaaaataaagactcctatgcatagtactttatgaagtacctaaaataccacaatacctaaaaaaaaaatttgcatacatttaatttttaagtaattttatcaattattttcagcactacaaaaactacagaatatattaataaattataaggaaataaagttcaattcaatataagaaaataaaacttatgccatcagaacttcttaagggtaaaatgggctaccttgttacatagtgacctccccttcccaaaaactaaactaaaaccaaaactgcaagtctctgaaaatgacatccttgaagaatttgacagatgtgccagctgttttatttcttaaaaacgtatagttgaacacatataataatctgttgcatttttctctagcattacacaactttcctggcctgcaacacacatactgcatctattaacgtatttaagcatatgacagcattgttctaagaatccgcaatattcatctctaactaaatgtacacacaaatgtttcagtcttccaatgtctatggtttccagcagtttagtattacatttttttttccacaaagcctcaatacaatacatttcctgaacttttagctttcagtttcccgttcgtcaatggctacaactctagaggcaatacataaacacaccccagctatagtatttccacttttgacaacagtggatgaaattattatgaccaaacataactacagtgcatttaagtcgtacatgatggctaacatagcaataacaggaatttaataatttacaaagatggaaatataaattatactacttatataataatgaaagttacaaaaccaacagtctctttctcagtgtataagaattgcagggcttctacctaaagaatcctccaaatacaaaacaagttgcagataagacagagaaaaaaatccctctcccttcaaaaaaaaggaagcaaaaaaacccccaaaccatgggaaatagaagtgatctgataaaagctttgaggacacggaaaaaaaattttatatatacttgtggattatacaattcaacttcacagtatttgaaaatgataaagaaaaattagtatttcagtaaaaataaatctaatctagatgcctactttctttgaaggaatacagcatgataaaaagtagtctggagcatctttatgtaacccatgcctttctcattctgtaatcatgggaaagaatatagaacattattaccagttgcaaaatgatttcatgataaaatcatgcttaaagtgactaaaaagtatttgtacaccatgcaaaatttccaaatgcaggaaggacatcttgccaaagttaaacaatacacgtcaaggggaagaaaaacagtgtgagaatgatttatttggtggctaggaacaggcattatttatatatgagaaaaaattatgtactctgtaaaaaagggagtatttattgagcatctagagtgaccagaaactaagcttaggcctttatagatgttccaccacactacatctacacaggaaaatagtgtagaagaaaacaaagcttaaataagtttctcaccattatgtgtggcatatactaaaatgtaagagactggagaagatgtaaacttaagaagctactgcaataaaagtatagggtgggggatgtgaggtgaaagtacaatagctcctaactcttcatgctaatcttaccagcacatcaatctataaaatgatagacacaaaaagcctacttttcttgagaatttatgtttagagcactattaaatttataatttacaactctaaaaatgaaagaaactctattcttcttaaagtagattttggagtcttagttttggatatttaagaatagtaatgctaaaaaaaagaagagaaaaaagaatagtaatgctcatccaagaaatgtaatcataggcttctcattaagaagcttgaattacggggcagcccgggtggctcaggggtttagggtctgcctttgactcaggacgtgatcctggagtcccgggatcgagtcccacatcgggctcccggaatggagcctgcttctccctctgcctgggtctctttctctcatgaataaataaataaaatcttaaaaaaaaaaaaaaagcttgaattactatcacattttttctgacagtaaaattattttttatcttggtttttttttttttttttttaaatttttatttatttatgatagtcacagagagagaaagagagagaggcagagacacaggcagagggagaagcaggctccatgcaccgggagcccgacgtgggattcgatcccgggtctccaggatcgcgccctgggccaaaggcaggcgcccaaccgctgcgccacccagggatccctttatcttggtttttaatagcaatagtagaaaaattatcagaggtactactataattcccacccagatggttaagaaccacactaggcatgacagtaaaaaacagccctactttagctctaaaaggtgcaggcctgctcattaattagctgtggatcttgaacatgtgatttgacttcctgtggacctcaatgtcctcatctgaaggcaagatggctggacttgaggttatatcccttccttcctctcttggtctccctgactctttctactttatggctttagtgatttaggatctggactggggtctctgaggacagagaggaaaatctggaaaaaaggaataggataacatatacaatcagaatatggagagaaaaaaaaagtcaaaaactcatatttacaaaaagaaatggacaaatggttcaggatagaagatcatgagtttcattgtcaaaattagtttgaatacaagtttcagttatattgaaatcagaaaagaaagtgagaaatgccagagataggacttagaaatgttatctgtaacatacaataatgcctcacaaataacccaagaaatcctcccaagttccctcagttcactcagaaaagatctcatgtctggcttcataattctgccccaacataatcaccaactattttccgacaggttattcccctcagccactttggcttcatcatttcaaacaaatctagaatatctccccttcatcatcactcaatgctctgtctgaaatgcgttttctctcaacttatactataatttatcatgttctcaccatgtttgaagcaccattctcagtacctgacgtgtattagctcatttaattctctcaacaatcctaggaggcaagtcaagtaacttgcttattaacattacatagaagcagagctcagattcagacacggggtgtctggctccaaggatcttgtcctctcagcttgctaactagtcattcaaagctcagaccaagttctgtcaccttcctgaagttctcatctgcttagcaattattcctgcctcttgagtccttaagtaaaccttaccagtggacctaggttatttatcttttgtgtatatattttatctttgctaaatgaggctcttgcctcatttattctataataagaacctaagagaacctagtatctgaaacataaaagtgcttattaaactataacggcatttagtgtttattgaagacctatacgcaggctctaggctaagtgtctttatacgtacagtctcctttaatcctcacaactgcctctcctcaatatcaaaagtgagaaaacaaggctcagagaagctatgtatgtttttcaatatcacatagcagtagtgacagtcttaagagtctgtaccatgctcttaatctccagccaactgcagaacaccttgaagaatcagtcctagcaacatttcagttcaacctgcacttactctgcagcataaccctgaacactaatgattccataccagagttgcagctgctgccctcaaaaaaacgtgtagctcagcaggacttcaggaccaaactgtcctctcactggcagagtccccatcattgactgaaatattttaagttctactttaaatcaaaatatcagggcagccctggtggcttagcggtttggcgccgccttcagcccgggccgtgatcctggagaccctggatcaagtcccatatcaggctccctgcatggagcctacttctccctctgcctatgtctctgcctctctcatgaataaataaataaaatattaaaaaaaataaataagtgaatcaaaaaataccaggatatccttggacaccactctcttcgacaccactcttccccctccaggctccctcattccctttacactcagactcctctctctgtgcttttgtattatagagtagaagggtcccgttaatcctgacaatcattaggatatctaaatttaatttagtgatagctcagacgtaagtgtatatttgataaattctatgcccataatgaaatatgagcctcacggatcagctagaaaaaaagcagtagcaaaaagcagagaaaagaggaatatgaaagccacaccgtaaaggaaagaaaaagtaataaaagcgggaaaatggacacaaacagaaagtagaaagtaggaatccaggataaattcagtgaagacacacagaaaaataacactaaaatctaatctattttaggaattctgacttctttattccttttcctaacctctaaaggaaatagaaaaatatgaaatgactgaaaaatttactagaaacagtatataaattaggagtttttttcctgagaaaccattcattttaaaatttcagagctgcaaagaaaccttaaaatgctacctaatccaacccactcattttacaattaaaataaggctcagaaaggttgattttaaattgcccaagattgtaaagctactcaatctcaccccaacatctactcctaccagactagggctttccagaaatgtattttactcctccattttccactcttaataactattaaattagtctctgtataagcatctcagaatttacatattattcctacttcccttaaaagaaaataatcagatattctggattacataaggcaatatggaattttattcttttattcccaaagtcagtaatttcaaattaagtcctggttcttaactgggagaagacttaatttcccagaaaagcagagagaaaaagatctccataaactgaccaaaagcaagcctagttgataaactacaatccatctgtaaaggaatcatgccccagacccctggaggctggacaatagacagctataacagctataacatataacagtctttatactttagtttaagtacagtgattacctaggccttaaacatgtctttgcctacaaaaggctgactgaagccttctcaggaagggaagaaaatgcctagtttactttaggaacacagcttacttttcatatatatgaagttcattatagataagggataatctgctttaacatgttaaccagattaggactgttgtactgaaaatgaaaaggacaaaaagatgggacacctgggtcactcatcagttgagcatctgccttcaacttagggctagagggatcagtgctcctgggatcaagtcccacaaggagctcccctcgagagcccacttctccctctgcctgtggctctgcctctctctctgtgtctctcatgaataaataaaatcttttttaaaaaaagagtaaaaaattgaccgagaagagtaatgaagttattaacagctaaagaggaaaactgggaagagcttttcagctgggggtgagcggagggggtgctggtgtgcagctgctacagagatggtatttaaacttagtttgcagacataggtgaaaatttgggcctcaaatttagacagaaaatatggatttggggcctagcaagcacagcaatgattaagtctttagagaaagaagtttacagaaaaacatttaaaacaacagcattcctcagataacactttgaaaataacctaaccttccatatgaataatacttatcacatagatatatttggactgctttattctaaatgaaaagctaaaaaattaattttttcctcaggctaagagaaaagggtaaggattaaaacagttccataattactatctgtccaaagtcaagtctctgaactaaaacacattgtttctgaagactccctatttgtaacaaaacttttagaaaaaaacagagaaaaatctgatgcaccaatactactacaattttacaatagtggtgagaacttaatagttttataagtacattaaccaaaatgcccatattagtaaatctgaagaacaggtagtacggaagttcataatactattctacctagttctatgtagttgaaaacttccaaaataaaaaatctttaaaaagtctacctagataatttttttaattacttttaattaaaaaaaatttttttaagattttatttatttattcgtgagagacacagaaagagagagagaggcagagacagaggcagagggagaagcaggcttcatgcagggagcccgatgtgggactcgatcccgggtctccaggatcacgccctaggcggaaagctgacgctaaactgttgagtcacccaggcatcccctaaaaaaatttttttgagatacagagtgtgagcagtaattggggacgggggtagggtggggggatcccaagcagacaccatcccaacaccgctgacaccgctgagccacccagggatcccctattttttaaattctatctgcggttgaagtttgacaactcagaattataacagataaaaatttttcaaataatgttttattcattctcaatagaccaatgaggggatccctgggtggttcagcggtttggcgcctgcctttggcccatggcacgatcctggagtcctgggatcgagtcccacatcgggctcctggcatggagcctgcttctccctcttcctgtgtctctgcccctctctctctctctctctctctctctctatatatatatatataaataataaataaataaataaataaatcttaaaaaaatagaccaatgaaacttacacctgatcttaggcgaaaggccgagaaacgatagaccaatgaaatttaatgtgtatgaaagggggaaaagatcctgtgtcactttaaagaaacataaatagtttattaaatggaaaaaatccttttatccatgttgtttgacattggacatttgttatgtttctcttcaacgaacctgtaatttttgttgaagaaaatacagtccatacaaatatatggctttggttagtaaagacaaaataaacatttattcccagtatccatgattaatttgctgaatgtagttagctgtcatgttatttcaaacatcttccactctagtaaataatcaaataaacaactttttaatgtagatgcaaaaaaggggggaaaagattttttaaaagaaccaatatccataaattatatctaaccctaacttgtaaaaaaaatgcacatatttaaaattatataaataaggagaggggaaaagttaaaggtttttaacaatgatcatagtttaagccaggacttaagtggatgtaatttaaatcaaatcactctactgagactataatagtgcaaccaatagagaacaaattgactgcttagatttaccacttactgatagtcatatatggtttacaagcacctatctttcctctctatgataaacagcaccacccaaaaatgacaactagatttgtttgcctcctcttcatctgtaaattccaaaacaataaaaactacacatctgtgcaaaactagcacactgtaagtgtgtaacttttctaacaggaataagaaccttcaattcccagaaagctattgctagcaattagtctcattctctaggtgatgtgcataagataacaaaatctagcagggtttccttggtggcagctctgccttcaatcattttcagaattttatgtcttctaacagaaatatgtcatcaggaaacttcagagcagcagcataaatacatatacttagagacaaaagagactgttggtgattctctttttctctatcattatgaaagcactgctgaagtctgaattgaggtatttcatattttgcagatgacaagatcattctcctcttcaacaaattgttgtagctttttccttgttaaagtaaaaattacataccataaaatgcccagatcttaagtagtcagctcaataagtctgaacaagcgcatacaccaactggtgaatctggatgtttcttgtactaggtcttgcaacttttctgtaagttaaaaattatacaaaaataaaaggttacccaagaagtgtacacttgaattgccactatccaagtcaagctacagaatatttctatctccccagaaaattcccttctgcccctttccacaacccttacccagaaaccactgtcctgatttctatcaccttacctaaagttttgcctgttttatatttttcataaacagcatcatttggtacatatttctctctggcttctcttgctctgaataatatttctgagattcatttctgttgtgtgaatcaattgttcactcctgttgtgaaaagttgctatgaacattttgcatcacttttttttttgcatcaatcttattgtgatcatgtactttattccccttaacacagtaacctttcatttaatggaggggttccccacatataaacaaccctgtatagtcatacagtatagacagatgtacatctagagtaaaaacatatataaattacaaaaatcatagatattttatctacgtgtgtgtgtgcgtgtgtgtaaatgaacagactctgagaaacccacccagaaccaacaaagatgttttaaaaacttataaagttcatagcgaaaataaatctaagatggaaaagctgttcaattctgcttaataaggatgttttaacctaagaataattccaaagagaaacagattttctctccacataagttactctgttctgcttcaatgaaataccttcttctcataacaaatcctcccacccccgccacaactagaacttcaaaacattaaatgttacctccactacacaataatcttttatgcgaggggtaaagcccaaaatatgtgttaaaattacaagttttattgtcttgctttttcaaaaagttaaacagggaaataatccatcagctaatacttaatatgggtaaagatcattcatcttcattgagaatatattctgaaaaggactcaacctctgggatgttttctccatcccaaaaagtaatttactgcagcattaaatctatgacagagacatcctgactttgaaatcccactgtgtaattttcagctgaaagtaggagagtttctctaatttccacagttagtaacactaagaaacatacacacaaatctgatttttgaagagatcctttgaaattcccaaccctgcttttgataatcagatgatcgtttttcaagggactagaagcggctcctcatttgacatcatctataaatttccaagatggaggcagaatgctacaaatggttctagatatttaccattgctttaggaagggtttgcaactataaaaggaggaaacaatcctcctctagtctttgatctttgttcatcttttattcctccttccccaaaataagcaacttcaaaaatacacagttctaatgtattacttttttaatcttacaaaacattcttagcatttggatattccctaacttctgcagatgtataattatttacttaacccattactcacttcgaaaatacatcattttcacttttctaataattgtatcattttctaaaacaaggaaaacagcctcgattaactgttacaaaaatgacagcagctctaaatagctacagaccccatctttcattatctttttcctgattgttttagagaattacaatttttttatttttaaagtgtttttcttccagaccaagagtaaaaaacagatagaacaaattcgtagaccccatactccctctggtggtccttcactctcatgaactagacaaattccgaaagactagaagtaaatactaaattatgcataaaatgaacttgctccaaaaaaaaaaaaaaaaagaaaaagaaaagaaaagaaagaaaagaaaagaaaagaaagaaaaagaaaaaaatgaacttgctccatttaagtattacaatcttacatgtttaagtttcagctgagtacaggccaattctttttgtaacaaagtgtgagatacaaattatttcgagtacttgaattttagtgtttcaaatattgctaaaatattcttaataacctgttatacagattagctacaagggtgcataaggccctactctaaataattctaagctgtctctcttgacagaagagtcttttacctggtaagtatcttttttgcaaattaaatcacacttaagtggctattatttttaaatcaatagttattttcataccaacaaccactcagtctcctatgtatatagatttaattttctttacactttggggatatattatcaaaagttaaaaatgcacacagaccctttctacctccttggccatcctggtgagtgctcttggctggggcctatcccacacctaaggcaagatgacggtggctacatagaagaaaaagtcactggagacaagtataggctccaactcaatataagtggacagacagtacacgatggggtacaaggagacaagatgatcagacgtgaccaagcaaaactggtcatcctagccaacaactgcctagctttgaggaaatctgaaacagagtactacatcatcctgttggccaaaactggtatctatcactaaggtggcaataacattgaattgggcatagcttgcggaaaataccacagagaatgcacaccagttaccaccgatccagacgattctaatatcattaggagcatgccaaaaaagactggtaaaaagaaaataacgtaaaatttttctttaataaaactggccagagattgtttgaaaaaaatgcactgtagaaaattcagaaatacacaataaaatgaaatctaattattaatcagctaggttaaaattagcgcaaatagtttcaggatgcctggctgactctatccatggagcatgcaactcctcatctccaggttgtgagtccgagcctcacactgggtgtacacgttacttaaaaaaaaaatcttaaaaaacttacaaatagtctcagaattttaaaaatgtccatatttagtggttcagtatcaaataattacaggatttggtgcgccaaatatgtacagtacggattttttttctttaggaactgtgaaaaattattgcaaaggcctatacagatatattcttaggtataacatgcataatacttcaaagctacattcatgactaacagtgtcacctgatttatcctcaaattagttattttaatatacgtccttgtttttttgtggctttattccttcaaaaatatttcctcacccccaaactcaaaaggaaccacacctgaggataaatgacttaaacacactcacaatgtttactgtgtagatgtgagaattcaacttatacttaattttgaaactgaaatgtggttgataattttatgatatggtctaccacaagttaaagtggacaaaaaaccctagtaaaatatccaaaaactgaatttgaaaatgagtttttaattaaaaggcatttttataaagttcctaaaagctgcttttgtgtaaacaaaactatgaaatactagtttaatttatcatatgtggtatatttaagcatcaccataggataaagatcataataatcatacacagcaaattacatacagtagctaaaaatatattcctatacactttaaagaacaattatctaaatcatccaaaagaatgaggaccctcagacttctaagattccttacaactatttgtacagaataaaacccactctacaggacaagtcactgtgcaaccaatctaccctaacgatcaaaaagacaactaagctttaacagcaataactacttctacagctacagaaagaggatgttctttctcctctagactgattctaagctaagaaacatttaggaaatttctccaaaatatgtgttctttcccaatccaagaaaaaacagaaaattgaagatttaattagctgcctactccagtattttaagtttttcatgttgaactggttaaaattatgttttaaaaaagaagttcaggggcgcctgggtggctcaatggttgagtctgccttcggctcaggtcgtgattccgggatctgggatccagtcccacatcaggctcctgggaggagcctgcttctccctctgcctatgtctctgcttctctctctgtgtgtctctcatgaataaataaataaataattctttaaaataaataaataaataaataaaataaaataaaaaagaagttcacctaaaattaccataagtaagaacattaaagattcagaaaaaaatatttgttttgttaaatgctgggaagacaaagacctcataccatttaagcctgttgtttgaagacagaaaacattttataaagaccatctttgatttattttttttaaatcccagtcacagctagcctattggttaaagagttcagctttaaatggtgttactaattacctaggtaaatagtaaaattaccattcaatgaaatactaatgaagtagcataattaactcaaaattataactttgttcttaagacattacacttctgttaaatataaatcatccccaatagttacaaaagacacattagaaaaaaaaaattacgctaaatcaaagtgtcactcacaaatgaatttaaatacgtataaagtgtataaagtataaaaaattgctgtatttttaatgtatttcctataccctatattggtcgataccctatattggtcagggccatagctgtagattcagtggaggtcagttgggagggagatgaagagaaaatggtaagtgaaagtatgacaaagatttcccaaaaagaacaaaaaaatttttcaagtttatccttgaattttgattcaaataccaagagaaaaagctactatcatcgtctaaagtaaaaacggtgggggggggggggaggtagtggggggaggtgtgggcagaattccatagaccattaaaaatactgaaccgaaacatgtgcctcaacttttctcttgtccacagtttaacaaaatggggaaacaatgaaaataaacacatctgtctacccttagcgaggcaaagaaagctgccattcaatgctaagccttatcccactggaaaacgtactcctgaaaagtaaatccaaaaccacgagctccaactactgcaggcagaatttactgagcggcggccaaacgtcgtgcacgctgtcctcagccacaccggaggagaccgagagctctgcattctccacttactaacttggtaccttcctatgctttcgccaccactgcaaaagccaatgttttcggcaaagctacgatgttcctctaaggctcgtccgtggagagaaggcaaccgacacgcggaccccctcaagctgttgtgttggtggtgcctggtggttttcttgttttgttttgtttgtgttgaatcagtactgggtgtgagtcctatcgtgtggccagcacaccttcgcaggcgtcagtggaagcagctctaacgttccaggagtgaaccgaaccacgagcgcgcttccactggctttcccctgcagcgagaatagtcacctgttaggcccgcgcggactggcaccctccgggcgcggccgagggccgtcgggaggccggatcccaggcgctcgtcccatggcggcaggtgaaggcggtgaacgcgcatccacacccgccgcccggggagcgcaaaccgaaagcgagggcgcagcggcggggcgctccgttatcctcgcccgccaggggccccgccaggtgtgcgcggctccatcgcgcccgcggcgtcccggcgcacggctcaccgcggctcgacttcgcccgccgcccgggcccagaggcgaagtttctctcccgcccgcggcggcggcggtggcggcggcggcggcggcggcggcggcggctgctcacgcgccgcccggctctcggcgggtcccgcagcctgctccgggcggtcgcggtcacaggcgccgggcctcgggcgagtcgggggccgccgacgggagccggagccgggacctgtcacctcgggcgggaaacaaaagccgggtgaggacgagcgggcgcgccgggcctcgcctccgcgagggggagcgccgagggccagggagcgccaacacggagggagccccagccccgcgggccggcgggcgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcgccccgaggctccgcagcggggccgggaacccgcgcgtaccggggcccccgaggcggcgcggcggcccgcggcccgcggcccgccaaggagggaattcggctaccggggcgcggcggccgcccaccccacccctgcggccatggggccggtacctgtcgccgtgggtgctcctcggcctcgtctcttgccgcctcggccgcgcgccgctcggcccccgcccccccgcccagcaggccgtccgcgcgctggacgccgccgcccgagactggcagcgcccgcgaaccggcccgaatcccccgggcagcgcccggcgcggtcccgcccccgccggccgcaggacccgccgtccatagggccccggggctgtcaatccgcccccaaaaggcgcgcgggctgtcgctgcgcccgtccggattggtggccgcgcgccgtccgtgcgactgaggccccgcccccgtccatttgcacctccgccttagtgtaaactccgcctctccacgccagcccacgtgtctggcccttggcctttgtggggtcggggggacggcatgcgggaaactgaccgacgccgcccctcgtcatcccttacctccggaggaacggatgcctacacaggctagttgacttcccatctgcatcgtatccctgacggctcggccctcctgtctgcttacccggcgtgaccagaggatgcagacggtaggccagtccttttgtggcaggtaagccgcctgggttagcatcaggaagtcagagatgcccagtggagcctggggaaaatcccgtcttgagaaccagtttagcacggcgcatctcccccacggcctcaagggactgtgaagaccgtgcttggccgtggctttatgcccgcctgtccggcatgatgagatggataccaggcggctgagacagcagagggccttaaaaagtgattgtgtattctgatccccctttttcgcccccgccaccaggaaagagtagacctactgagcaaaccccacttcgagagggaccaggctccttccaccagaaggctggctgcccctgagtagttccccaaagagattcagatgacggcgattgagctggccgcacctgggctttagggaataaccaactcaatcccctcacttttgaggaaacagaaacctcaagtcccatagccatggggcttaatagtcacctgtggaaacctgtctcatagccagatcagaagccacacctcttagccccaaacctgctctctgcactatgtcatgttggtcatttaggtgtttgtgaagagcctcttccacaaattgccatccctgccttcctgaggtggtgcctgaagaaaggacaaccgggaccaacgcctaaaccttctcaagggcaagggccctgacttaatgcctagaagtttccctgtttaccaggtgccacagagaatcactgaaacaatgtgttcatgcattaattcaacacgcatcagtgattaaatccaaatccagccctttgtccttcaataatgttataaaggtttccaacaccaattgattgagaatctactactaggggctctcagtccagtaagcctccaactcttggttttggctcaaagtcatgatctcagggtagtgagatccagcctggtgctgggctctgcactcagcagtgtctgcttatcactctccctctgctcctccgcctcgcgtgcgtgcacggccgggctctctctctaaaataaattcatttaaaaaaaaaaagagggatccccgggtggcgcagcggtttggcgcctgcctttggcccagggcgcgatcctggagacccgggatcgaatcccacatcgggctcccggtgcatggagcctgcttctccctctgcctgtgtctctgcctctctctctcactgtgtgcctatcataaataaataaaataaaataaaataaaagaatcttgtgacacctgggtggctcagtggttgagcgtctgcctttggctcaggttgtgatcccagggtccggggatggagtcctgcatccggccccctgcggggagcatgcttctccctctgcctgtgtctctgcctctctctctgcatcattcaaggataaataaataaaatctttttaaaaaatctaactaatagcaagtgccgtgcgcaaagtatacataggtgagaagacattgtcccagcccttgaagtctttagccaaggagatagtaacatcctcactgcatgtcagtaccgcttatgtttcagtggacagctccaaggaaggaacattcagatcttcctggaaaaggcagggaaggcttcattgaagatgggacaccagagctgacttctaaacaatagtcttaaaagatggtgtttgccagatggagggatgtgaaagaggaaggaaagggattcctgtactgcagaagatagcatgagcaaagagcatacagacctggaaaagcctggtaattgagggaacagcgaggagcagtatgggcaaatctgcagggctgtgtggtcatgtcacatgctctgggaccaggctcttccaggaggaagacagaaaggccccagaggctgccaggctgtgttgtaacacaccgcagcaaacaacaacaggccctgtagatacagctgcaggcttttttttctaggccagagtctgtggggaacagtcagttccacagttctgatggcagcctggctggccccacccactctctcagaaaaccactccggtcactgcacttgccctccttggcatttagaaacacgtgtgcttgcaatttccccaaacactgctgcccttcagaactcaacgataacgtgggctatggctgcagacacctgggtgtgggacggacagcccttcccagatgcagagggttctttgcagggcctgttaccaaggctggattcaggggcgtgtgacctgcacttggtttcatgctctgctgtcaccgtcttgaaattcttagtaaattttcaacattgcatgttcattttgcgctggaacttgcaagttatgtagccagtcctacctgtcactgctagtgcccctgggaatgtttgtgatcttgctcaaatgatttctcatttttaaagcactgggcattcatgaggtttgttcacatgcactgtatcacctaattctcacaatggcagtgtgtggtaggcctgtattactagtcctatctatcagctgagaaaactgaagtttggcaaccttctccaggtagcacagcagggaatggcaaagcttgtatttgaactcagcccacacaagccctattccatctgctatggagatacgtttatgttggtttcagaatcctttcaaaggcagatctgtacaggaaggatgcactgaggtgtttttgtttttgtttttaagtaagctctacacccatggggcttgaactcacaaccctgagatcaagactcgcatgctctaccagccaggcaccccaaagatgtactgttttaagagtcagaacatatggtgaagtgaatatatgtcatttcatggctgcttatcccatctgaataagttttcattaattccgaaaaactttcagccaatgtatgttcaaatactgtttctgtccctctctctgagccccccagttgaaatacctattagaccttctcactacatccctttcttttactgttttttatctttagtccttcgatgttttgttctaaaagtttcttgtgactatttttcagttcactaattctgtcttcaactctttaaaaaattctcctcttggggtgcctgacatacaactctcgatctcagggtcatgagttcaagccccacatcaggcgtgaagtctacttaaaaaaaaaaattctccttttaaacccacccatcaaaaaaatttaaaaaaataaataaataaacccacccatcaagctcttaatttgttttttggttttttttttggggggggggtcttcttcagatctgctatgtcacttcttatatctctttgtgacttgctataattttcaagctcagcttttttctccttaaacagagaaagtgtagttgttttatggcttgtgtctgttaatttcaatctagagtccctttgtgtccatttctgttgtcagtttttactactggttcttcctcatgctgttttatctcttcatgtacctggttatattctggacattgtatttgaaaaatcagtgccccatcaatttgacggggcacctgggtggcttagtggttgagcatctgcctttggctcaggtcatgatctcaggatcctaggatccagtccagcatcaggctccccgtagagagcctgcttctgcctctgcctatgtctctgcctctctctctgtctctctcacgaatgactaaataaaatcttaaaaaaaaaaaaagaaaaatcatttgaagcaacaataataatatcttcctccgaaaaggatttccattgatttctgcagacatttagtgacattagcaagctaccatcaccttaactcaatttcagggcttctgattttctgagcttcccagatgacttgaagttggactacagtctgtgggagggtttgtttatttatggttcctccttacccaatgttgcagttctttgaggttccagtcaaagattggagttgttttagttatatattatttcatagcaaactatcccaaaatttagcagttcaaaatagatgtcagtgtactttttcttaaagggccagatgataaatattttagatttgcaggccatatggtctgtgttactactactcagctctgtcattgtagtccaaatcagctatagacaatacatgaatgaatagaatggctgtgttccagaaaaactttatttacaaagccaggtagccatttcaagctgataaaaagcatcgatgaaacacccacaactaataccatacttaatggtaagagactagatatcttctccaagaaaaagacaaggaacgagacaaggatgtccacttttgccacttctatttaatattgtactggaggttttagccagatgattaagcaagaaataaaattaaaaggcatccaaattggaaaggaagaaataaaactatctctactcacagatgacataattttgtgtatagaaaatactaaagagggatccctgggtggcgcagcggtttagcacctgcctttggcccagggcgcgatcctggagacctgggatcgagttccacatcagggtcccagcatggagcctgcttctccctctgcctctctttctctctgtgtatgtgtgactatcatttaaaaaacaaaaaaaaaaacaaaaaacaaagtctttaaaaaaaaaaagaaaatactaaagaggggtgcctgggtggttcattcagttaagcatccaactcagtttcagctcaggtcatggtctcagggtccagagatagagccctgtgttgggctccgtgctcagcagagtctgcttctcactctctctctccctccccctccccccactcactctctggtatactctctccctcaaataaatctttttttttaaagactttatttatttacttgacagagagagagtgcccacaagcaagaggagtggcaggtagagggagaaggagaagcagactcccctctgagcacggagcccaacatagagctcgatcccaggatcctgggatcatgacctgagctgaaggtagatgcttaaccaactgagccacccaggcacccaaataaatctctttaaaaaaaaaaaaaaaagtagggcagggcagccccggtggcgcagcggtttagcgccgcctgcagcccagggcatgatcctggagaccctggatcgagtcccacctcagactctctgcatggtgcctgcttctccctctgcctgtgtctctgcctctctctctctctatgtctctcatgaataaataaataaaaatattttttaaaataaaaaagaaaataaataaaaagaaaatactaggaggggcacccgggtggctcagtctgttgagtgcctgagtcttgattttggctcagatcatgatctcagggtcctgggatcaagttctgtgtctgtgagtgtggggagtcagcttgaggttctctccctttccttctgcccctcccccggcttactcttgttctttctctctctaaattaaataagtagggatccctgggtggcgcagtggtttggcgcctgcctttggcccagggcgcgatcctggagacctgggatcaaatcccacatcaggctcctggtgcatggagcctgcttctccctctgcctatgtctgtgcctctctctctctctgtgacaatcataaataagtaaaaaattttaaaaataataaattaaataagtaaataatctttaaaaaaattttttttaaagaaaatactaaggaatccactcaaaactcttagaactaaaaagcaaattcaagggcacctggctaactcagtcagtagaacatgtgactcctaatcttaggattgtgagttcaagtcccacactaggtgtagagcttacttaaaaaatatataatataataataagtgaattcagcaagtttgtaggaaacaagataaataataaaaatcaattatatttctatacactttcagttaacaatgcaaaaatgaaatttaaaaaatttcatttataatagcataaaaaagcataaaatactggggcacctggctcagtcagtagaccatgtgactctattgatcttttggtcattagttcaaggcctaccttgggtgtagagcttactttaaaaataataataggagtgcctggctgactcagttggtgtagcatgtgactcttgacctcggggttgtgggtttgagccccatgttgggtatagagattactcaaaaataaaatcttgaggtgccttggtggctcagtaagttgagcatctatctgactttggcttgggtcatgatctcagggtccggagattgagtcccaagttgggatccctgctcagcagggagtctgcttctcccttttcatctgctcctccccttattctctctctctctccctttctctcaaatagatattttttttaatccttaaaataaataaaatattttaaaaagtacgtaggaataaatttaacaaaagaagtggcaaacttacagtctgaagactacaagacattgttgaaagaaattatagaagatttatataatcagaaaaacattctatgttcatacatcagaagacaacattaagatggctactccccaaattatctacaaattcaatacaatcccaccagagtcccaggtgacttctgtatagaaatcaacaagctgattctaaaattcatatggaattgcaaaagacccagaatagctagaatagtatttaaaaagaaaaatggggcacctggctggctcagtcagtagagcatttgcctgtatcttaggattttgagttcaaccccacaaatgtggagcttacttaaaaaataatttttttaagattttatttatttattcaagacagacacacacagagagagaggcagagatataggcagagggagaagcaggctccatgcagggagcccaatgtgggactcgatcccaggtctctaggatcataccccgggctgaaggcagcaccaaaccactgggccattggggctgcccttaaaaaataatctaataagtaaatagaaaaacaaattagaaggactcacatttcctgatttcaaaatatattacaaagcaacagttactaatacttggtactggtacaaggatagacatatagatcaatgaaatagaattggaagtccagaaataaacccacatatctgtggtcaactgatttcaacaagggtactaagcatcagtgagtaggtggagaatctagaagcctgatgcattgccagtgggaatgtaaaatagtacagcttctttggaaaatagtttggcatctcctaaaatgtgaaacatctaattagcatatgacccagcaattccaatcccggatatatacccaaaagaactaaaaagaaggactcaaacagatgcttgtgtgtatatatatatatatatatataaaattcataattgccaaaaggtctatcaactgatggtgaaaacagcccaaatgtctgtcaactgacgaacagataaacaaagtggtatatccatgcaatggaatattattttgccattaaaaagaacaaagtaactgatagaagctacaatatggatgattctcaaagatgttaactaagttaaaaaagctaatcacaagggacgcctgggtgactcagctgccttcagacgcctgccttcagctcatggtgtcatcctggaatccaggatggagtcccggattaggctccctgcagggagcctgcttctccctctgcctatgtctccgccgcctctttctctgtgcctctcatgaataaataaataaatcttttaaaaaaggggaagggtaatttgtatggtatgtaagttaattgtatttcaataacgctgttaaaaaaaaaaagaaaggtagccatcaatgggccatagtttgcgtactcttgacttaaaacagtaactattctaggggcacctgagtgacttagtcagttaagcgactaattcttgatttcattgaggtcatgatctcagtgtcatgagatcaagccccacatcgggctctatgcttagtgcagagtctgcttgggattctctctctcctccttttgtcctccacctactctctttctctctctcaaataaataactaaatcatttaaaaaattaaattaaaacatttttaaagattttatttatttatttatttatttatttatttatttatttatttatttatgagagacacaaagagacagagagagaggcagaggcacaggcagagggagaagcaggctccatgcagcaagcctgacgtgggactcgatcccaggactccgggatcaggccctgaactgaaggaagatgctcaaccgctgagccacccaggagtcccaaattaaattaaaattaaaaaaaaaatttaaaaactgattattctatttagttgtttatgattctgcaatttgaaacagggacaactggtctctatgtggcatcagttggggctgcttgaccagtcctgaatgatctacttccaagatggccttactcacatggaggggaagtgggacctcagctgggatgttagcaagggtcttaggttcttttccacatagtctctccatgaggctaggttgagtttgtcacagtacggttgtctcaagataattggacttaaaaaagaaacattttatttatttattcatgagagaaacagagagagaggcagagacacaggcagagggagaagcaggctcctaatagggagcccgatgtgggactcgattccagaactctgggattacaccctgagccaaaggcagacgctcaaccgctgtgccacccaggcatcccaataactggacttttacatgatgactagcttcttctacaaggcaaatgtggaagctgccgggctttctaaaggtttagatctgtaaccaacaatgttatttccaccatgttctgttggtgaaagcaggtcacaagccagtccagattcaaggggaaggaactaataatgatgtgagtacagatatatggtttactcatggacaccaaaataacaatctatcaatattccctctgccccttaatgtttcacttcctcccccatgcgaaatatactcactaccccctaagatctcccaaaatctcaccctgttgctctaccaggattggatttgaggttcataatctcatcacctaaatcaagtttagatatgaatgaaatttctcaagtgatcctcctctggttatcacaacctttaaactacagagacaagttacctgctccccacaggaaacagtcagagaaaggaaaatcacaaattatattcctattcaaaaaggagaaaaaataaaaataataaataataaaaaaggagacacataaataaataataatacaaaaagcagacacatagcagtcacaaatccatagcaattctgaaatccagctgggtacacatcaccaattccttagctcccatttcttaggggtagttttacttatcacatggcaactggcttaccccagagccaaaatacggaagctgtaccagacctggtacaacattgcttccatcacattctattgggtcacagagctagcccagagtcaaggggagtacatggagcgtgaatacccatagctgttgtggttcactgggaatcaaagttatagtttaccataggggtgatttatccgagtctctaaccttcataagtcttgcattccaattttgtaccctaatcttaataagctttgaaaaccacagctcaacctctctgatgactcagattggcaaatgcccatgaacaaaagcagccccaagtgctggactcacttctctggttgggttgccagctgtaataaataaaaatacaggacatccagttaaatttgaatttcaaataaacaatcactttttactatgagtatgtcacaaatgtggcatgggcacacttatgctaaaaaataatttgtttatctaaaattcaaatttggctggggcataccctaaaaaaaataaaaataaaaaacatgtcttatctgaaattcaaatacaactggaagtcctgtattttacctggagaatctgatctctctggattcctatgttttaatgtatcttggttcagtaattcttcactatcttgttagatttttaaagatataaacatatagcatatttagggcagcccgggtagctcagcggtttagcgctgccttcagcccagggtgtgttcctggagacccaggatggagtcccacgtcgggctccctgcatggagcctgcttctccctctgtctgtgtctctgcctctctctctctctctctctctctctcatgaataaataaaatcttttaaaaactattttaaaatatagcatatttagttgtctttgacaggaggattggtccatattctaagtggcttttctatatgtgggagcattcccctattatgagttttgtcctcaacctggaagtcaacacaaattcccagcctccctggcaactaaaacatggacatatgacctaactctaccaatcatacacccaaggaagacttcaatttggaagtgcagaacatgaggcttggtgaaggactcccactttttgttgggcagcttgctataaaaaattcaatttttaaaaatgaggcaaatctatgtatgctgtagcagagaccgttagtcatccccaatatctattctcctcagagtgcctgggtggctcagtaggttaagcatctgccctgggctcaagttgtgatctttatttattctctttatttttagcagatacatggctacctgcaataaagaatgttgcccaggggtacctgactggttcagttgatagagtatgtgagtcttgatctcaggttcatgagtttgagccccacattgggcacagagactccttaagagaaaaaaaaaaaaaatgtttcccagcctcccttacacctgggtgtgtccctatgttctagccaatgagagttgagcagaaacatcataagaagtgtccttaatggaaggaagcatgtcccactctttccttttctctttctgctggctagatgcacatgtaatggctggagctcagatagacattttggaccatgaagtagagccccatgctgaggatggcatagcaaaaggctgaaggtatctgataattgtgcagtcctagtgttgcctgtctgcttacttctagactttattaatgagagataaatcaatgtctaatcttacaaggcactgatattttgaattgtcacagatgaatataatcttttttttaaagattttattaatttattcatgagagagagagagagagagaggcagagacacaggcagagagagaggcagagagagaggcaggctccatgtagggagcctgatgtgggactcaatcccgggactccaggaccacgccctgggccgaaggcaggcactaaaccgctgcgccatccagggatccccagctgaatataatcttaaatgatacacctattgatgtggaatgatttctaagataaattgccaagtgagaaaagcaaggtgcagagcaatgtattcaatatggtgctattgggggaaaaatgcaaatagatgtatctatgtttgtatatgagcagccttcttccttaagctgtaataaataaaaatatccttaaggatatgctatttgaattttttctatgtgtaaatattacttattcaaaagcgaacttgaaaaaagtctaaaaaattaataaataaaaataaaaacatctaaaactagctaataatatataatgttttatacttttaaatcatggtaatttggtgaaactacggtcaattttcctcttttttctatttttctacatttttagatttctaagcatatttacatgcataattgaatggccccagacaatgcaaataatttatgttttaaatatttgtatttgttgatgtgcatgccctttaattcccaggacctcaaagtccaatatactgaatgcatactttggactgaaaatccattcaacaacatatgttgaacatctactatctatcaggcactgttctaggtaaataaaacagacaagattcctttgttcatggagttaaggttctcatggggcagacaagtagacagacaaataagattctttcagttagggctcactgctacaaagaaaagaaacagggtaaatgggataaaaagtgttgaggacaccatcagagaaggtggtgaaagactttgaggaggtgacatttgtgctgaaactgaatgatgagaaggggtcagttttggaaatttcaagaggatgagaatcctgggaagggggcctagagcatgggagaaacagagaaatggttggagcaactggagagaagtgtgcaggcaggaggaatggttccagaagactttagaggggtgggcgtatgtgtacctcagtgagaaaccattacacgcctaaccagaattgctaaaattaaaaaagaccaaacaataccaagagctggcaaagacagaacaacgagaattctcacactctgctggtgggaacatatacttccactttgaaacacagtttggcagcttcttttgaagttgaacatactcttaccgggacacctgggtggctcagtcggttaagtggcagactcttgatctcgagctctggtcttgatctcttatttattagcccgctatattatctgtctgtttctctccatattttcaaggaagtagcttgcaagtaataatttctcacctgctacctgcccacttgttttttcccctactcctaacaccaaagagaagtaagcctgacacccagaacttctaacttttgaggctgacttcatcacctcaaccctcaccacagaaatgttcatctgcattttacagagaacagaggtccagtgtggttaagtcagcatgagtgctttccctgaaggcctccttggtgaatttggggggagccccttaaagctcccaaagagtttctttcctctctcggctgatgcctgaaatgcatgggtctgaatggtatcctttttggtatcaggactttaggagcctaggacgggaggtggccccacttttgctgacttcagtggccagtgaatgttccattcaacaaacaggccccacagtgtctgggtacacagaggtgagtgacatccaggccctgccactgaagcactcacagtcctggctgagtggtctcaagtacagtggacctaagatggcctggaacttgttggaaacacagactcttgagttcccaggagattcttatttgggtggggcattgttagcaaactcccagaccatcttcgagaaatggtgtctgggacagaagaaatactgaaaccatgtagaacgagccatggctgaaattgttcaaatctgatgaatgcaccacaagcaggataaacatgcaagaaatctcaccacagaacaactagttaaaaaacaaaacacaaaaccccaaaacacagtgatagaaactctggttcccaggattcaagagaaagcttctatagggtggaaggtgttgggagaaagtcccagaagtgagcaagaagggcaagatagggggaaaagtgaacctgagagttcaaagagaactgtcaaggccctctcgattggcaaccagttgggcctggcattgggaaagggccccagctctgtttataagctaatcccctctccacctggccctttgctgtgacgagccagatttatatcctatctcaaggataggattctcagagttctcagagatctttgggctgtcactgcatagctggatgctgctctgaccttgttgggcaaacaaccaaaggtatttcccaagcctgggtacatgcagggccatgagctggctgccccagaggagacatagaggcaccaatgcctactctttggggacttagctctgatgcctggaacctggctgaccctcaaactgaaattggctgtgtgccctatgagctcccagaaagcatttactcaggtttctttgcagcttggcttccctgtccaagcccaatgggcgcaaatcagaattaatcatatcccaagaagccaataggtcaacatagtgggcaggggcaaaaagagggggtggctaattcaggcatttggtgggtgaggagggtattgcttaggtcaacaggaaccacacctgtggggagacatctaggactagggagaggtgacatcgaaggacaaatcctgtggtctaaaagaaggataacccagtgcaatttgcatcatgatgaagacccttgactaatgttcatattagctaaagtctaccaggcacttattggaagctgaaattcttaaagttctagatgcctaaatgtcttaactactttaagctttttaaaagatttatttatttattcgtgagagacagagagagagagagagaggcagagacaggcagagggagaagcaggctccatgcagggaacccgatacaggattcgatcccagatctcaggatcatgacctgagccaaaggtggacactcaaccactgagccacccaggtgtctctgtcataactaatttaatcttcaaaaacaacccaaggaaactgtagcatggagaagttaaatgatctgccaagccagcaactggcagttgtggctcttgctctaagctccgccacctttcagaagtgagcgtagggagaccgaagatgttggttgggtaggaggtgaggccactatgctagattgcagagtcagcacattctcctgccctggggattctcatttgagcttttccccggtttaaatgcttagtttacatataggacagaaaatgaaaaattttaaaatcaactacttgtccaaaaacgtacaatcaaccagggtggacatgaagacgatttcagcttctgccacctcactaagtggcggttacctacctgcctggtggtctcacctcccaccacatcctctcttgcctcctactttcctgcctgactcttcctaccaccaaatctgggtatccaaacattctctggacttacatgcccttctcccttctctccagttatcaaaatctttcaagacttagtccaaatctcatctcttccagaaagtgctcacagacatgcctggttggaacaactctgtccctggcccatgtgctgagataggatgttctttcagcatcggccataattcactttgtattaggtcacttctcagtggatctgtctccctggtggcataagcacagagattgctcagaatgtagctgacatctgcctgtgtcatgggtaggaggtcatggtaagtaggtcattagaaggtcttgaggacctctcttcattgacttgaaaaaacttaggcttgaagatccacacaaattccatgtaaaaagcaagaagataaaattaaaatagtatgtaggggattttactctaaaatctgttttaaaattttttctatgtcctgtaaaataaaattgctttgggatagcagacatcttacgtgaatgaacatgagccttacttcttcatgtcattaaatgttaatgagttcattcattcatttattaaacaactgaatctggttgctcaaaagctacgtaagttgacaaatatttaagacagggaggcagtgtagtgcagaggtgaactgtatggactctttgaactggctgtgtgtaaataccactctaccacttattaggcatgccactttaggttaataagtcatttaaactctctgtgtatcagttttcccacctatcaaacggaaatgataattatagtacctatcagggttgtgaggattaaatgaactaatgtatattcataaatataattatttatatgtaatatataaagcagtcagaattgtgcctgctatgtagaaatgttggcttttaaatcattattgtcagcattatgttaaaatgtgttctttcttcgtggggggagatgaggggcagaggaagagggagatagagaatctcaaacacgctccatgcctagtgcagagcccaaagtagggctcaatgccatgaccttgagcagaaatcaagagtcggacacttaaccaacagagccactcagacacccctaaaatgtattctaatagaaaacaaaaaaagactccctcagtctagaaagataagaaggtccttgctaggtcaaggaggggatgggcattccaggcaacaggaacagcacatccgaaggctcagatgtggacaccagcatggtcagtaggggaatcaggaggctgggatctaatgtgcagatgagggcaagctgagcgatgcaggggtcatgcatgctgtgcacgaatggctggctgtgccatgtcagacatttagacctctactccgatggtgatggtgagccagtgaagggatctcagttacagatcagctgtgtgtttgaggcaaatggttctggcagcatagtgggagatgatacaagcttggaggtgggacaccccaccccctacacacacacacgcccaattagaagccccaggaaggaagaggtaagagacgctgaagctgtggcagtgagacctgaacagagagaactcaggagaaggatggaacaagaattgccgggcagccccgtggctctgctttagcccagggcctgatcctggagacctgggatcgagtcccacgttgggctccctgcatggagcctgcttctccctctgcctgtgtctctgcctctttctctatctcataagtaaataaaatcttaaaaaaaaaaaaaaaaaaaaaaaaaaagaattgcccaggggacggggggactgattggatgggataagagaggagagatctaggatggtgcccccgttccactctctgggttacacgccatttccacaagacccatgcacacatgcacacttagaagacagttgctgtgtcttactcatttatgtatccactccctcaccctccccagacaccccagcaccacgccaggctcagtgactgtagctgaattgggtttaaaggaatccaagtttgctccctgcccaacccctgattgggtaattgtgtcaaacacaacccctccacctcaccattctctgcatgactgctgtgctgccttggtggtggccaagaggagccccccttccacttgagggggtcagcctgcctgggaccctgtgtcagccccagagttcccacatcaaccttgggactgggcctgcttcacagcctttctactctttgcaggaagagaataggagcctaagggccttgcagcaacgggaagaatggatggaatgggatcagcctcacgcctaccgtctaccggtcccacaaaaacaatggctccttggagacgtctgttcacaaagtgatagaaaccttaccgccgcccctcacccccaccctcattcctgtcagccagccaagcaaggtgctgcccagagggaacccaccaccgctcttggggctttccctgctacccatacggtcattcatgagtaagaaaaattaagacagggatccctgggtggcgcagcggtttggcgcctgcctttggcccagggcgcgatcctggagacccgggatcgaatcccacgtcgggctcccggtgcatggagcctgcttctccctctgcctgtgtctctgcctctgtgtgtgtgtgtgtgtgtgtgtgactgtcataaataaataaaaaattcaaaaaaaaattaagacagaagagcatagtttgatataaacccagaggcagccaggagccaacaatggagcactgtcctcaccccacgttcccctggaggatgctcagcgggcaagtatgagctggctcaccccagagctgagggtggagcggagccccgcatcacggagagtaagtgtgtgcacatgggcacccacgcgtgtatgcacgtgggagtgtgcgcgcccgaggcgcacggcccgcgttcactcctaatacccacgtgtgcacccacgtgtgcacccacgtggacccccggggacccacccaggtgtccgcgtgcgcccatgtgcacccgtgtgcgcatgtgcagtgactgtgcgcttgcgcccgtgccagaggcggggccgggggcggaggaagcaggagggtacgtgtttcgccgaggtgctggtctgtctgtgggcaggtaggtaggagtgggtttgggtgtggttgtgtgaacaggagccacatgtttgttgtgagggaggatttcttcccaggtgtttgtgaaggaggacgggacagctgaggtggggcaggccctagctgtcctcatccttcctgggatcgcctcccagcggggtcacctttgtcccaaatgccccactttgatgccccgggttgggctggcctgcccagcaggaagagctcaatctcggaaagttgaaaggggcacgcagaagtggggagcaagaattcacacacacacacacccatatccccactcccaccctcaccgccagctaccttcccagcagggcctcggcggccctgccgtaggacaggagggctgcagaatgagggaggctctgttctggcagtggagacataaggggacaccactcagtagatccccagtgctgtgggggcctcagggggcagcggtgaattaggtcatagatgcctgggagaatgtggggaggagagaaggcaagggaagggggcattgcaggaggcagaggaacgagggaaggcactgaggtggggaaatgcagagtgtacttgagaaagcggagctgaaggaaacctaaagctcctctggaggctgccttcctcctggccatgggagaaaacccgggcctagagagaggaagtgcttctaagacctagaagcagaaatgaggtctcctgacttccaggtcagtgctctttctgctactccagaaagcctgcggggaagaaagccagggaatcaggctgttgattttgcttccttcagctttctcacccgcaggagggaggccagagtcaagggttcctgttttttgcctccctctgttagcggctcactacctggcacaagtcactttgcctctctgaaccccacatttccagcacgaaggcagtggaaggcctggcatcacctgggaatgctgcctttcactccctgtgagctaatgtttgtcttagtcatccttctttctttagtgggaagcagaagctacagtgtcatggaggcattcaaataagtgttttcatttttatttattaaagtttttttttaagattttatttattcatgagacacagagagagagagagagaggcatagacacaggcagagggagaagcaggctccatgcagggagcccgacgtgggactctgggactccatcctgggtctccaggatcacgccctaggctgaaagcagcgctaaactgctgagccaccggggccaccctaaagatttacttgagagggagagagagcatgaacggggaggggggggtgtagcccaatgtggggctcaatccagggactctcagatcatgacctgagccaaaggcagatgcttcaccaactgagccacccaggagccccaaatcagtgtttttaaatgaaggaaagaaggaactatgatgggcgcctgggtggctcagtccataaaacatcctcccttggctcaggtcatgatctcagtgtcctgggctcagtgaaatctccttgtccctctccttgttcctctgtgctctttctctctcaaatcaataaaatcttttttttttttttttttaaaaaagaaggaacgttgagctccatgactctggtaccaccctaccttgagaacctcagcctctccccaggcagggcatagggtgaaggaggcctcaaatcgaaaagaccttgaaagggagggcaggagagataaatatcctagctgtacagaggccttgacttctccctgtctctgggcggatgcccttgagagcgcccttcctagtagccttggccttgcagaaaactgctgtggtgagggggttggaggaggggcagggacctcacacagaacaggggggtggatggacccaagaggagccctggtaggcctcttcctcacccctgctctctccactcactgcctctctgctcctagaagcgtccccagacctcctgttccaatcctgggaggctggactgggcctggaatctcccatttcccatgccagtgattccttagtttttgtttttgtttttgttttttcaaattgaaataacgctcctattttgaggtctttttccttttttttttttcctttttgttttaaatatttattatttgagagaaagagagcgagcccctgagcacaagctggggagtggggggacataaggaaagggagaagcggactccccactgagtaaggagcccagtgccttgcggggactcaatcccaggaccctgagatcatgacctgagctgaaggcagacaacttatctgactgagccacccaggcaccctttgaggcccccttttcatgttaaagattttattttccacttcccttttctacgatagcagctgtatttcttttaagcttgtaaagcatgaatctgtgctcatacacaaaactaacctatggtgtagaaatcagattgaggttgcccccagggatagggactgactaggagggggtaccagggaatataggggtgcagaaaatgttcaaaatcttgatttagatgatggctgcacagatatatatacacttgtcaaaattcatgaagctgtaaacttaagatgtgtgctattgctgtgtgtagactatacctcaataaagtaatgttaccatctaaaagacatacgtagttgaggtgcctggctagcttagtagagcatgggactcttgatctcagggtagtgagttcgagctccacggtggacatggaacctacttttaaatttttttttaaaaattaaaagacacatatagggtgtctgggtagctcagttggtgaagcgtctgcctttggcccaggtcctgatcccagggtcctgggacagagtcctgtattgggctccctgctctgagggagtggccttctccctctgcctctgcctgtcagttcccctgcttgtgttctctttctatcaaataaataaataaataaataaaatcttaaaaaatgaaatcaaataaaagacacacgtacagagaaacatatagaacagtcatgctcagtttaatgaattataaagcaagcacccatgtaaacaccacgcagaatgcctggtgccccttgtagtccacagtgctggctgtaatctccccttggaccccaacaccaaagactgggcatcttggctgcaaacaccatgcacttcctgctccccagatttaaggggacacagagacagagatggggtggaacccatgggctttggaacctagaatttcccatcagtgcaaccccaagcttgactacaactcctgttctggtgagctgaaggaacgaaaacacacccatttcccctttttgggaggggggtttccgtcctggcctccccaggccaagtcttggctgggggtgggggatgtccccagtgaaagtcaaggagaaatgtgccttccctgcatccatgctaaaaataatcccaggcagtgctgctgccactgagcagcaggaaggacagaatcatgttttgctttaaacctagaagcagctcagcagttgggggtgagggaggggtggtagacagaggctaaggatctgagaaccctggcagtgctctcccagcccccacctcccagctgcagctggtcctctcagggggtgcctgcgaggggggtgagagagagagagagaatgtgtatgtgtggtgacagggccttccagcagagcaggaagctggggaaggttggagatgggtggggaggggtctctgtcctgataaccaaactgtgtaggctgcagggcaagagtcatgtactctgcggggtccccaccacctctgagaagagctctgacccagaaccccacacccagctccctcaggggcccctgtcctcctgcagggtggcgcctgccccttgggagttcctggcacacacagggctgaagtttgtcacttcacagtccccagctctgtctagcttttgctctgccctaagacatagggaggtcctcaagggcgggtgcggtccagtggtgaggaatttccctggaaacgggaagttcaagatgtgtcagtgtgggatcccagcttgaggagtaagtggctgagcacaggcaagaggcacccctggccgccctctcctgctctctctcccccaacagctcccctggctgtctcatgcagcagaggcttcacatggtgacaggatcatcctgcaggtgacctcagttctcccaaggtaacaataaaactatcgtgaattgaatgaaatgaatgtgtgtcatgttccaggcattgcactgtcttacatggattatcttatttaatctctcagcgagcctgtgttatcagaattattactctacctatttacagatgatgacactgagacgatgatgaagtgcttgtcctaggatcccactggtagtaggtggaagagacagggctcaaagttatgatttggacagagaatgtccagagaatcgatgagacaaatttttagaaattggaccttcccagataatttagggatacatggttgctatacttgatactttggtaggaaaacacacacacacacacacacacacacacacacacacaccaaaaacaaaccagcagtggctttagagtcaaaattttcactaccagttatgattttggccaagaaacttgaccattctgagcctcggtctccatctctacaaaataggtacaataatccttgcatagaactgctgtaatgaattcaaatgcagcattttttctaaacttggaaaactccaagctccttactgcctcagggcctttgcatgtgctgtaacctatgcctggaaccctcagccccagatgttcacatactggtttgtttttgtcatcttggtctcaggtctttctttagaccaggcttccctgactaacccattacccttagcagcatcgttcttgtttttcaagcattgttctgaaattatcttgctaatttatttgttttgtttatggcctatcctccctctccaactgtccaggatgtaagtttcttgagcactaggatctctgtagggtttaaggacccattcccaatgctcaaagcagcacctggccaaatcagaggttcctaaatatttatgaatgagtgcatgatcatgctttaaaaacgcattattttccagtttattattttctgtcacaggcttcactaagccaaagggcagtaaatgtgggttaatgagggcttgagagagggctttgggcctggcccatgcccagccctgaagctcccaggctgcacagagccatgcttgggcttccggctgctccaggataaaggtcaacccttttgctggaacatgaggttctgtaccatctgggcctgcctgcctctggcctcatctccccgggttctccaacctgtactccatgtccaggccagaccaaacaactcaaagtgcctactggagaacacaggctgcttcatgtcactgtacctttatagacactactccttctacctggaacactctgcaccctggctctgcctggctagctcctctcagacttgaagattagcctcctcagaggagccctccctgactcctctggccacatccagtccccaactttccagggcactcttatgatttgttttttttttgtttgtttgtttgttttacagtctctcaagtagcctagagatctcttgagggcagtgaccaggtttggcacccccaggatgaagcgcggtgtctggtgcatacagtaggtgattaataagatgccccagcacagcttttagactttgggtccccacgaattaacagaagtcctggagcacacagtaggtgctcattaagtacccagtgaatgcgtgaacctcagcaatctgacattggcagaagctgggggcaaggtgaggcatgcaggtgggaagtaggaatggaagatgcatccttggaaacaagtcggtgtcagagggggccccaggacacttcccaggaaaatgaacacataaacagcaggaaaaaaaaaaaaaaaaacatacggatggatggaggcatataaacagggctttcagtgagcaaagacagagaaggatgaaagaggaagaactggactcagaggggacagaatgtgcccatgagagctgcagaagacaggaagccagagactggaacaggctgactcgctacaggatgtctggtgcccttgcttcagcctccgggggtagataagggtggtgtgggcagtgtggtgctgtggtcccctcctagggtgggagggctgggtgaaaggccacaggtcacgagattttgggacatcttaggaaactcttcctctcttagctcagaagaggccctgtgttatgaaacacagcacccaagatatcacagccacaaacctagcttcttgcccttgggtgagcaacttagtgtttcttgcctcaattttcccatcaggaaagtgagtactgttctcctggaaaggaacgttagggtcatactgagttaggacgtgtaagtgaaatgcacatggcctgatacaaaggccagggactgacattaacggtagtgatttctcccaaagtcctgctgtgcccaggtcctaagagaggctgtgccttcatgtcactgagtaccacagatagacccaagttcagagactcagcctctgtttttttttatttgatgccggatcaatacagcaaggcaaagttaattcccgctgagagggtgagtggccgcaggcatgccagctggctgagagacaaccgaggatgccttggccagcaagcccgaccattgagctccaacactgactgagtgttctctggggcctctatgtttcagcctgtcaaatgggctgaagacagttttctggctatcagattatacctcgaggcatgcatgcactccaaggaggcagcgttcctggaatcatttgaggaagaagggaagaagaccctgaggcccgagaaaaggaggacttacaatttaagtacctgatctgagcaatctggcagattatttagaaaggctggcactgatagtagagtttaatgtgcatcccagctctgtcacttctctgagcctcagtttccttaagtgacaaaggaggctaacaacagcatccacctcccagaatcatgaataataaatgagcttgtgtgtacaaaggcctgagcccaacacttggtccctggtagcaattgatattagctattattgtgaataataatgtcacaagctcccgggggaggaaggccagatcactctctgaacactaaagccactttgaggaggttaagctggtcatgactcagaaaaatcagtaagtcaccaagtgtcaagttccatcttgcagcttccattaggattgtgtgattcctagaggggaagggggtctgattcttccccccccagtcatggccccatgtctgccatgttctctgggactgatgggggaggatcacggactaacaggtctgccaagctttgggggaggcaacataaatagagccttcagctcacttgtccagccaggctcaagaatatttctaaagtacttggggaaacaagagtgtcaaggatggacctcatgggcccagagaaccagcagacccaaactggagggtccatgaccttggaggctgttgcagggctgggtgatgagagagagaaagggaactggggttttttatcttttggaatccaacttttctcctcccaccccacactcccacaagaatttggaacccaaggactgactggggggtggtgcagggcccaggtgggaggtgggcagatgagagcaggggtgattgcctgacagcaggatgccacagctgaagaaggaagtataaatatacagcggccagtgtaggactggacagaggccatatgaaacacacggtacattccggccccagcgtaacaaactgtaccagccttttggagagttgggagcactgtgaaggggagggaagagagcagaggttccttcgaggttggccctgcctcctcctcccccacttctcccacagctcgggcaccgcagggaaagtcccgatgttccttttgcaaccacaggaaacctactatccctgctcacactctgtacccagtgttcctctcagcagctccagactgggagggagcagtgagtgggggagagagaggaggctggggggagggcagtgtaggcagccacagcagcccaggtaccatgagggaaatggcaagcatggcttgggcactaacagagctttgcaagggaggtacagatggcagtgaggtgcagggaaggaagtgccttgcccaagatcacacagccagtcgttcaccagggtgggaccagagtgcatccagagctgggcagtgccgggcagctctcttgggtgtactgtgcaggcgtggcaggccagggaacaggcagtgcccgggaactgagggtggggagcccagatccaaggctgcctctacgctctggttagctctgggcaggtctggcttgggcaccatcccctccactccttccaaacctaccctcctcctccacctaaatattagagataatgcatgtaaagaggctagcatggaggctgcttggtggtgatgtcaaccagaatgagtcacctccacacctcctctctcctcctccacacacacagctcaaggcctagaacctcctgggatctttctcccatatcaccacctccttcctgagtccctataactcaacgtttggtactcaccacctgctggcttgggttattatttaacctcacgagctgtctgtttgtctcttcaactggtctgcaaactgcccaagggcaggaaatcatttcaatacacccaacatttactgaacatcaaatccagtgccaagctgggcctgtgggggatgagctcaagtgatggcggaggcctcaaagaggcagactttgtttctgcctcaaggactttttaatctggttagaagagctggattagtaaacagatcactagaatatgagacaggccacacgctgtgctgcgagaaaggtacagactgaatgtgctgggcattcagaagggagaggaatcagatttggctggcgctgtttcaagcaggcttttatgagttggagcttaagagatgggtatgcggaggatgggcactcctggcaggagaaatggcacagcacactgtggaggttgcaggtgggagatgaaaggactttagcaattgtcttcaactttctaatgacatccttagcaggacccaacagagccttccatgtggtaggtgctcagataagttctttgtcccctccttggtttggaagcagtggaaccttcaggaactgcactcagtgacgtctttctgtagacggatgggtaaagagaaaacgtggttctgaataaatccgggtttggggctggaacaaagggaggggtcaggctccagtgtggggtcgtcttctccacccggcagtccactgctcggcccttcgtactcctggcgtctggccaggggtttccccagctatcccagagggctgggctcggttcgccagcccctgggaatccctggagcctccaggatggtgcgaggcgccgttggggaagggggtccggggcacgaggaggggctcctccgggggaatcgctcgaataggccccctccagcgggcttccgttgtcacgtgactgcatcccgggtcttccaagtgtggggctgacgcgctcggcgatcctcctccagaccggaccgtgcgcttctggggctcgggtggcggccggggtggctgcttctccctcgaggagctacgaacacctgcacccctcccaactgtgctcgggtcccgcacacgcccgggattccactgcgggctcaggtgggggatggagacgtctgggtgctggcagcccggagcccgggctagaggcggcgaggaaccccccgcccccggcccggcgcgcgtctccggggctcggcaccggcccccggccgcccctggccgggccccagcgcgcgctctcagggctgcggcggcggggaggctgcgcgccgagcgcaagccgcgagcacaaacagggcgaggaggctggtgtgagcgcctgggcccggtgccagcgcgccggggctggaacacaatgtcccgagcgggcgggcgagcggggagcgagaacaacatgactcagcagctgggtaagtgggtgtgctcgctcaccagatcangagcgcagcgcccctccccttggtgatcaggccgagccttctccgcccggctggtgaccgtgagacaccgtaacgcaggctcgatagagcagagggatgcgcaaacgcgccacgtggagctcccgcgcggccggctcccgggctcccgcccctgcctgccgcgcgggacctccacgtggcgcgtttgcgcatccctctgccctctcgcccctgcgttccggtgtctcacggcccccagcccggcggagcaggctcggccccatccccaccgggaggggcgctgcgctctccgcctgccacccgccaggtgtggcccggcctgcagcttctgtgtacaagtcccagtttcccccaaagcccaccatcctgggaggcctccggaggtcttggtgtgtgggatgtaactcatcgctgcagatggaggtagaaatctgttctggggtggtgaagcgctgcaggaaaaggatgctgagagaagtgggatatagggcaagaagatgtcccccacctctgtcctcggctgacccagagtttagagtctcttcctgtcccctcccttcaaaaccaccaggcccctgaagatttcctcagagggagggagaagcaggtggggaggtgctttgaagcctgagaccttgcttttctgccttacccaccctcccacccaaagccacaacaaagactcatgaatcctgccatccagccacaaagcttcttcctcctctgtgcctgctgtcctggtggggccactatgaggatgacagcccagggcaggacttttcctggaggcggagacctgtcccacaccctagcctcctggggtgtctgcaaggtgccccaggggacatgctgtgcctggagtgtgccagggctggcagggaggggctcggtcctctgctgagttccaggaaaggccctggcagccagcataggcctgagctccagggccttggagggtggggctgggggagggaccccaggcagctgaagtgcctcacctgggccccatgcccctgggccatctgatggcatctctggcaccctctgaggagatggatgccaatgcaggcctgggccgtggatccccttcccacacatacagtcctatttcccacaaatgtgctcacccagccagtgttcaccgaatgtcccaaccagaaggtaacttaactgtcatcaactccaagcttctatctgatgaatgaaatctgtctgtggtatcccaggtcagtaattgttctgaacctgtctgcatatctattgtgacagggacactctgacaaggcagcccactgcccttctggactcccctgtctccaagtccagtcacctacagaacatctgccctcacatgacctggaagtgactgaacttgtcctcctgtctcacaccagctcttccccactgcccactgtgactctcccatcccccacactcaccgggaagatgggttaatttttaactattttctctccttcgccatcccgtatctgaccgactaccaaattcctccctttgttgcttttattacaagatgtattgttctttatttttctcattcacctcttcctctctatccccataggttccacctttggctcaaattcccacagcctctgccacactgtcctttctgacctatgtttttcctttctcctacataggtttttcctggatagtttttctcagatgctgtttatgttgtatgcttttagcttcagactcctcaaccgggtgtactgggtataccgacttctaacctgtgtgttccgtatgaagggacctgggctcattcgtggtgtgcctagatcacagagcctagccctgggcctggtacatagcagaagggcagcaaatgttagtcaagggatcaatccacttggtgtgctgttttctcatttttctctctcgactcagtctccccattcccatagagcctattggttcctggtactcagggctcaggcccttttgttttgaagagtgactattttttaatctaccaaatcttctgagtcgggtggggaagggagaagctgatactcaagttaacatcaatgaatctgtgccaaatgccaactgcagagaccttgagtgcagagtggaatgagtgcagctgcctgttgggaatctctgcttctctaagacacataaaaccactgaggagggtggaaggctaaaaggtgagtgggtacagttggtgactgtgggtttacagagggatcttttcacaattgggagattccagcttgcctagctctggtccctgatgtccttagattgttctctttcttggcactgcatttcatacacacacacacacacacacacacacacacacacactcctggtgatcttggcctcagcacttcaaaatacctcctgcaggaaggctctgataatgtccacccaactttgatcatttggtcaacttctctctgagccttatgatctgccttcaatctctaatctattttattgcttagttatgtcctgtaattttttcaactccatagattataagctcctttatgtcagggatagttatctttcatttatttatttaatataatctacttattttgagaaggaagcgtgggataggacactgcaactctggaggctgtataaacctcaatctggattccaatacttagctgtttggccttgggcaagtctctcaacctctctgagcctgtttgttcatctgtggaagttgctggtgatacttaccttgcagaatgaggggcaaaggtcagagagactacaaagggccaagaaagtgcctttgcatagtgatcagacgacggctcgtcttcttccttgtttggttggaattcttccctgcattgggggacagatttccttaactagccccacccacccacccactggaacacttgagcgtgaaaaaggacactattaatcattacaccggttctacagacgtgacccggggcgcaaggccaggctaccctaactcacaataacgagtgaggacagggttcggatcccgagccaccagaaccccgcgcctaagcagggagccgagcagagctcaagctcaatgaacgtttgttgaatgaacagagccgatcctccctcagttctcgcagcagcagcagcagcgagtgaagccgcagattgaaaagcccgcccccgccgcctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccatcccccttcccccaagcccctggcaaccagagatctacattgtttccatggatttgtctgttcttttcttttcttttaagatttatttattttagagagagagagggtgcctacgggcaggggtggaagggtggtgggagagggaaagagagccccacgtggggctcaaccccacaacctcgagaccatgacctgagccgaaaccaagagttgggtacttaactgactgtgccacccaagaggccctggatttctctattatgaaaattttatatcaatggtgtcatataaaatgtggccctttgtgactagctttgtgtaatgttttccaggtccatggtgtagtagacatcaacacctcatttcttcttacgccggaatcgtacctcatgaggagggtgtccgccgcgtctgttgtgggccccgggtcggggacaggcgcggcctccgcccccctccgcggccctcctcctctgggggcgccgctcccggcgctttcgccgcgtctctcgcggggcccacgctttctctggagtaacgagctgccgtgaggcccccgatctggtgcctgggccggggtaagcgccagctggggcgggacggtctcggcgatgtggggtccgcggcggggcgcgggcggcacccccagcgtctcgcctccctatttctggctttctgacgcgggtgggggggcaactcgcacgtaggctttgccccctgttcaccgagagtcacaacatacgttctctcattcagtctgacagcagcacttcctggtagtaggtaagtttccgtagacccgtattccggaggaggaaactgaggcccggattatggagtttgcccaaacccaagcccatgggtctgcagtgagcttttcattgtagagtaggctgattccccttggcttcccctgtccatacaagctccggtcctctccagagtcacccaccgaaatggtctaacactgtgtcttgcacagtagcccctccaagagcttttctaattaactaggctgaaacactcattaccagagcccagtagtctggggtttcataggtggggaatgggctggggggaatagcacttctggtttaagtatttggggggagggcttcaaagagtgctccagagttgttccaggcaattaaatgggttaggggagttgaggttgattagcccgaagaagagcagggtgggaggggtagaggggatgaataatgtgtcttagaggtgtcattcaggcccaccatctgtgtgctcactgccttcccacacccaacattttggtccaggtgaaacctgcttgtaatagtaatgattacagttgacatttgatgggtacttcatcttcacaagcaaccccatgcagacattactattcccattttacagggagggaagtcagctacaaagagagcacaaagctaagtcagtgactgaactagtttcgaaccctggcagtctggccagagcccacactccttcactaagcgaaactgcacctaccatgatgggaatatcggctttgaaagtagaaagccagtgcagatgacagagaggtgtgtgctatggcagcccacgtctttttgccctggtaaggacaggtaagaaacttgggggctggcagtgtgtacatggaatctcagatctctctcatcagtggttccagatctttggatttgacagaagagacaaaacaagaaaacaacagccaagtccttacaaagttgcagctttaattcatgtaccctaagaacattcagaacacaactaccatctgttaccaccattatttcataagggcaagtggattttaattctcaaagtaagaaagacctcatctgaatcaaaatcagctattcccaagaatggatagtcattggctttacaccaacaaatggacattcctgtgtgtgtgtgtgtgtttcattgtgctgtggattagtgaaactgtcactctggggatggcctctgcctcttaatccctctgcttcatttcaaagcagaaccaaaagtgggctttaggtgtagtaggaaggagtcaggttaaagccaagaaggaacttttcttctttggaaatccttaaagaacaggggagcactgcatttgcttaggaaatgagggttgcagaatcaagtccatggactggagaagccaggagctctgggtcctccccagaactttgttctgaagggtctctcctcagatccactagggtagccttggaaactaaagcagtcccatccagcagccatttcctgcctgaagttcatggggcatgacaggtggttccatggcagcagggaggcctccaggggcctctgtcacccctcagcacagagtccatgtagtcacccaccttggagcttggtaaagtgctacgaatgacccttgaggagggctgaggacagaaaacaggaagggaagagaacagccacctgggagtgttgcctacagtctggtgtatgatgggtgcaggctctgagcagacaggcctggctggctgcagcagccttgggaatgttatttctctccctgtttcctgaaagcccaagtgtagagcaggacctagaactttccaatgggagctcaaagccctattctagtacatgctcagtgctggctctgggcctgagcctgtcttggagcttatcccctcccttttctgtcccaggaggtgaggccagagggtaaggggacaagtggggaagggtctggtctcacttgccacatcttattggtggacatcaaatcccctaaagttggactttcatgtttctgggatggtggcattttctgtctccacgggaggcctcaagtctcatcttttttttttttttttttttatgatagtcacacagagagagagagagagagagagaggcagagacataggcagagggataagcaggctccatgcaccgggagcccgacgtgggactcaatcccaggtctccaggatcgtgccctgggccaaaggcaggcgctaaaccactgtgccacccagggatcccaagcctcatcttatcttataggaatggggtgggggcagggtgctgggcactggaccatgctactccgatataggccccatcatgtaaaggtacaaacctacccaattttattcctggagttctagagtggtaattctggatcccctcggatcgcaagtgcacagactgacctaggccaaggcagtccatccctttcttctccagtgtcacactgcttaaatgggcctggagcccctgtaaccagatcctctgtcactgttgtgcactcaagtcctcaaagaatgacagatgtgatgatttgagcacctactaagtgcaggactctcccaaatgttggagatgcagggaaagagagctgccttcaagagtttctagacagaccggtagatactacccactacaggggaactacagtttctggaagatgatgggtttgcctgtggactgcaacactttataaagtgctccccttgatggaagggagccctgcctgtagaaacatctcgagatccagcagtgaatccatggtgaagaaataaaagataggaggccagagagtgagagaccagccttgctggtacctaatgggctcatcccaaatgtccctcccagaaacttccaaaggaagcagcccagaagttgggcctctgctgccccctaatggaggaaagcagcctccggagcagcctgctggggcccaaccacctgatccctaaagagagggatgtggtggaccttcctgccttcagactttttactcccctacagtcttgagattgatttcctacagcctctgaagctgaaccctccctcctcccaagcactcctggcagccccattttcctatacccactctctgtcctgtttccccagtttcctttgttgcccagggttctgattctggcaccctggttcctggccctgctagagttctggttccagaaggccctcaccaggtgccttgggcctagctcccacccgggtgcgaggccgcactgaagacatgggcatgagcatcccccggtgcctggggcatctggacatccgcaagggtgtcgtgggcttggccacaggtgctgggttcgtctatctgctctacaaggccatcagggcgggcataaaatgccagccgccgctctgcactgcctcacccatctgcatcgcccgtgagtgtacgggccctggggagagggctctgccccaggaggcaccggctctcgaggcttccagtgtgggagggcccaaaggtgactcctccaggttcctctctcccccttccttcctcttcaccatcttcctcaaacccgtcctcgagatgctagctcagaggccccaggtagtagatggtactcaagtgactcctcagggttcacctggcgggtctccaaattctaccttcactccagctgccaggatgctactgcttggaaacttggcgttagcaattctacctaagggaaaattgggctacctggatgcacagagcctcctctagtccacacgacaactttgtgcaaagtagaaaaaggcacccttctgcaaggctcttgattgccatctgttgggatatccctgccatgtactgattatgacaagatgccacataggactgctgtaggccagaacattgttatagtaaatatacaaaaccaggacatgtatgatctgaatgatacatcattagatgtagtaccctcgtgcagtacacgcagctcagctgtatctggcggtcctgcatagagcaagaaggcctcttcagaaaaggcaaggcagccttgtccccaggtccctctccccctcttcccaaccccattctttgatcacatctgagtccacagcctgaactgggctggggtggctgtctaggcctggcagtcgaacgagagcggcacgggcgagactcaggtgagctccggaggctcctcaactctttggagtgcaaacaggatgagtacgccaagagcatgatcctgcacagtatcacgcgctgtgtgtacttgctggaggctgaggtgagggaaagaaaccaggaggtccctcccagccagcctggcccctgggggctacagctgatccccaccccccttggttggccaaacttgtgccctgggacctgtctttctggctgatggcaggaggggtttgctgaggggccttggtgacatgtggggcaggcagggagcccaggacacctgcttctccccgcctcttctgtctctcctggcacactctaggcctctgcttgtactaatgatgatatcaggttggtgggctccatgctggatgacaacgacaacagtgtcaaaatccaagctctgaacacacttaaagctttctctggcatcagaaaattcaggcttaaaatccaggtgagtcagaggcaagtggtgggatggagaacacagaatatctgtagtccatgggctctttaatgagcattggataattggtcatgttccagaagttgtttgggtctgagtttgtaatccagaaatatgcttttccttgtaattaagtaagaccctcctcaagggccatgaatctttgaatctcatgctgaaactgagcagggatgcttggagccccaaacagcagaaagcaccgagattctttctggtaccagctaattcaacaccaatggggtgtgctacagttcgacttaattctgacgctgtctacctggggttagtgcagaccccacaggtaaagggctcagtcccacaagattgccctcccccccccccccccccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctttctttttttttttttttttaatttttatttatttatgatagtcacagagagagagagagaggcagagacacaggcagagggagaagcaggctccatgcaccgggagcccgatgtgggacttgatcccgggtctccaggatcgcgccccgggccaaaggcaggcgccaaaccgctgcgccacccagggatccccccctactcctttccagtagtattcaacatgctgtaatccttccaatcttaaaaaaacaactcctcttccttgacttccaaatttctctctagcaaatggtttcttctgaatcaaaacataagtaaaatattgaaaacttacaaacattttatatgtgtgcaatagaaagaactataaagcaaaacacacggctgagaaatagaatacgaccaataggtaagatgctccagatgcccctccccaatctgatctcttccccaaacagatgcaattatttcctgcattttgtgcgtcaattccttgatttttttgtatggtttgctatatatgcaggtatcaaattctagcaaggcaaggcagataataaatgaatagacaaaatgtagtttgggatgtttttaagcttcatgtatctggaagtatgtagtttgtatgctgtggtttgccttttccccacaacatcgaaagattctcctttatttgtgtggatagcttggtttccttgttttccactgctgtatagtgttctcgttcatgaatatcctgcaattttatttatccatttgcccatcggtaggtattaaaattgtttccacgttgtgccatgagtgtttttgtataaatcgcccttgagaatataggtagctttctctaggacctatatacaggagtggaatgactaggtgaaaaggtatgcccaacttttcaaaaagggttgtatcaatttacaccctctaccttgagtgttcccattgcattgtagttcctccccaaaacttggtattttcatttaaattttttgtatcaaacttttttggagaggggcacctggctgcctcagtcagtagagcatgtgctcttgatctcagagtcatgagttcaagccccatgttgagcatgaagcctacttaaaaagaaagaaagaaaaaaaaaaaaacacctctttttggaaaaaagagaaaaaaaggtctctaggtcttcgcttgctcgccacctttatttggccctctgagttttcctaagtctgtaattctcaagcatatcagaattgcttgcagagctggttaattatgaagatttcaggaccccatacctagagagtctagtttaggagggaagctatgtttttcacaagcctacccagaaattctgatgcagctggcttgggtaacactttgcccggggtattgtggggacctgatccctgttctctctgggtaaaagcagccactccctagcctcagttttcatctagatgtgctttcctgcatctctgtccatagcctgggaattcccccaaacccctagacccagccagctgctccactgagacatcctagtggctccctaacccagcctgtccaaaatgggccttgccctcattccctaagtaagaccattttgtccagagggatctgatcccatcaaccctctgcttggtattcctcaagactcatcatgaagagcatgatcctccacctccttgccccagtcctagccattcacagtgtatgtttcatgctctcctactcgctcgctggcccttgcacctgctgttccttctgccttaaacactaccccagagtaactcttacctgtccttcaggtcttagtggacaacaaagggttggggcagggagaaactggtactaatgggaatgctgtgatcctcattccaggattcttgccatcctcttacatggttcacagaagtgtagcatgtggagttatctgtctttggtaatatctctcagtccagggacgcctggatggctcagggattgcgcctctgccttaggctcagggtgtgatcccaggatcgagtcctacatcgggctccctgtgaggagcctggttcttcgtctgtgtctctgtgcctctctgtgtgtctctcatgaataaataaataaaatcttaaaaaaaatatctcagtctaagcatcttgcatctcagaagccaagatccttttgttcattcaacagatgtatattgagcgctaactttgtgtttaggcgttggacatgcagcagtgagcagagcaggaaagatcgtcgtcccagtgagacatattctagaagggcaaggcaagcaatatataaattagtgaaatatatagtatgtttcatgtaacaagtgcggcagaagaagggttataaagaagctagtaagggggtgatggtacagtttcaaagaaaatcttcgggacttagagcttgatgaacagttcttagaaataacaccaaaagtgtgatctataagaggaagaaatggatacattggacttcatcaaaactaaaaacatttgccctgtggggtactctgttacgaggatgaaaagacaagctgcagacaggaaggaaatacttgcaaagcacatagctgacaaaggatcatatgtagatgatcatatgtagatcatatagaactctcaaaactcagtcttttaaaaattccaattagaaaatgggcaaaagacttggagatattgcactgaagaagatctaggagttgcaaataagcccatgaaaatatgtttaacatcagtaggcactagggaaatgcaaattaacaccacaatgagatatcactatacacctattaggtagtccaaactcaaaatctgtgacaacaccaaatactggtgaaaatagagaggaatgggctttctcatatgttgctggtgggaatatacaatggtacagcacccactctggaaaatagtttggcaatttatttaaaaaacaaaccatcagggcacctaggtggctcagttggttgaaagtccaactcttaatctcaactctggccttgatctcaaggtcatgagttcaagccctgcgttgcgctccacgctgggtacagagactactgaaaaacaaacaaaaaataagtgatacatttactcagtagttgcactcctatgcatttatcctagagaaatgaaaattaatatctgcacaaaaacctatacacaattatttgtatgcacctcgtttgccgtagaactggaaacaacccaaatgcctctcaacaggtaaatggttataaactgtggtaatctgtaccatggaacactcctcagaaataaaggggagtaatctattgatacaacagcttggatctcaagggcattatactaagtgaaaaatcaatctcagaaggtcacaaagtatgattcaatgtatgcaacattctcaaagtgacaaaattatagagatggaaaacagttgcatggttatcaatggttagggctggtttgggtggggagaggtaaatatgactataatggagtcccacaagggagatgggaaaactatgatggaataatctgtcaatagcagtggtggttacatgaaactacatatgtaataaaatgaggaatccgaatttgtaccaatcctgatttcctaggtttgatattgtttataattacataaggtgtaaccattgagggaaactgggtgaagagcacacaggatgtctctgggctacttttggcaacttcctgagagttatcatcttcaaaaataaaaagtgttgcatgtgacagtgctgtggagaagaatgaaataaagatggagggtaaggaaggctagggtgggaatggttgcagtcttaaagaagtgagtggttagggaaggcctcactgagaaggtgacattaaagaaaagtcttggaggtgtaagagagtgagctatgactatctggagggagagcattctaagtagagaaaacaacttgcgcaaaaacaagataagtgtgtacttggcatgctcaaagaatggctaagagtccattatggcaaccatgggagcaaagaggagaagaggagatgaggtcaaagaaattgtggagggagcgaggcagaatatattggaccttgtaagccactgtaagggctttatctcttatgctgaatgaactagggacctgagcagaagagtgacatgtctaatatgtctgttgtcctaaaagtaggtttagggggagaggatggaagcagggagacaggaagctattgcagaaatccaagtgagaaatgttggtggcttggaacacgttggtagaagcagcttgactgttgatagattttgaaggtagagctaacaattttctgaaggattcaaaaagcaatgtgaggaaaaacaaagtagttaaagaggaccacagatttttgacctgagtaactggaagggaggtgcaacccaaagcagagacagagaagttggtggaaaaaaacagtttgggtgctgagtatgtgttaactctgagaggtctattaagcagaattctgagaaggggcacctggctggcttagtcggtggagtgtgtgtcttgatctcggagttgtgagtttgagtcccacgttgggtgtagagatgacataaaaataaaatcttgggggaaaaaaagcgttctggggaaggagtggaattggcacctgaatatatgaatctggtgttcagggtgaggtctgggctggagtcgggaagttgaaaggcattagcatcaacagtatttttaaaactgtgagtctggatgatatcactgagggagtgatcaagatagagaagaaaagattgggcagaagaaccaggaaagaagtctgtgggggagaagcccagggcagaaaggggataggcatggccaactaggtcaagtcacgttgagagtgtaagttagagggaattgtctacagggcttgggcgcaagcagggaagagtggggcatagtgttggggaatcactacataaaagcagttccttttcccctcatctgctccacccccaggaacactccatcaaggtactggaactgatctccaccatctgggattcggagctgcacattgcaggcctcagacttctcaacagcctctcactgcccgactatgtacatccacagctgcgacgggtgatgcctgccttgatggagatcctgcagtcagactatatcctggcacaggtgcctgaggaccatggcccatgccctgccctccttgaccagccctggcacagcacctagagggagggagagggagagagatttgtgctttccctgctgaggcccacattcacctgccttctcatgctttactctttcttttattcaggtgcaagctatacgattgctgagctacttggcacagaaaaacgaccttctctatgatattctcaactgccaggtgagaaaggaactgaagaagtgttaatagataccaactcaggtattggggaaggaagaatcatggatttccctagacatacttagccttaacaagatcattttatttctcttcctacttttgtactgtgtatattaaaaactatctcctcttccattctctgaatagaatgagaatttgttttattgagagagagattctcctttaaggggctttctgaacattgagagccaggtatccagtgacaaaacaaaaggaaatataggtgttttcatattagagaaaaagtacttataacaaaaaccaatattaggaataaagagggtcactacataacagtggttcagaggccaaaggaactctaaacttacgtgaacctaataacataacctcatatttatatggcaaaacttgatagaattacaaggaattttttttctcttttttcagttttagtgaggtataatagactaaattgtaaaatatttaaagtgtatatagtgatgatttgatatacacatatacattgtgaaaggattctcaccatctagttgattaatacatccaccacttcacatatttatctttttgtatgtgtgagaacatttaagttctactctttcagcaaatttcaatcatatagtacagtgttattaactataatcaccatgttttacattacatttataggcttttttttttttaagagagagaacacacacatggcaagggaaggggcaaagggagaaggagagagaatctctctagcatggtgcccaacacagggctcaatctcacaaccctaaaatcatgacctgagctgaaatcaagagtcagatgctcaactgactgagccacccaggtacccccagatcttattcatcttatagctgaaagtttatatacctttgtaccaatgtctccctatttcttctacaccaccagctcctaacaaccacttttctactctgtttttgagtatgacttttttctttagattccaccaataagtgataccatgcagtatttgtttttctctgtctacttatctgacttagcataatgtcctcaaacttcattcatgttgtcacaaacagcaggatttccttctttctcatggctgaataattgtaaggaaaaattgacacatctaccatcacaatggaagatttaggaggtttgttttttcagcaattaatagataaaaatctaaaaccagtaagggtgaatttgctgtgaataccataaataagcttgagctattagacacacctagaacattttacaattaataagtgtatattcctctcaagcacacacaatatttataaaaattagccacatgcaaagctttaaagtttgactcaacagatttctcagaatcaatattatgatcatatctctcatgttttatgaccattgtgcaattatgttagtgataatgaaaggaaaactaaaaaattcctatacagttgaatctgaaacttaggtatactggagaattgaggcaataggaaaattgaagaacttcagaacttgtcttggatttctttgccattgtctctctacgcccgttataggtgcattccaacttcctgaacctgtttcagaccacacagccagggagtctgctgttcgaggtactggtgtttgctgagcggctaagtgagggccggaattcaccccactaccgtgctgtgaagtggcattacaatgaacaatctctgcatgaagctctttttggggatgagtcacgactggcagaccggctgcttgccctggtcatccaccctgaggaggaggttcagatccaggcctgcaaggtcatagtcagcctgcagtgctcccaggatgtgggagtccggccctcctcctgccggcccagtcattcctacttcaatagcggggaataaagttaaggagagccaataaatgactatgggagaaaagcttgaagggcactttctatctgaggccatccagggactgggtgtggttttatccagcacgatcccttctctgggtgtgagggaactggtgcatctctgaaacacgtccccactgccctgtttaggggacagattccctttttctcttgctgcttttcaaatttgagtgtggagccaatgctgtaggggagtttcagagagaaggcatgtttagggactgaggccaaaggtaatcaacaggagatagtattgcatggattcctagggtgggctaggctgtgctgcagtaacaaacaacctccaaatcttagtggcttaaaaaaatgacagggttgtttctttgtcatcctacatgcccctagcaggtcagctgggggggggaaggggtgtaggggcagctgtcttttcaaatcatcttctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaatgatgctcaccacttctgttcacattgtgttagccaaagggggtatggaagatcagtcttaccatgtgtaaggaagaactggaaatatttggtgacagcattaatgacagagactgcaggcgtattggaagagtgagacctctggaatcagaatctcaggttcaaaccccagctctgtcacttactagctctgtgaccttggccaaaccatttaccctatttgagccttagtcttcccctcacctataaaatgaaaataataatagtaacttatctcatgaggctgttgggaagattatgtggggattatatgaattaatataaggcacaatgttctgcatgcagagggtatgcatcaaagatcaagattgaaagagtgaaagcttagcattggaaaggtccttagagagcaatgaatctagtctctttggattacaggcactgaggagtcccagaaccctctatgaagcacccggaaatgccactggaatttagctttagaaaccagattgtgtgggtaatacaaaccataaccatgaattctccagaaacaaggagactgtcaaaccaaatatggtcacctattttcagatttccccattcattgcatttcccacttgttcattcattgtgttatttgtgagcccttgctggaaaacaaacagtagtgattgcaaatggtttaagaaaatgttatgggagaaaaccctaaaattggagctgttccatctgctactacctgattgaggaggaagaacatgttggcccagctatggaaccccattgttcttcagtggcaggatttaaaaaccacagtccagtccaaggccaaccctggcattttgctgaaggagaaaacacccaaagagggaaagtgacttgctcaaggttacaagactgatttggggcaaaaacagggttagaatctcctagtcttgggctttttgttttcatagtctttggcctgaaccccatgggggttgaccatggattctaagccagaatcggtggcagttgagagagacagcacctctggctgtccttttaggcctgaagtacttgaggaaatttgtccccactgaattcctgactcaggatgtcatcatttgggtcagaggtgaggtggggggagggttgttaataaggatgggctgatcagaaagccatccttatcaccatcacccaaagtttgacttgtctcctctgagtggacaccactaccagatctgaatcatcagcccttatctctctcctgagttcaggcctgagagtgctccttcctgtttcttagatataccgcagtcactccagtggaacctatcaaaagccaacatcacctatccacttctcaaccagctcctcaagttcccatgtcaccacctaagtattgggcatcaccttcaacttcactacagccaaccagccattccaaacatcccacatctacccaagttcttcacttaccactactgctaccctattccctgcttcaggacttttggggtatcactttctacttctgtcttcattttctctaggcctacacactccaggctaatctcagagccaggagttgatcatcctcgagaacattcagggtttccctactgtcatggtcaacttttttctcagccccaaagctaagtctcatgatctgacaagtataattgtacttaaagcgaaagtaggttgagttttatcctcaaagtcatggtcactcacccccccccaccttttttttttttttttttttttttttacattatagcaccaaatgaattagctttatatttaagaccctttgtgatcttgccaggagcaagatcatattgcttgtcactagcctatcaggtcagatctcttctccagccaaactgaagtgaatagtggttactgctgacctaatcctgtcacatgtggtcttgcctctaagcttttgatacagtgttccctctgcctataatgcccttctcttgtttttactggtctgtgtcctgtagtgtcatcagagttgaattatgtcctactgcagcctagagatttcttcaaccagcctttgctccttcctatagcacttcatatctgaacctttcatttggcatttggcaaattaaatctttgatcttataaattttgttcttttagcagtaggtcataccttactccttataaagccttgaagggagaacctgctctgcataggcacaagataacaattggctgatggtaaagaaaggggagttggcagcggacaatgagatggggagtgttgtatgggttacgtgttgctgtgtaacaatctatgaccaaacttagtgtatcagcctgggtccaatcaagagagagaaatcgtacagtaatttgaacagggaaattttaatatcctaacttattacaacaggggattaaagtaacaaaaggaccttttagtaaggaataaagaatacatgaatagtagatgtaggagcagcccctacttctagggctgtggcttaagatagaacacccgaggaagagacatccctagcccccactaaagctgaaatccagaccttgttgaaaacacatcctatggctcaccagatggcagaaaagtcattgtactgtcatgagagtggaacttgccagaaatctgctctctaggatgccagggaaagttcttcacatggaggtgcctaaccaaaagctagaaaactgcctgagcaggggaaaccactgcccactgggtgctcctggcctctaagtactgcagaagcctgctagagaaggctagatgctagagaactcatgatgctgcaggagcctcatgctggagaagccaaggtgctgggtgctagagaagctgcaaaacctgcaggaggtggaagcactctgtttacactactgcccaaggtgggcagtgccaggagaagctgctagctgcttgtgctgctggtcattccaggcactgggcactggggaagatgcttgcactgcaggagcttgccaactgaacatactagaaccaggaagcaaaacctttccctccttcagtgtttctccagctctctccctcttaacaatttaaaacaccagtaagcatttatctctcacaggaattcagaagcctattagttggggggttctgattcggtcaagctatggttatggtcaaacttttggccaaggctgcagttatccaaaggcctgactggggctgaaggatccactttcaagatggctcttttatttggctgacaagttggtgctggctgttggcaagaggcctcagtttctctagtatgggcatctccacagggatgcttgagagccctcctgacatagcagctggcttcctctagagtgggtcatccaagagaaagcaaggcaaaagctgcaataattcttctgatttaacttcagaagttgaacattatcagtccactacatcctattcattagaaatgattcactgatccagcccacatgtaaggaaggaagacttaggctccacctttccttacattaaaaatttttttaaagattttatttatttattcatgagagacgtgcagagggagacgtgcaggactcaatcccaggaccccagggtcacgacttgagccaaaggcagatgctcaaccactgagccatccaggtgccccccccccgcccaatttttaaaatattattttctttataggtaggctccatggctaatgtgagcccaatatggggcttgatctcacgaccctgagtttaggacatgagctgaggggcagcctgggtggctcagcagtttagttccaccttcagcccagggtgtgatcctggagacctggaatcgagtccatgtcagtctccctgcatggattttgcttctccctctgcctgtgtctcttccccccatctctctgtctctcatgaataaataaataaaatcttaaaaaaaaaaaaaaaaagacatgagctgagatcaagagtcagacacttagggcagccctggtggcgcagtggtttagtgcctcctgcagcccagggtgtgatcttagagaccctggatcgagtcccgtgtcaggctgtctgcatggagcctgcttctccctctgcctgtgtctctgcctctcattctctctccgtgtctctatgaataaataaataaaatctttaaaataaaaaaaaaaagagtcagacacttaactgactgagccacccaagtgctccaggctctaccttttgaaggaagagtgacaaagaatttgtgaacatttaggaacctccacaggtggcattggtcaacaaggactaatggaacaccttctgtgtgctcagcagctagatgcatctgtctctccctacagaggttctctttcaaggagaagagaaatttcataactgatggttgccatcatctctcttcactcaggcttctttcagatagtcagcttgtttccttcttttgccttcaggcaattacatttccaaggaaatttccatctcttcagttgattccaagaagtcttcttagaagagaggggcttcattggatctctgaagaggagaggaggggagaggaaagagagggaggaactctccagggtgggaaacgtttggcacttgctacagtttctctgctgatgagtaagagatttcaaaatgaatgagcaagaagcaaacaaataataataaaaaaagagaaatgtggtttcttaaaatagtttatgtattgttgtttgagaagcagtggcctagatacatacaatagagtaagatgggggaaggaaagcagagaatttaaccaaaagggataccaatcagtttctctcagatgggactatggtagaggctggcttgctggtaggtgactttagccagacccctaattacaagatgagaacttcagctgtccccgcaagatgacttccagcaggatcccagcacagtattctcaactgagcaaaagggcctggaggccatggatttgtcctaagacttaaaacagagcctttccttctctctcaactcaccaccaactgctccctgagcccaaagcaataacttcagagttgctgttatgagtgaagaaacagaagagagaaatcgatttatcttttgtgaaataggaatcctcttatcatcagcaaatatgacttttatgcctctctaataataatagatggcaagtgtggtagacagccaccttctctttttttaaagatttttatgtatctattcatgggagacacagagggagaggcagagacacaggcagagagagaagcaggctccatgcagggagcctgatgtgggactcgatcccaggaccgtaggatcacaacctgagtcgaaggcagatgctcaccactgagcaaccccggtgcctctggtagacagcattctaaaatgaccccatgactcccacttcctaaatataccttgtgtaatctgcacccccccttgaatgtgacctggacctagggacttgcttctaccaatagaagatggcaaaggaagagattgtttttattttttttaaagattttatttgagagtaagagagagagagagaaagcactaacagagggaagggcagagggaaagggagaagcagattccttgctgagcagggagcctgatgcaggacttgatcccagggtcctgggatcatgaccttagccaaagccttaggtgcttaaccaactgagccacccagatgccctgagactgttaattttaagggtagattacaaaaaactatgacttccatcttgcttccattttcttttgcctttcacgtgctcatgctcatggagacagctgccatgccacaatctgtcctatggagagatctatgtggccaggaacccaggcaggactcaggccaaagcctgtgaagaactgagataatcagtctaacagccttcaaagaaccaaaacctgccacccaccacctgaggaagcttggaagcagatccaccctgttcaagcctgaagatgaccgaggcccaagctaacaccttgactgcagccttgtgagaaacccagagccagaggacccagttacaatgtgactggattcctgacatgcagagactgtaaaataagaaatgatgtgaagccactaagatttggggtacttcgttatgccacagtaagtaacagatacaacaaatgactgttgcatggtccagtcactgggtctgttctcttctttcagaatgagaacaaaaaatctgcaacactacactcaagtgtgggagcttaatgtccctgatccctgcccacaagaaactatagccatttgaatgtcctggaacatgatacagtttcctttgagaggaataagaagtgagtggagagagagctttcctctgccatgacacctgaccctcctaagtcaaaagataaatcaacaccccagcctgggaggtcccctttactctctgctgtcttcctctcctctcaaccctctgcctcagggcttctcagtcattaccaccttaaaacacctcttttccttgagttgggccagggagtcccatagccaaaattacgtgatgcatgtctttccttaaaggaaaaacttaagtgaatagatatttttctcctaagtgtttggcatttgctacagcttatctgctgatgagtaagagatttcaaaatgaatgtgaacagagcaaacaaataataatagaaaagcagaaatatgatttcttaaaatagtttatgtattgttgtctgagaagcagtgacctagatacatacaatagagtgagaagagggaaggaaggcagagaaagagagcagagttcatgaacttggattacatcttttgccatttcctggtgttctatagagagcacgagaaggtccaagtggccagagcaagtgtgagaacctcagctacttccaagggagtgaacaaattcctcagatttgaccccaggattatgctcgcttcagcagcacatatactaaaattgaccccaggatggaacctcaggagaaattccctgaggctgtaggtaccccagatcacattattggaaggtgggaaagaggtgctacgtaatgaatcctgttttctaaggctggaaaccatccaggctaactgcagtgctctggtgacatcttctgatcacaaggctggcaaatatttattgtttccaaggtgcgtaaatgtgggcagtgtgtttggcccagccctgtcagtctgagatgacaaagaatggcaaaggtaaatgaatcctcactgtagagcctctccattctcatatcaccctgggtacttgtattctgggggatgctggagtccaatgtgagtccaggaggcagagagggtgtggtatagagattgcatgattaaggagattacagataggactcttggacacaaatgggaaagcacctcgtggaattagaaagcatacacctaggcaaacacactgtgcctcaatttttttttttttttttttgtgggtcacatagctgcctagaatagacactacatttcccagcttctacatggccactacatggccagctaggcttggccatgtgactatgactggccaatggaatgaaagagttcttttttttttttttttaagattttattcacttattcatagagatagagagagagagagagaggcagagacacgggcagagggagaagcaggctccatgcagggagcctgacgtgggacttgatcctgggtctccgggatcacgccctggactgaagtcggcactaaaccgctgagccacccaggctgcctggaatggaagagttcttaaaggaaaattcagaccctttctttccccatcttccattatgctgcctgaaacaggaacagcttggtaagcaatctgggaccttgctgattacaacaatacctgtagatgccagaccagcctgggccactgaggcttggagctgccctatcagccctggactatgtatgcttggaatgttacatgaaagaaaaataaacctctgtcttatattaagccgtttattttgcagtttaaaaaaataggctgggatccctgggtggcgcagcggtttggcgcctgcctttggctcaggccgcgatcctggagacccgggatcgaatcccacgccaggctcccagtgcatggagcctgcttctctctctgcctgtgtctctgcctctctctctctctctctctctgagtgtgactatcgtaaataaataaattaaaaaaaatcaaaataaaaaaataaaaaaataggctatacagggcagcctgggttgttcagcggttgagcactgccttcagcccagggtgtgatcctggagactcgggatcgagtcccacatcaggctccttgcctgcttctccctctgcctgtgtctctgcctctctgtgtttctcatgaataaaaaaaaaaaaaaacagaacaccgaaagcatgatgaacaagaaaaaattggaaaactgaaaattaaaaacttgtgctctgtgacagacactgttaagagatgaaaagacaaagcacaagctttgcagaacacatacctgataaagaaccagtatccttgggcagcccgggtggcttagcggtttagcgccgccttcggcccaggacctggtcctggagaccctggattgagtcccacatcaggctccctgcatggagcctgattctccctctgccgctctctctctctctctctctctctgtgcctcttatgaataaataaataaaatcttttttaaaaaataggctatacctatttgtatgtcctgtagccctgtcttgctaaatgagattacactattagtgatttgttttacaatttacttattaaatagacagttattgaactttgagtgttcttattgtagcctcttaaataagaggtgacaggtgagcacagagccagctaccagaggagagagtgagtttggtccatcatggaatacagaaaggggaggtgagctcatctatctgcctgtctttcccagaaccatctcttgccttggtttccgcaaatggcagattacatcttttgtctgtgaagcaactggttttagggagaggaactatgattaccatggaagtctgcaggcaatgagcaagttcaggttacagtgagcaaggcggttaatggcacagagcagagggagcaatcacttttgattgttgctagaacaaagtgacaaagcagcttccactgccctttctgagagtgaaccaggatgggtgcataaaaatagtgcagttggtaagcgggcaggctgtggggcgtggaacttccccaccaaattgccagagaggaaaaaccctgaccatcaaattgatgatttttaaaaacctgacatattaaatatatatgagagagaagtatagaaataaaaggcattatgttggcattcaaagtgatgtgcagctgtaaaaatggaaaagttttcagactttttccattcagacagggagtagaaacctaccttcacaccatccaggtaacctgtgccactttcagacattttgtcgctgttagggggtttgctgtcgattggcttgtttagcttctgtgctgtcctctgatgtgccttcttgtatagctgggctggaaaacgaaatgttagatggtcacactcaggactccagatgtgatttaggtatcactgatcatatgcactgcccaagaagtgatgtgaatggagttaagtggagcagaggaatttgtgtgagaggcattctttttttaggctagagaagatatagcagacacagacaataattttgatagcagctccctgatcctgagatcacagctaaagtgtgtgttcttggtgccaaaggttgcagtgatggcctcctgactcctaccttccggatactgactgaggcagtagcttccctggcagctcagttctgcagggtttttagggtttctttctttttttttttttaaagatttaatttatttatttattcatgagagagagcgagaaagggagagagagagagagagacaggcagagcgagaagcaggcttcatgcagggagcccgatgtgggacttgatcccgggactccaggatcatgccctgagccaatggcatgcactaaactgctgagccacgcagggatccccgtttttagggtttcattcctggaggttcaggctggatctcattcctctcctccagtcctttcagtgacttcgtaagccccaaactatctgtattacattcctttctgcttagaataagtacagtggtgtctgttatctgcaactgcagcctggtgataaactgcctaacatacatagaacaagtgtcacaaaatgtttgttgaatgaacgaatcaatgggcaaatgaagactgaaaatgcattgatggacaaatagagactaagagtgaattaatgggcaaatgtttgttgaatgaatgaatcggtgggcaaatggggactgagactggtctgcaatgagttgggactcaatagaattcagtgtgactcaatagaatggtgaaagcaatttggtggattctaactaacatttttaaagattgtatttattttatttatttgagagagagagagagtgcgcacctgagtgggggaaggggcagagggtaaaggaccaggagagagaaagaatcccaagtggactccacactgagtacagagcctgatgtggggctccatctcacaaccttgagctgaaaccaagagtagaatacttagctgactgagccacccaggtgccccctaaccaacattcttaaaagatggaatacaataaataatctcagaacaggttgcatgtagtatatgtaagtattattttgtgaaactttagttgcacacacaaacacacattatgaatgtgtacatgcacacgcacattcacagtggtggtaatccaaatattcaaccatcagcatgacacagacatcaactgattggaatggatgccaacaatatctactggttgtctgaataccaatataaagtgtatctctgggcagcccgggtggctcagcggtttaacacctgccttcggcccagggcctgatcctggaatcctgggatcaagttccgcgtcgggctccctgcatggagcctgcttctccctctgcctgtgtctctacctctgtgtgtgtgtgtgtgtctcatgaataaataaataaaatctttaaaaaatgtatctcttttagtcgaaaaaagtgaaattctttggtctgttgtagcttaatgcttttagaggatgggaggcagtgagcacatatttctaagcacccttcctttggcattgtccctggccaaagaaacatgtccatgactcactcctgcccccaggggagcctttcctggatctagagcaatcctcatgtgtcataacttgggatattctagatagctgtgtttctgcccaccaacatccatcttcatttgtcaggaaccagcaatcccccatctccctactgccaccaccagcccagctgtccattaaggagccacctcaactggcttaccctcatgaccctgcaagtttcccatagcattgactgctctgactccactatgtccttccacaagcagacagcctgtcctcattgtgctctgctcattgttacctccaaatctttgctcactctggactcttacttggaaggtctttattcgcagcttgcctgaatcttagtctctcttcaagactttgaaaaagagcactgccccctcctgctggcatccagggctgtgctgggcattctacataggaccttggtgtctccaccccttcacctccaaatatttcctgctgcccatcttctctaggaagctatggtgtctccacatctcaaactctttcaggcacctacttactcatcaatctccccagattactttgagaggaatcccttcaggaatgaattgagtaacagacagtttctaccacatgagttttctccagaactttattttgtattttcacaagctgatataacttctggggcacctcagtggttcagtcagttgagcctccgactcttggtttcagctcaggtcatgatcttgtggtcatgagatcaagcctcacaccaggctctgcgctcagcacagagtctgcttcagatttttctctccctctccctccagctgtctctctcaaataaatgaaatctttttttaaaaaaaaagattttatttttatttattcatagagatgcagagagagagagagagaggggcagagacacaggcagagggagaagcaggctccacgcagagagcctgacgcgggacctgatccagggtctccaggatcacacccttggctgcaggcggcgctaaaccgctgtgccaccagggctgcccataaataaaatctttaaaaggaaaaaggcttccaaaaaactttggggactgacagcatttacatattaacaacatgtgtataacagccacgtaacaacagggcaaactgaacaaaactaccattgtattattgccattgtttcataaaaatatatttgaacaccaaaaaaaaataggaagggcataatttcagaacaaagaatcattctttaaatttatctttaaaaaaccctacattacccttaatttttatagcaaaaatagaccagtgagaacattgtcatggaaaccaccagaaaggtgcagaagagactggagaatgtcagaggagggaagatgaggggcagggaataggggccaggggggagatcacagaggtcccccagtgaagtattcccctgccctgaactgactcgtattctcctctggggcggctgtgtttgggccctggccaatacacaaggctgtggccacattcactggtcaggtgcccagcgaccactcccacacccctggccctggccaccctggtgatcgggttcccacccccttcatgctgcacaggtgtcctggatgcatgcctgtgaccagcaccagctggattggggagacaagcccctggaacaggagaaacagtgcgggacctgtagtcaagagcctggcgtcttggcctggctctgttgcatcacttgtggacgtctgccttttctgggcctccgtgtcctcaccttaaaatgaaggttctgaatcagtcttaagtcatttctgaggaagactttaaaaaaaattttttttaagtcgtgcacattatgacttgaatttcaggggctccaccctcccctccaggccttccacgaacttcccaggggccctcggaccccagatgaagaatcccaccttgccagtcttgacacacagctgccgacctcttgcctccaaatctgccctttcctgtgcagttaacagtattttccagttatctaatacccacaagggcacaagcaaatatgtcagggaaggagggaactctgtaggaagaattattagtgcctgggcatcccctctagtgcatggtggagctgggagagacggtgagctttgtggatgggttgctgcccagagcagcagaccaccgatgtgaagagagctgtagaccatggctcctggaaggagaggacacagtgataacaggagtccttccctgagagcaaggcccctggccaccacagcagtgtgggacagtggtaagagcttgggctcaatagctagaatgtcctgcatttatatgtggctctgcgacctaattgtgttatttggacaggttactgtgccttgagttttgggggtcctcatctgttaaaatgaggatatgggttatgcagcagaggggcacatgggtggctcagttggttaagcgtctgcctttggcttgagtcatgatcctggagtcccaggatggagccccacatcaggctctctgctcaaggtgggtggggggtggtctgcttctccctctgttccccatcctgcttctgctctctctcgtgtactctctctttctcaaataaataaataaaagctttaaaaaaaaatgtcatgcagcagaaatgatagaacatactgaatgttctgggactcccttgaattttccagcctccctcgcagaaggttgggtcatgtgactagttgtggctaatggtctgtgagtggaagaggcatgtgtccctcctggctgaggcattaatgtgtctgtgtacttcctccatctgtctcctccatcttccagaatgaccctggaggccagtcttccagatggtgtgactacaagatggaagaaaggtcttctgtttcgtatcagattttacatgagtagtaaataagattttattttgccaaactgccaaaatttcaggagctctctgttgtgacagctagtattaattaccctaatatagagagctgattgagatgatggatcccaagccctctgagtacagtggaggtgttattctcagagaaaagacttaagactcctatattagtcagcccggctgccataacaaaatatcacggattgagtagcttaaatgagagagatgtatttctcagagttctgaaacctggaaccccaaaatcagggtgtcagcatgattgggttctggtgaaagccctcttcttggcttgtagatggctgcattttgtgctttgccctcatatggcagagagaaagagacagcaagctctctggtctctctatctctcttttaagtaatttctacgcccagggtggggctcaaactcacaaccctgagatcaagagcagcatggtccaccaagtgagccagccaggtgtccctctggtgtctcctcctatgagggcactaaaccccttaggagagaaccctcatgacctcatctaaacctaaagttcccaaagttcccatctccatatgtatcatcacattgcagggcagggcctcaacatctgaatttggtagggggtacaattaagtctgtaatacccccttaacccagggtttctcacatctcctcttaagagcaaaatttttttaaaagatatatttattttagagagggagagagaacaagaagggggagggacagagggagatggggagagagaatctcaaatggaccccacactgagcagggagtcccatgcagggctcaatctcaccaccctgagatcatgacctgagccagaatcaagagtgggacacctaaaccatggagccacccaggcgccccaggagcaatttttttcttttaagattttatttatttattcatgagaaacacagagaggagagagagaggcagagacacaggcagagggagaggcaggccccatgcagggagcccgacgtgggacttgatccagggtctccaggatcacgccctgggctgaaggtggcgctaaaccgctctgccaccccagctgcccccaagagcaaatttttgtaaaaagcagaggcaggcaagggcgaggtgaggtgaagttttcatggagagggacatcctgaggaaggctgcctcccccaccattccactgttagcctcatgacgcagtcccttaaaccccgtttccctctgagtcttttttcctttcttccattgtctgcacatcctgactttcataagattcacagacaaacccttagacaattaattgactcatcaagactagacaattcctaggtcttcaaggccatcttgtttcacctcctgattctttttttttttttttttttaaagattttatttagttattcatgggagacacagagagagaggcagagacacaggcagagggagaagcaggctccatgcagggagcccaatgcgggacttgattctgggacctggggatcatgccctgaacctaaggcagatgctcaactactgagccacccagggtccctctcctcctgattcttcccactgacaagactggacctggaagcaccaggcctcagaagcaccagacgccggggctggcttctccaaaagataaggggtagggggcagtctggggcaccagggacagagagacaggagaggatcagactattaaggacgaagctgactttcatttcagtatatcgacttcacataatttttcaaaacaaaattttattccacgagtggttttcccccctaatttgaaagtaatgcatttggggccccctgggccccctaaaatgtgtgatccagcctgtccaaggcttgaatcagggtatcacgggagctgccctccttatgccattgcttccaggacctgggagaatcctgtctgctgcctgcgctgcagagcagcctgtgaccattaacttcttcaccctccacccccggcccagggcgggcacctggggccccgggtcacgtgccaggcaaggggtttgtccctggggcccctccggccccaccagagccaggatcctcggtgcccaggctcatggccatggcccttgtgctcctcgcgggggttctgctcccttgcccaggcgagttcctgccctttaaaaagaggttcatgaaggtgagccaaaagagcatttcgaaccttccactgtagtcgccttagaccagccaggaggcactggttgggtttggagagctgagtagggggtggggacttgttcccagggctggaagcttactgagtcccccaaagggcttcagagccctgctgcttcacctgcctggtggccccggaggtgaaagaaagtggccttatgaccagcaccaagccccccctcccctgagccgagcccaccccaggctgtctcagacctgccccccagcccggccttaccaacctgccctaatctctcttccccctctcctgagcaatcgctcttcattcccttccccatctttctgtccctccctttcttcccaccactcctaccaagtgtgaactgggggtatagagcatagagggagcccaggaaaaggagagacacaggcaaagtactgacccccccccttcctctcctgggtcaggtgcagggcagggggtggcccctggtggccaccatctcatggcctctcttcccggaccccaggggcctagcaacgtcccaggtcctccctccccttcccatgcagccagagagctggtggcaccagagttgtccccacaggtgaacggagtggagtgctcccaccactccgagtgcgtcagtgactgctgcctaatgaacctggaccacggaggcgccttctgtgcccccaaggccagaatagccatgttgtgcctgttccaggtgaggctctgggctggggcagccagctctggcctgaagggtgggggaggctaaacaggcctctggggctgccctctgctttctcaccctctgcttggagtgccctcaccccttcctcacccggccactcctactcatcttgcagcacaattctggttgcctcttctgggaagcctgcagctcccactctcagcacagcctggattgccccagtcttccgtgggtgccgtccagagcatgagctggctggagcttgcccagggcaggcttgcagcatggccatctttgaaccccctacctccaacttagtatctgcacacagtaggtgatcactgaacgtttgttgaatgaatatctcaaccctgacatcactgaggcaaaggagatgggaaaagaccttttccctaccagtccccacctccctctctctcttttttttaaagattttatttatttattcatgagagacacagagggagaggcaggccgcctcgtggaccccgatgtgggacctgatcccaggaccccgggatcacatcctgagccaatgacagacgctcaaccactgagccacccaggtgacccacctccaattttttgagaagagcctggcactgaggcagcagggaccagagcttgggagtaggacctgaggtttttttgttttttcctaaaggttttatttatttatttattcatgagcaacacagagaggcagagacacaggcagagggagaagcaggctcccctcagggagcccgatgcgggactcgatccccgaaacaggatcatgcccagagctgaaggcagacacccaatcgctgagccacccaggcatcccaatgccctgagtttaaatcctggattttccatcccctgtctctgtgacttcagccaggtcacttctgctctttgagccttagtttcctcacctgtaagatggtgctaaagtgacaacctcaccaatattgtcctggcaacgacagtgcccatccgggcttggttctgagctgatagaaatgcagaacgcatagtatgggtcgttactcctcttcctttcttatctggccctgggcccaaacctttctaggaagaatgggctcggcctccacttccttgtctggggagctgccgatggcctgactgtacagctggggtggccagagggtcttttcatgatgggccctggatctattttattcagtcctcatggtcaccccatgaggcaggttactattgccacccccatttgacggatgaggagactgagaccaagaactcactaacttgcctaaggtcatagagctatccactgtacagctgagagcccccaggctcctgctccccgagaggtgtaaacccccttcttccctgtaccttggtgactcccacctctcgttcacatttcccacagaccaaaggagccctcaacgtcatatgcccctgccaaagcggcttgagttgcatatccaaggacccaatctgttcccgccgttgccatttgatttagaggaggatccaggctggtcgctgccaccccaccctccctcagtcccttggggccagaggcctggagagccctgtcttgctcacattccagctcctgagacattaaagtcacttcctggctctggcctctgtttgcactttctgggagaggatacctgggagggattattctagtccggggtggaaagtttggctctatctagaggcctggtggtcttgggaccgagttgcaggaaggggatgggataagggtagtgagcgaagaggctgggtcccgggaaggtgtggagggctggctgtatgggaagggtagggttggggaatatggctggaaggtgtatgttggggtgcccatggatgggttatatggtaggaaggactggaagggaatattgaaatgctttccaaggggagcagagggtggagatcattgagagaatgttatgagaaggtgtgtaaagtgtgtaaagtataaatgcaaaaatgttcaagcctgtggtgggaaagacctggtgctttcgggtctccactctcccagattttttttcaagattttatttatttgagagagagagcatgagcagggggagggacagagggagagggagagcagattccccgctgaggagggagcctgacgtggggctcgatcccaggaccctgagatcatgacctgagccaaaaggtagacgcttaactgactgagccacccagatgtccctccactctctcagatattatcggttccattttacgagtaaagaaactgaggctcgggcagcccgggtggctcagcagtttagcgccgccttcagcctagggcgtgatcctggacaccagggatcaaatcccacgtcgggctccctgcatgaagcctgcttctccctctgcctgtgtctctgcctctctctctctctctctctctctctctgtgtctctcatgaataaataaataaataaataatcttaaaaaaaaagaaactgaggctcagagagctacatgactcccaaggtcacgccttaggcatgatgcttaaccgctgagccacccacagattccctaaatgctttcttatctatattaattcatgttattgttacagcaagtttagagtaggtactataattatccctattttacaaatggggggcacctggctggctcagtcaggaaaatatgcaacccttcatatcagggccatgagttcgagccccatgttgggtgtaaagatcactaaacaaaataagcaaataaacctattttacaaatagggtattgagtacccttctcatgatttcagaataaaggatggggctgggatctgaacccaggctgtcttgttctagaggacaggatcttatttatttattatttattttaaagattttatttatttacttatgagagacacacagagagagaggcagagacacacgcagagggagaagcaggctccctgcagggggactcgatcccaggaccccaggatcacgacctgagccaaaggcagacgctcaaccgctgagccccccaggcgtccccaaagtctttgcctcattttattgtggaccatgtcttgctcaaccatttctctatgggtagccattaggaacatttcccaatccaaaccatccattcaagatacaagttcttggctaaggacacaaaaacctgctgtaaagatagctcaaacaaagtagatgacttctcctgcacctgctggtggaagaggcaggacgagggctctgctggttgaggttgtccttgtgctcaccaccttctagcttcctgctcagccatctgctgctctcctctccatcctccttctctgtcctcccctccttcctcatttgtttctttgttgcattacaggagttaatatgcagattcagaggcattatttttctgcatctggacattcaaatattactatgttcctcacatggaagttttagaggaataatcctaatgctgagaagaccaaagctccaggtcaccttcatttaaccaaatcattttcttcccatctgatcagccttttctctgcccagacacggctctcatctctcagaagccttatttctaaggtgaggtctctacccccataggttcctcctttttttccaatgcaagacaacagacaatgttatgagttcaagtcccatttcattttcttcaccattggcaccagaaggcctgccttcctacaggtagcttgggctgtgtgaatatttctagccagcaaagtgacaggtgtgacttctaggcctaagcagagaagcccaagtgtgacacattggaaaggaagtctccatttttggtgactgggcaatgacagcttttaagccctcactccccttctgcgccacatctaggcaagtccatataaaggtacacactctccttggtgctggtgggctgtgcagaccacatgcccccagcctgcccagggaaaccctcactctggccccaatgcttagccacagtaaaaacagccaaagccacacaccccttcatccttgctactcacacctcctcgcacctgccctgctgtcctgggaacgttcctgtgttcgactaataaatcttttcatatcatcttgttatgtgtatgatcagtcccaacatctgaaccaattttgtttggtggttggttggttggttggttaagattttattgattgattgatgagagacacacagagagaggcaaagacacaggcagggggagaagcaggcaccctgaagggaacccgatgcaggactcaggatcccaggatcccgggatcacgtcctgagttgaaggcagacgctcaaccactgagccaccctggcatcccccaaaccaattttggatgagagttgatttccccctccatgaagcacccacaaaagctttgagttcctagttctctcttgccacagccagaccgtcagatgaggtggtgggtgggtggctgggtggtgcctggatcactagagtcacccatgaaggacggtttaccccagagagtgtcctgattctgtacctcctcctaacccctctcccccactgcatgcactctctccttctcaaagaaaaagaaaaagaaaaagaaaaagaaaaaaaattctaattgaagatctctggggaaagagagtggaaagatgaaaactagaacctaattgttacttgatagctctgtgacttttggggaagtttggcaacttctctggggctcagtcacctcatctgagaaaatattcatgatgctgtttattaatcataatatacaatcagggggagcctgggtggctcagtcggttgagtcttccgcttgggtcatgatcctggagtcctgggatggagtccccgcattgggctccctgctcagcggggagtctgcttctccctctccctctgcccctgcttgtgctccctcattctctctctctctccccccccccgctaaataaataaataaatagatagataaataaataaatatttggaaaaaatgagctctattaaaaataataataataacatacaatcgaattacacgaaagaatcttttcaaatccctggaactcggagacctttgaattctagagctaatgagatccgctgccacatgtggctagtgatcatcaaatgggaacatgcagaaaaagcacatttttgcattggtgcaagtcctgtgggacagctgttctggaatgtcagctcccgcagggcaggcatttctgggcatttctgttccttttgctcccagctgtgttcccagggcccggaacgctgcctggactcagtgggtgctctggtgctacttgctgactactgggctcgtctgacagagacgatggcggcagtgacagatcgtgtgacctcctaagacgcagcattggggatcaggacgtgtgtgagtgtcggggaggagggagcccggaggtgacaagcaggctccgctttaaggtgaataggagtttgcagagacagggtcgggccgcggagggaaccgccgggagcagacaggaaggcctggctcggccggtgcgtgcgagagaagtcacctgtttgggtgccacgaatggcaaacctgccacatctctctagtcccctcgggcaccagctcccgagcgcccggcccgggcgagggcgagggcgagggcgagggcgcagcgcggcgagcgcgggcagccgcaggggccgggaccagggcgccgtctccccgcaggacgcccgggagctcggcccccagcgcaagccgcgcaggagccagggctgccgccgggcgcacgaggacagcacgtgtcacagcccggggagggggtccccaggaaggagggagggggacccagaacccgacggagcagggggaggggaggggagcggccagccccggagccggaatgcgcgctgcgactgcacgtcccagacgcctgggggagcccgaggaccggcccaaggtggggaccgcccccaaaggctgggaaccccaggtggggggcggggcttttctttcgaatgtgggttccggctcgggctctcgagaggtcatctcagcaaacttcgaaagttgccttgtaagtgggcacagctagagggtcggctcccagcgtggttcccggccctccctcctcagcagccccagggcttcggctgtggctccaggtcagggggtgcgcaggagacgggagctggtttgcccgctgaaggacttaaggagaaaaggcggaagccgcctgggagtgggtgttcattccctcaggataggcacatgggttcaggacgtgaaaagtgatgccagagattaaactaggaggagggcaccaacaatcctagggggcagcctggaggaggcaaccagaatgaactgtgtctgagggggtcccttcagctcaggctcctctgctgtgtgcaagcagatgggccccagaactagactgggctgggagtgggggctgccccttaagggctgagggcaaagcaacccccaaggggaaggtcaaagtcctgtctttcccagacattcttgcacctggataacgagttgttcctgtctgctggacctgatttgggtatttctgaagaatgagaaatcatttaaaatcatctgtggctgttgtaagaaaacaggaggagggggaggggaggggaggagagggaggaggaggagggggaggagaagtagtcagctaagaacattttcttctaatgctctctctttgttgcctccccctcctccatccactcccactggagatgcaggttgaaatgggctgtacacaggttgctggggcatgtgtgtgtgtgtgtgtgtgtgtgtgtgggtgtgtgtgtgaagggtcagagaggcaggaagcttaggcttgggcctttcctctgttggggcatgaatgaaagtctcccagagacttgtgctcccctccccaccctgatgggcttcagcccattccataatccaccctccaaaagctcagtttgcacctgaactcttggttcccctgaccttaaatatcagaaatgttaaagaaaatgtacaagacagggacacctaggtggctcagtggtttggcacctgccttcggccctggacgtgatccccggggtcctgggatccagtcccgcatcaagtcccgcatcaggctccctgtgtggaacctgcttctccctctgcctgtgtctctgcctctgtctctctgtgtctctcatgaataaataaaatctttttttaaaaaaagttgaagacaaatgtgtataacagttgccagtctcaatccatagagcgtgcaacgcttgagctccatccaggttatgagtatgagccccacattagatgtagagattattttatttatttatttatttttattattttttagattattttaaataaatagagtgttatggagcatttactatatgccaggggcagcactagatgctttacatgaatgatctcacttaatcctacaaaaatccttatgaggggtcagagctattatcacccctatttgagagagggaaaattgagatggattgagcaatttgctcctagtcacacagcttgaaagtgatgaattgggctcttctgggacaccagaagagaaaggaggtatgaggcagaaggaaagagcttaaggaaaagaaagaatgcagcacctcctatgctggggggaaatccggggagagcatgaatcaagaggagttttgggaagttgtgcataggctgggaggcttttagagccagatgctagtttactggctgtgtgtcgtgagttttcagcagaagcaggtttcaaggcagccctgctataatcggattacatttagagataaataattcagattttgacccaaagttccatactcagctatacttctgattaagtgagccctcagtcctgagccaaatgtgccctccaggatgacgggcttattgtgcaagagctcaggagttgagatagaagctgaggtttacttagagcaccccctgtaagtcttaatgacactgtaacccatgtcttggtagaaattgcttctgtactaaatgtgtcagacagatacttggtgttacatgcacatcagaaagatacagggtgggatcactgggtggcgcagcggtttgacgcctgcctttggcccagggcgcgatcctggagacccgggatcgaatcccacatcgggctcccggtgcatggagcctgcttctccctctgcctgtgtctctgcctctctctctctctctctctctctctctgtgactatcataaataaataaattaaaaagaagaaagaaaaagaaagaaagaaagatagatacagggttacagtccatagtggtacaggagctcccctcatttggagaaagtctacaaaatgcccttggaaagagagattgcaggctggaaacccagcctccaaaaatacctgatgccttcaaatttagaaggggaggggaagatatgttgctgatacaattaaactggcttcatgtgatgggaggaaaacttttcctctactctcttaggttcagtttttggggtctgcaaattaaacggacacaagatagcttggcaagagaaaagacagttgttttattagttaattagtttgtttgtttgggggggggaggagggggagggagacaagcagactctccactgagcaggaaacctgatgtggggctatatcctaggattcagagattatgacctgagccaaaatcaacagttggacatttaagcaacggaaccacccaggtgccccaagtcagatttttattcacatacatatgtggagggaattcacagaaaaaggtgactcaatgaggcaattggaatttggggcatatacgccaccttaattgggggaggggaatgggagaaggacactttggaaaatggcttaatagggggagggatgggaagaaggggcatgtaggaaaaagcaaattatttttaagaaagctaaatgggaccttaggagagtagatgggtccttaggagagtacgtgatagttttgtgacaatgtagtgctgacatccaccaatggtaagactccagtgagaagagtcaatctttcctggttgcaagaaacctctccaggagggaatttatgatggttgaattctttggggaggctctgcttttaggcagataagaagttttagaaaaaagccaattctcaaatgccttcagcttacagtagcagcactattcagtggaagtgaaacatgagacacataagtaattttaaattttctattagccataattcaaatttgataatgtattttattttttaaaattctttaagtttaatttagttaacatatactgtattattagtttcaggggtcgaatttagtgattcatcagttatacgtagcacccaatgctcattccatcaagtgccctccttaatgatcatcaccccgttatcccatccccccacccacctcccttccagtttcctcaggttgtttcctagagttaagtcttttatggttatcttcctctcttttcatcttattttatttttccttcctttcctctgtgttcatcttttgtttcttaaattccacgagtgatggggatcactgggtggctcagcggtttagcgcctgcctttggcccagggtgtgatcctgaagtcccaggatcgagtcctacattgggctcccagtatggagcctgcttctgcctcctcctttgtctctacctctctctctctctatgtctatcataaatcaatcaataaataaatagtaacagactttaaaaaaaattccacgagtgaaatcatgtgatattgtctttctctgactgacttatttcacttagcctaataccctctcattccatccatgtcacaaatggcaagatttcgttctttttgatggttgagtaatattccagtgtgtgtgtgtgtgtgtgtgtgtgtgtgtgtgtgtggtgtgtgtataccacatcttctttatccatttgtcttcagtggacatcaggactctttccatagtttggctattgtggatattgctgctataaacatggggttgcaggtgccccatcaaatctctatgtttggggcagccctggtggtggttcagcggtttagcaccaccttcagaccagggcgtgatcccgggggtcctggaatcaagtcccacgtcgggctccctgcatggggcctgcttctttctctgcttgtgtctctgcctctctctctctctccatgaatacataaataaaatcttttttaaaaatccctatgtttgtatcctttggatgaatacccagtagtgcaattgctaagtcatagcataatatattttatttgtaacccaatcaaaaatggtatttcaggatgcctgagtggctcagcggtttagcacctgcctttggcccagaatgtgatcctggaaacctgggatcgagtcccacgtcgggctccctgcgtggagtctgcttctccctctgcctgtgtccctgactctctgtgtgtctctcctgaataaataaaatcttttaaaaaaaagttatttcaaaatggaaaatacttgagatatttcatattcttttttattggtaataggttttacaaacccaatttgtatttttacacttatcccaattcaagtcagccacacatcaagtgctcaatatgtggctagtcgataccatattagacagcatatgtctacaaggtccagaattaggaattttttatggattcaagcctgcagatactcctgcctgcttctatttctagcagatctagaaaaaaagtcacagaaagtggggagcccctgggattaggatattaaagaggcacatgtcactggcaaagctaaaacttataggacattttttcatagagaaaaagtgcatgtggaggatggggtggggagtggggagggacagagggagaggacagagagaaccttaagcagtctccagtgtggagcctgacttggggctcagtctcacaaccttgagatcatgacatgagctaaaattaaataggacacttaacccagccacccaggtgctccctgcagaggacatctttgggaattagaaaatgatgattcctggggcgcctgggtgtctcagctggttaagtgtctgcctttagctcaggtcatgatctcagggtcctgggaccgagccctggcatctggctccctgctcaatggggagtctgcttctccctctccccaacccccacacgtgctctctcttgctctctctctctctctcaaataaataaaatcttaaaaaggaaaagaaagaaaatgatgacccgtcttggctacagacagtgagagaaggtgcttttgaacaacagcaacacaacaagagatgctccccttctggcagtcttgtattagtgtcagtgcagaaaaacaagaaccactccagggggttcaagtagaaaggatttaatacagggaacagggggttggggtctttgctgctggcttccacagagcccagctccccaacagccattgcgcgccttccttgcgaaccaaaccccagtactgtttggacagtaggtgtccagcccgaggagaaggatcacgttagtccaagccggtcatggccgtcccattccctttgcccagcacttgctttcccagacccccttgtggccgtgggtggtcatatgacccggttggagccattgggataaggagtcagcctggaggggcagcccggggggcgcagcggtttaggtttagcgccgccttcagctgaaccagggcgtgatcctggagtcccgggatcgagtcccacgtcaggctccctgcgtggagcctgcttctccctctgcctgtgtgtctctcacgaataaataaactaaactaaaaaacaaaacaaaaaaaaaagcccggaggctttcgcaagataagatggcctgccctaagcgcccagcctctactccacgcttcttaccttagaatacttagaatagggggagacaagatgacactcccaggagctgctgggaaggcagctgccagttgagaggaggcacgagaacggcaggtctgccagcagccaaacaaatgccagcacttgctatctccagacttcttgattcgtgagaaatgtgtgtccctagttatttaagccatcattacatggttttttgttacattcaggtaaatccagtcctaactcagaaacctaatggttgggatccctgggtggcgcagcggtttggcgcctgcctttggcccagggcgcgatcctggagacccgggattgaatcccacgtcgggctcccggtgcatggagcctgcttctccctctgcctgtgtctctgcctctctctctctctcactgtgtgcctatcatgaataaaaaaaaaaaaaaaaaaaaaaaaaaaaaaaaaaaaaaaaacctaatggttactctagggaggcattgatcaccaaccacaaaatcctgggctgggagagcatctcgattttaattaattcactctcttccttctttgcatgaatctcctctcctgcatctccactaaggggcagtggacgtccacctgcttatctcagtgatggggacttcagtcctgcccaaagcaatccaggtttgatggctccaggggatataaaattatatatatatatataaaatttttaaagattttatttatttattcatgagacacacacacacacacacacacacacacacacacacacacacagaaacacaggcagagggagaagcaggctgcacacagggagcctgatgtgggactcgatcccgggcccccaggatcacatgcagcactaaactgctgggccaccagggttgcccataaaattattatattaaaccaaaaccaaattccctacaattccacctatttgtcttagtatgactaattgggaaagaaccgggagttgtagaaagggtaaggggtggagttagatgggtgtagtgttaacattttctacttatgtgacattgagcaagttactgaacctctctgaactttagtttcttttatctagagacaataaattctccctcctgggtcactctgaggatttgctagcacagagtaagcccacagcaattgttagtggtctgtcctgttaacacatgggtcgtgtcaactagctggcacatctgagagttgggcccagaaagaaggtatgagcccaggccagggactggtaagcttgatgcagggcaggaatatgggccattctaactccccactagaagggtgcgcatgtgtgtgcacacacacgtgcacctgtctgagaactggaggggcaagtggggcatcccagggaggtgcggttggtcccccaatggagaggttcccagcatggctgcttcaaaaccttgtctccagtctgtccagcctcatcccgcctggtcccagacccatccgttcttcctctgacctgtttgacacctgccttgacgaggcgaaggcttgatgggacatcaaggaagacactgactcaagaacattctggagcccggggaaggttgcaggaagagctttaattgctgagaatccaatcagaaaagggaggtgctggttaagggggtggccagccagggagaggtggtggatgaggagcatccttcagtggctttacttcttggagcgcccagcatcgtggcagacaccaaagttggtattggtgatggagcccacgatggacttgtcaccctcacaggtcaggccccgctcacagggacacttgtagtaaaccccatagagcgtcttcaaagacacagaaacagtggaatcacaggctgtcgcgggggtggggtgggggggctactttgggcatagcctgcccctcgctccccgcctcaccccgggccaggctcttttcagactgtcccctcctgactgccacgccagggggcgctgtgggcctggaggacgcccggcccaggttcccccactcggcttccttggtgcttactaactagatctccctggggagcctccagttacccatccgtgaaatgggaataacaaatctccgcccccacccacctcactggtcagtcgtgaggttcgaaagggccgagcggatggggcagtgcctggagcctgctgaccccctccctgacccgccccccagctgtgcctcgtgccccagcaccgcacggcccgcggcacccaccttggcagagcactcgctgttctcgctggccttgggtgcgcagcgggccaggctcagcccggtggcccggtggcagcacttgctcttgcactggacgctgttcagacagagctcgccgtcttcctgccgggcggccagttagcgagggccctcgccctttgtcccttcgccaccgccaccgcccacagcgcgtcccccgcgggggcgcgggtaaaggacccaacccgcggggctggcggccagtctgcccacccccagccccacccgcgggagaagctgcgagacaggacaggaccccgccacgctaccgactcccggggtgatccgggcaagaccctgcccccccccgtgcctcagtgtccccttggaatctgcacatgtgacccaaaacagggtgtccagacttccctgggtcctgcagtccactgagaagcctgtgaaggttgaggaccatcccccaggaaggcatatgacctcagggggatcctggcccctctgagccctgcaaggccgcgagttcagaaattttgggtagagacgcagcacgggggggcggggggggggaccatccgccctgcggcctctgatccgctgagagcttccagctgcgcgacctcaggcaggtggcttcacctttctctagaactgctttccatctgaaaacgggtttgatactaggtccctgcctcatgcggtcagtatggggactaaatgagtaaacggtcctgaggcattgagaaccgtgtccgtgtgtcactctaggtcggaagccagaatcaccgggggagctttctgaactactggaccttctgagccagggcttccggggcaggagcctgggactgtccctcagccaggtcaaacccctgctctgcgcatgctccgtgccgatcagccttgtctgagcccccctcccccaacccggtaggaggcgcagggtgggcatggacagtaaagcagaagatgcctcacctctcagcctccgggcagccccaggtggagacgtgagaggtaaagatctaagcttaaaaagtccccacctggggcagccctggtggcgcagcggtttagcgccgcctgcagcccagggcatgatcatggagacccaggatcgagtcccacgtcaggctccctgcatggagcctgcttctccccctgcctgtgtctctgcctctctctctctctgcatctctatgaataaataaataaaatcttaaaaaaaaaaagtccctacttggatgttaagatgactcctcccctgaagtccctcttaccaggtggataatgatcccccgagggtcaggaaccgcgtagaccaccgcaagggcaacgagcagaaggacgaggatcttttccatgacggatggggacagccggtataggtagcagctggcaggtcaggtggcagtagacagagccaggtggggtggtagagctataaaaggggcctgtccacaggtgaccccccccttccccaccccacggggctcgacgtaacccgaggcccagctgtggccaatctgttgggggcgtgtcctgataaagccctgggcggcccctggcaccttggcaggtgtgcgggcgtgcacgcacgtgtcggtgtccgtgctgatactgcgttaatggttgggcgtggactcggaacagtttataggctggacaagttatctgttctttttttttttatattttttttaagattttatttatttattcatgatagtcacagagagagagagagagagaggcagagacacaggcagagggagaagcaggctccatgcagggagcccgacgtgggattcgattccgggtctccaggatcgcgccctgggccaaaggcaggcgccaaaccgctgcgccacccagggatcccaagttatctgttctaagtctcaatctccttatctgtcaacgggatcatttcgagagttgggaggcctgagaaaatgaaaatggtagacctaccttaacacagtatatatgtcactctggctgtgcttttcgcctgccctcaaccagggggctgcctccatgagtgattttaggggccttgggacattgcttctctgaagagtctttcctgtttcctttctatttcccttcctggctgcatcctggaattaaagacccacccggtggttaaggcttcctctcacctcctcccccacccaaggccacatgtgagcgtgaacagtagttggtcctggctgagactgaggtcctgtgagcttcagatgaccccagggctggaggctgggaagaggcacagctgccagagtgtgctcaggtgtaggaccagagcgattttccctggaggactggtcattgcagtcaaggaccccttccccatcccaggatgtggaagactgctccactgtggaggccccagattgggctgctgagagcaaagctttgatccagacagacttgtcttccaaactcagcactcactgtgtgaccctggacaagtatctgagcctcggttacttcatctatgcaaggaagttgatggctctttctttgtaaggttgggattgaacaagacaatgtatgtcagagtgcctggcgtgtagtagatgctctgcccatgtaataccaccctcctttcttccccctgataccgctagagggtggaatataggggagcacctggaggaaccagccaggagaccctcaaaatggcagaaacccaccaattctagacagaaaaataccactgattaaagaaccactgttctctcttatttttataggtctcagtctttaaaactgcttttcccccatgagctcattctggcccttccttcgctccctgccctctccacctcattacacctgtgagctgagccacagggagggtaatgacgctttcccactcacaagtcaaggccaggaggcccctgaaggaactggaggagctatttccacctgtaaagggagctgtgaaaaatccatcagtcctatctccagctgggcacagccagcttcccagaggagaaagaatgcatttttcccttataaatgaagagtatagcaaagagaactttggccaatgtttgtgcttgcaaaacataaacaaaaattaattagatttttttaagtagtttccatgtccagcatggagcccaacacaggactcgaactcataaacctgagactgagacctgaactgagatcaagagtcggacacctaattgactaagtcacccaggtggcccaattaaatgttttttgtatcaaaacctcataaggcttaactaccccattcgcaatctaaagagtgttgtgctttgggtttgttcacttcaagaaggaaccccacgtgcagtcacatggattaacctgaggcataatactgagagaggaaagccatagacaaaaacagactgtgtattacattggcatgcagttcaagaaaaggtaaaattttttttaaagattttatttattcattcatgagagacacagggagagcgaaagaggcagacacacaggcagagggagatgcaggctccatgcagggagcccgacgtgggactcgatcccgggactccaggatcacgccctgggcccaaggcaggggctaaaccgctgagccaccacccagggatcccccaagaaaaggtaaaactaaccttttagttttgatgaaagtctgcagctatccccctgggagggctgttgactgggaggggggcaggaaaaagcctcctagagtgttagaactgttctaaatcttgatttggggtgttggtaacacatatgtaaaaatccatctggtgatttgcttaagatttcagtattttgggcagccctggtggcgcagcggtttagcaccgccttcagcccagggcgtgatcctggagacacgggatctagtcccgcgtcgggctccctgcatggggcctgcctctccctctccctctgcctgtgtctctgcctctctctctctcaatctctgaataaattaaaaaatatatatatatattaaaaaagatttgagtattttactgtgtgtaatgtagatactgcacctcaatgttattcaaaaaggaggagatgcctctctggtcaagtcataccacatggatggtgagggttgaggaggtatcgtgtcttttggtgagtggggttgggccacagtggctgtagacctagaaatgtggccaacctcttgtgggtgtcacctgctctatattctccaagatctcccaggacacgcagggtgggcctccagcagcagccatgttaataaatgagcccgtcttgctctccaccactatggactggacaagagacagacacctgacccaagcctctcttttcctggaatgtagacttgcatccaatagcttgccttcaagctgatctgaaacatgaaactagcaaagcccaggaaggcagatctctgatgtgctgacgaagagatggagaaagctggtctgccgaagggaagaagagcggatcagccattcaagaagaagcagtggcagccataccctgacttctgatggatttccatggctggctgcatccctgcccctgtggggcctgaagctcccttgtgttcctatagtacatcccctttgcttaagccacaaacacagacaactcacttctgggaaggggcttagagctctggatcaaagttagatgtatagcaaccctgggagtcagagcaggaagcagacatggaatccactcaagattcaaattccccattgggagacttgcttgtgtcctccaatcctgtatgcatgagcctcactggagagagccctgaggcggacagcccacctgggcctcatgaaatggggagggacattctccaaataaagagtggatttttgttaccaaagaaaggggaatgattctgggcaaaccagaataataggtaccccttccattccattggtggctgccaagtccacagacaatcccaagaagtagactcaaattacaaccaaggtgtgtgataattgtgacttccaaattttctctgactatccaatctccaacttgtttaggtgagggtaggaagcgaggcatgcagtgactttcagtttgacagtctctttttatttattgtattgtattgtattttttatttttgacagtctctttttaattcaatactcagcctcaagtgttcctttcaccacctctctctcctgaccaaggtaggatggagcatggagggaagcttaggcgtcttcaaggaagcagggacaggggtctctatgatctgagccctcagtggctgctgtaatgatgtctctggtcccatctcatccttctggtcctgtatttttttaaaaaagattttatgtatttattcatgagagagagagaaacaggcagagggagtactaagaaggcaccatgcagggagcccgatatgggactccatcagggaccccagtatcacgccctgagccaaaggcagatgcacaactgctgagccacccaggtgtcctgtatttgtaatctgggctcttattttttttcattttttaaaagatttatttatttattcacgagagacacagaaagagagaggcaaagacacaggcagagggagaagcaggctccccgcagggagctcgatgcggaccctatcccaaatcctgggatcacgccctgagctgaaggcagacacccaactgctgagccacccacccaggcgtccggtaatctgggctcttagtacagttcctccttttgtctggtcaacaaccaagtgaactccttcccacctcccacccccatatttataatcccaactccttgccagtgctcccttcaaatgttgcaactatcctgtgtcagatcaaaatgctagggagatagcccgatgtctcacaagtcactgccccagtgctaaattcaggatgtctgtgtgatgttgcctctctttcagtttggtcatgaatatctcaatattttgaaacttagaggctaaattgcaaagttagtgactgtcaaagaagaaggagggataaacaccaaaatgttaatagtggtagtaataatgataaacatttgagtacttttatatgtgaggcattgagccagttttgtaattttacctaactcttatgtgatagatagtacttaaaaaaaaaaaagattttatttatttatttacttgacacacagagcacacacaagcagggggagcaggaatgggagtgggagagggagaaacacactcgtcgctgagcagggagcctgatgcaatgcggggcttgatcccaggaccttgggatcatgagctgaaggcagatgcttaactgactgagccacccaggctccccgatactatttttgtaaaaatattttgtttatttgtttgaaggagggggaggaacagagggagagcagggggacaagcagactccctgatgagcagatctcatcaagccccatgaggcttgatctcaggatgctgagatcttgacctgagctgaaaccaagagtcagatgctcaaaggagtgagccactcaggtgtccctgtgagagatactattatcttctccattttataaatgaagaaactgaggtttgggaagattaaaccatggatggccacatagattagtaagcagttaactcaatccagatatgtctaaagccaaagtctgtttttaagatgatcttggctctcctttgctcccagcgttggggttatgagtgatttatattcttttatgtaatctttcctggattttcctatctctctacaccaaacatgtatttacctatgtagtcaggagaaatacatattttgaagaagagaggtaaaagaggaatatgcaacaaaaacataaataggagaaagatactgtattgaacagaaacatgttaaggtctgggatgcttcctttgccgcactttgtagttgtctcttatcacactatcagtgtgcattgcgaatatacagacgcatatacatatatgtaagcgtctcactgtctttgagggcaggggccctgtcatttttatctctgtagttttgcttagggaagatatcctccagcatagggcttcaggacatggtacgcacttggtaattgttgatggaggagaaaccacagagatgagaaaccagtgactggaagacacaatcagaaaaggttttgctggactccacagggttgggagtgctgagagggcgactagggagccagggaggagtttaatgggaccacgtgggtgtggtgggtacggacagtgctcaggaaaaggttttggttttgaggcaagaaggcaggaattgaaagggaggaatgtgacagtcgcaaccctcccctcccaatttttgtgtgttcccccccctccatcccccacccccggctcgggcgggtgaagaggagtctccgttccccgcggcgggagtgcgcggtgggcgggccgcgcctccccaggccgggtcctgggtttccactccctccccccgcccgagtcccgagcgctggccgcggtgctgaagccgcgctctcgcaggagggagcaaggaggggccgcgcggcggcggaggggcggagctctctggagctcggagctggaaaggggggcggggggcagggcggcgccagtaggcctgagaccctggccggcaggagaggaggcaggacagggagacagcctggctggagcggacaaaggcatctggacaagcttcccccaaagaaaccaaggttgtcttccttgtcttatttcctaattctctttcttctaccttgcagggacccccatcttgcacccccccagcctcctccccaaactcggcttaggagtgacccacttctaggcctccatctgcaaagccactggcttacagcccccaggattccagcccagggcctacagcctcaccatggtgaagctgctgcctgcccaggaggcggccaagatctaccataccaactatgtgcgcaactcgagggctgtgggtgtgatgtggggcacactcaccatctgcttctctgtactggtcatggccctcttcatccagccctactggatcggtgacagtgttaacacacctcaggcaggctattttggcctcttctcctactgtgtgggcaacgtgctgtcctctgaactcatctgcaagggtggcccactggacttctcctccattccctctagagccttcaagactgccatgttttttgtggccttggccatgttcctcatcattggctccatcatctgctttagcctctttttcgtctgcaacacagccactgtctacaagatctgcgcatggatgcagctggctgcaggtgagcaggattaatgggagggcaagcaggggcccacttcaggctatagggtaagctgcaccattccatcctctgtgaagcctccgggtctcttacccagtcgttctcctttagtttaattttattttttttcaaagatttatttttttttttgagtactctctatacctgacatggggctcaaacctgcaaccccaagatggagagtcactggcttcaccgactgagctagccaggtaccctttagctattcttctttaacccagttctactctatgctctgccgaagcttctgaggagtagaaaattttagaatggctaagaccaaaaggatagttgaggtcaaattgttcaaccctctcatcttgcagatgagaactgaggtccagagagaggaagtgactagcccaagaacacacagatagttgatagaatgtgtcctgactcccaggccaccacatcagaggttattgttgctctgggaaggaaaaagaaggaagcctccattgttggccctgtgggaatagtatccaacccagggcaaaataagtaaagtacatcctagacagctctatctcccacttctgggcatttgttctttcttctttaagtatccccagatccctgccttcaatccttccctcccaccccaattgttctgagggagattctaaggtcagtcattgatttggagtgttatgctgtgacctttcccatagaaatttgcattaagttccctctttctcggtggagtgaaaagctttattccctagttatcagttgccatacttgaggcaataaatgacagtgatattttgtgatggggcagttgggtggtggctagagtcttttaaaactatgtgggattggtagctacttatggtgcccagaggcaaggccttcccctttttcttgttcctggcccaggcagccctctcagtctttgggtcagctggtcctgttctcctctaaagcctagaaagagatggctcaaggccttgccctgtagcccttggtccctttctactccaaggtcatgcacagactgcccatgctagggagatgtccaggagcagtggtgggactgcagactccaaagaaaaccatcttgacatcgttggttagaatgagaagcagcattatccacaatagggggaatggtgccaggatcagaatcccagacaaccgaacacatagactcaatactctgtcagagttggaggggaccccagagagctgtgggtatccccccagctacagatgaggaatctggggctaagaaagaggaaaagacttgaccaagactatagcagagcaactggcaactaaggaccaaggggaactaaagcagtgggttccaggaaactagatgtgttccaaagatatttttatggaagccacatatttatgtaagtgtaatgacttataaagcactttcatatatctcatctagaagagccccatccctacctagggaggtagctagtcctcttattttatagataaggctcttcgtgggtaacttgtcttttagcaaatggacaggacctttgattccgaatcttgtactcaggctactgacttggctccagagctgcctccccagtctgtccaccatctccctctcctctggtctctatatgatgagggaggggctggggcagggctgaggttaatcttgggcagtggggagaaggaaggggaatgaagatttagcagttttgtgacaaactggcatgcttaccagctggccctccctatcagaactatggaatgctggaaccacaaccattcctttcattcttcacactgccccctcccacaacctcctgcaacaggtgctatttgctgaacaggcagtgcctgggagagtttgggtgggggaggcatcatcaggccatttgaattagactctatgtcatggagctggagacactgatagcagaagtggccagatgccatcctatgaaacatttatgtcaggggagagcgaaggtggtgtcatgttccattctttggtgtaggggaatggaagatgagccaaagggagggacgaagagcgcatgtactctgcagacagcaactgggacatgcatccatttgaagatgtctcaaccagttagtttaatcgagaaacctgagatcagggaaagggacaggagaaaggaaagaggatagataactggggcagtgtggggctatagtttaacaatgttaatttagcttctggatgccagttgtaaactgtgtgtggttctagctcctagaaacataggtagggcaagttgcatgtctttctgagtcttggtaacctcctctgtaagaatgtagcaacagtacctcctatcacaaggttctgtgaggatgggacgtataaggcatataaaacaccttctacagtgcttgtcacatagtaggtgctcagtagctgtgaaaaaactcaaaaacaactttatcagttaggataggtgaggtaacaactcttaaatccaagtgtcttaaaacaaaagtttattttttgcttgtggtacatgcttattgaggatcagtgctctcacagttctctcctggaaccctggctgatataatatcaggtgtcaaccagctttcatcattgcagagtgaaagggagctctggaaggtctcctcctagcagttaaacactctacatttctgctcatattttgttgtctaagggaagtcttatggccttgcctaacttgaaaagaggagaccaaggaagtataatcctactatgtacctgaaatatttgtgaacacctctaatgccatgcacatccactgaagctgcttccatttgactttagtgccaataataatagcaacaaatggcagtaactggctgcttgctatgaatcagatgctgcagtgagcattttctccacatgaccacacttaatcctcataatactgttatgagtcatgcattattatctcattcttttacagatgagagactggaaatcagaaagggtaggaaaacttgctcgagaatagcatgctggcctccccttagacctctgagacactataaatagggttgacccctaccatgtgtccaggtgcctgggtcaggtgctcacagagggttgcttccaggttagaggccctgggatattttccagagatgctatggaaggagaattgtgccaaggggaggagatggggagaatggaaagtccataaggaagacttctttccacattgacctgttccccctcccaccacggttaaggtaggggccatgctagtcaccaaagcacaggtcttacactaactggggaaggacataggttttaccaaagagctctgggagggttcctgctctccttccctaggtatatacctgaaacacttctcattttgtcactaggtatgaaatgtcaggactaaatacattcagctctttggagaagtgtgtctgggagttgagggaattaattttggggtcaaaaaagtcaggatgagttcaggtgttggctctgctctagctggatgactgggcaactcacttggtttctctgagacttcagttttctaatctgtaaaatgggatattaatacatggcctacttcacagagctgttgtcagaatcaagagaaaaatggtatgggaagtattttgtgacctataagagaactatataagtaagcttgtcctgtataaaatcaaaggagaattgatatacatttaggtgaggaggtgggatcctgatctttatattttactgtacattcatttgatctgccgaccttccttgcaagcagaagctgagctcaaggtaggtaactaggtcctgtgaggttcttcttaggtgctcctgggtatggtacaaccttggaactagagagccttcaggcctgtggaagaaggatcagggatgggaaagtagcacagatcatggaaggcaccccttgcctacatggtggtggtccttggggttgccttggtcacattccaggattatgtcacctacttgtgcagctgaggtgggatggtcattggtgggagggcatgggagaagtgaagagaaggtagggaaaatgacatttttggctgtaaatactaagtcaatgaacacacaggatgggataatcgtagctaacactcatgacgtactaagtatgtgccaagcacttttccgttattaacccatttgaacctcactacaatccaaatgagtagggactattcatattcctactttacagatgaggaaactgaggcccaaaaaatctcaagtggcttgctctggcccacgcagttagttagcaaagagctgggcttggaatccaggctgactttgctagtgtttccccgcttttcctattgagagaattacctgaaagaatgttttatttttattttattttattttttttagattttatttatttatttatgagaaacacagagagagagagagagagagagagaatgaggcagagacacaggcagagagagaagcaggctccacgcagggagcccaacgtgggactccatcccgagtctccaggaccaggccctgggctgaaggcagcgctaaaccactgagccacccgggctgccctgaaagagtgttttttatttatttatttatttatttatttatttatttatttatttatttatttttaatttttatttatttatgatagtcacagagagagagagagaggcagagacataggcagagggagaagcaggctccatgcaccgggagcccgacgtgggattcgatcccgggtctccaggatcacgccctgagccaaaggcaggcgctaaactgctgcaccacccagggatcccgaaagagtgttttaaaaacagggattcttgagctctggaaatcagcattttattttattttattttatcttattttattttatttttaaagattttatttatttattcatgagagacacacacagagagagagagagagaggcaaagacacaggcagagggagaagcaggctccatgtagggaggctgacgtgggactccatccccgttctccaggatcacaccctgggctgaaggtggcgctaaaccactgagccacctgggcttccctggaaatcagcattttaaataaatattagagattcttaaattcaggaaagggttagcaactgcactgaactctactaagtaaggcttgaagaggcttatttgcttgaatgaaaagttcatgaaggaagaagccagagatggggctggaaaattttgtgtattcattaaatctaagattcccaagttgtagaacatgccattattgtatgtgctgtaaggaggaaaaatactttttttttttcttaaatagcagaatgtgggacttgaacttgcaaccctgagattaagacctgagctgatatcaagagtcagagcttcaccgactgaaccacccagatgcccaggaaaaatactctaatcaaacgatggcctgaaactttcttattatacttatttcagagctattggagtatgaagagatattcatcttaggagtgatgagttctctgggctgggaccagattttggcagggtttgaagccagggtagccgatgcttcatcaagtccacagtgagggtcgtggctgagggcctagtaggaccacctggtgccatggcaggctctactgaggagctctgctttctgcctctacccatgaccaagggcaattgactttagttcttggatctttaattttcaaccatgtgttctacaagagtgatggtaggagcggtcccatatgtcacaggctgttaacaccaggagaagggaggtgacaagatgtcagcagtgcagggtgggaggtagcaggcagagcatacccagtctgacagcatctgcaccccctgctgccctctcagccacaggcctgatgattggctgcctggtctacccagatggttgggactcaagtgaggtgcggcgcatgtgtggggagcagacgggcaagtatacactgggccagtgcaccatccgctgggccttcatgctggccatcctcagcatcggagatgccctcatcctctccttcctggcctttgtgctgggctaccggcaggacaagctcctcccggatgactacaaggcagatggaaaaggtaactctcatcccccaaggaggtggggcttcctttcagccattggtccttggccaagggttggggacaccaagaccaatcagacatgcccttattccagaggccaacggtcagtgggggtttgcaagccagcaggtgatgaggtgatgacagcagctgtctgtgatagaagagtgtctttccttctccctcatgccctcactcctgtcagggtctacagaggagagaaccctggtccagcctggggaggtaggtatggcctcctatagaaggcagcactgactgggtcttaaagttcactgggagtttgctcagtgcagagagaggaacaacaggttagcagagggctgagttgtgggggctagaggagaaaggcaggttgggggcagatgtgacagcttgtggagtgcagacggtgggtgctcccttgagttaaaagtagctttggggttctctgtttcattgttttttaattttttaaagattttatttttttattcatgagagacacacagagagaaagaggtagagacacaggcatagagaaaagcaggctccatgcagagacctctccagtctcctttccccatagttgtcttcaccccattgacctgaactagaagaaagaggcaaactcccttgccccctcgccccccatgaccaaggacccttcccagacgaggaacttaaagcccggaagggagacccacccagaagtacacagaaaggtggtgcaaagagcccagaactctgggcttctctggctcagcccagggcccacttctccataaggaagtaatcaaacatctcacccttctttgtaaatagaagagtgactcccacacctaagctaagtggttaaagatgaaaagcaaattattagaatgagctgggccaaggaggagagaaaagagaggtacctttccattttaggaggtgcctatagcttctaggttctggggatactcaaagcctgggtcccttgaaaaccccataaagggaaaggaaatggaactagcaatcctgtgaggacaggttggaggtggcgagtctagcagcaagctgcacaaccagcactttctccattgatggagggttttccagaaaggctttagcaggagctgctggaggcattttatttagctctcatcctcaaggcagggccagccttaaatctgtctggacacagcagagaacacctttatatagctcatttgcattctttccttttcagaaaggattctttcagctggaaagaaatttcattgacattatccactcattcacctgtttagctcacaaccctgagatcaagacctcaactgagatcaagagtcagggtctacagaggagagagctacttaactgactgagccacccaggcatccccacatacctccctttaaagtcctttctttgggcagcccaggtggctcagcggtttagcgccaccttgggcccagggtgtggtcctggagacccagtatctagtcccgcatcgggctccctgcatcgggctccctgcgtggagcctgcttctccctctgcctgtgcctctgcctctctctctctgtgtctctcatgaatagataaataaaaaatctttaaaaaaagtgctttcttttaaaatcttattttatttttgaaaagattttatttatgtgacagagagagaaagcccaaggagggggagcagcagagggagagggataagttccctgctcatcagggagcccgatgtgaggctccatcttaggaccctgggatcatgacctgatccaagggcagatgcgcaaccaactgagccatccaggtgccactccccccccttccccctgccgcctctttaaagtgctttcttatgaagagatggttttgtccatttgacacttttctttacaaatcataatgtcagttggctctcctctccttccctttctcctttcatatcccctcgacctgttttcaatcttttcagatttttttctctccatattttagtttcttcactatcatgcaggatttaattcatcctttttgtttattatctgttagaaaatacccaaataacctttctgaatacatctaactattcagtgaagtagttattgcctctgtcaaagcacagaattgaatcaggaaagcagagtttgaatcccagttcttccaagtcactttcttcaaggtaaaaagggcaacaccaactcctgctctgttacctccattagtgtgtggcatgagcgaaacaatgaaagcaggaatgaagccttgcacaagtacagagttgctgatccactctttaagagttaaggaggcagaggagaatgagtgtgggctttggagtcagacctggatttaaaatttgggctccactgttatctaactgtgactttgcagagattgattaacttctctgagtctcagcttcctcatctgagcctcatttttatagagagagataggcggcaggtttctcttcatttgtaaaaaatacctacttcaaaaaatcatgaacaagataaggctcagcaacaagataaggatatgtgctcttgtcactgctgttgaagactgtactggaggttatagccagggaaattaggcaagaaaaagaaagaaaagaaatccagtttggagaggaagaagtataactatctctattagtagatgacatgattttgcacatggaaaatcctaaataatccactaaaaatctattaaagctaatatataacatcagcaaagttgcaagatacaagcaatatacaagaatctattgcatttgtatacactagcaatgaacaatctgaacatgacattaaaacaatttcatttataatagcataaaaaagaataaaatatgtataaataaatttaacaaaagaaatataagatttatacatgaaaattaaaaaacattgttggaagttattaaaggcctaaatagatggaaacatccatgtttattgatcagaaaacttaatatattaagatggcagtgctccccaaactgatctacagattcaaggcaatccttatcaaaatctcagttggttttttgcagaaattgataagctgatcctaaaatggaaatgcaagggacccagaatagccaaaacaatcacaaaaaagaaagagattggaggacactcatgtcctgattttgaaacttactacaaagctacagtaatcaagatggtgtggtactggtatgaggacagacatacagatcaatggaataaaatggagattccagaaataaagccaagcatctatggcaatttttctttctttcctttctttctttctttctttctttctttctttctttctttctttctttcttttatttattcatgagagacacagagagagagagaggcagagacataggcagagggagaagcaggctccctgtggggagcttgatgtagaactcgatcccaggacccggggatcatacctggaggcaaaggcagacactcaaccactgagccacccagatgccccagggaaaattgattttcaacaaagatgccaagaccactcagtgaaggaaaagaatagtgttttcagggatccctgggtggcgcagcggtttggcgcctgcctttggcccagggcacgatcctggagacccgggatcgaatcccacgtcgggctcccggtgcatggagcctgcttctccgcctttctctctctctctgtgtgactatcataaataaataaaaattaaaaaaaaaaaaaagaatactgttttcaataaatggtgctggaacaaccacatgcaaaagaatgaagttggactacatagccacctcacaatgtatataaaaaactcagaatggatcaaagacctaaatgtaagatgtaaaattataaaaatcttagaagaaagcaaaggtataaatctttgtgatcctagattaggcagaggtttcttagatgtgatacctaatacacaagcaactaaaggaaaaatataaataaatcggatttcatgaaaaacagaaactttatttttttaaatccttttttttttttaagatcttatttatttattcatagagacagagagagagagagagaggcagagacacaggcagagggagaagcaggctccatgcagggagcccgatgcaggactcgatcccaggtctccaggatcacaccccaggctgcaggcagtgctaaaccgccgcgccaccggggctgcctgaaaaacaaaaactttaaagattatcaaccagaaagtgaaaagacaatccaaagattgggagaaaatacttgcaaataatgattctagtatccagaatatattaagaactcctacaacttaagtaaaaaatataaataacccgatttttaaagtgggcaaaggatttgaacagacatttctccaaggaaggcatccaaataagcatatgaaaagacagtcttcgtcactagtcatcaggaaaatgcaaatcaaaaccccagtgagctattttacagtcactaggataaagtcagtaaaaaagatgaacattaacaggtgttggtgggcacgtggggaaattggaactctcatatgctgctagtgaaaatgcaaaatcatgcagttgctgtggaaaacagaagggcagttcctcaaatggttaaacatagagttaccatgtgactagatatgtagatataatttactcctaaatgtgtgtgcaagaaaattgaaaatatgtttgtaccacaacttgtatacaaatggtcatagcagcctaatagccgaaaagtggaaacaacccaaatatgcatcaactgatgacttgggtagacgatatgtgtatatccgcccagtggaatattatttagctttaaaaaggaaagaagaggggtagcccaggtggctcagcggtttagcgccgccttctgcccagggcgtgatcctggagagccaggatcgagtcccatgtcaggctccctgcatggagcctgcttctctctctgcctctctctctctctctctctctctctctgtctctcatgaataaataaaatctttaaaaataataataagaaagaaagaaagaaaaaggaatgaagtgctcctaagtgctaccatatggatgaaccttgaagacattgtgagaggagccatacacaaaagaccatatgttgtatggtcccatttatataaagtgttcagaataggcagatccgtaaagaaagaatgtaggtttcagtagttgtccagagctgtaaagagggggaaacagggagtgattgataataggtttctctttggggcgatggaaatgttctagaattggatatcagtggtggttgcacaactcggtgattatactgacaacccaccaagctgtacactttaaatgagtaaattttatgttagtaagttatacctcaataataaaaaaaaaagacagtgtgagggatccctgggtggtgcagcggtttggcgcctgcctttggcccagggtgcgatcctggagacccgggatcgaatcccacgtcgggctcccggtgcatggagcctgcttctccctctgcctgtgtctctgcctctctctctctctctctcactgtgtgcctatcataaataaataaaaaaaattaaaaaaaaaattaaaaaaaaaagacagtgtgagggattagatagtgtgtatagagcactaacagtgtctgcatgttatacaggtgattcataaatattagttctctcccccttctgtccttccagcatctccaacttttcacagcatccatctgcccacccagtaacagcccctgcactccatgtgcccaccgacaggttcaggcactgggggtacaggattgagggaagaagtctaattggaccttcccatctgataagggacaccacaggcaaaatggaatcacaagctgatgaacattatgaagaaaaaaacccctcaaggctttttgagagtgaatgaaagaaatctgatctagtttggagagggagagggagttatcctgaaaacaaggcttggttataaacaaatgatgttctttttccttgcagaggaagtctgaagcagctgaagggttggtgagtaattccattgttgggtggtcttcgtgcttttgcgagggctgtggcctccctggctggtggggctggggagaggaacaaggactctggcaggggctcactggcatctgagaccctctcgttctacttctgtctccagaaggggaaaaagaacaggaagaaataatttatttttttttaaagtttatttatgatagtcacacagagagagagagagaggcggagacataggcagagggagaagcaggctccatgcaccaggagcccgatgtgggattcgatcccgggtctccaggatcgtgccctgagccaaaggcaggcgctaaaccgctgcgccacccagggatcccgggaagaaataatttaaaacaggcaggtagtttcataaactcatctttctctggagcctggcaaaaaagaacagactgtttagaagtcattattctaatttgggcctttattttcaggaagattttcagtggtttgtaagaaacataatagaaaacttagtaaaataaaaaataaaagtcacagagaaaaacaaatattcccaaaagctaggctaatagaaatactgtgttgagtattaaatttagctttatgcttcttgatagctgaggcaaaagaaaaatatgatgtaaccagttttaatgtctggttgaaaaggaagcacaacatatcaatttccttattgtcttttaagtttccaaaatacggaatattaaggaacacattaaaaaaaaagctcatcatagtatcaccttccagatgctgccacttaatgaggacctccagcaggccaggcactttggggaggagggattatctacatttcagctattttaatttttgcaaagtaccttccaatccttgaccacatatacttttctgaataaatgtaaattagtattgctctcctcctgcatatttattagatgattctcaaactctaatatgcatacaagccaccaggggtcttgttaaaatcagcttctgattcagttgaagtggggccacagacactgtgtttctaacctgcttctcataatggttacactttgagtagcaaactattagactattagagcatgaacattttcacatctcttatcaatgttcgttactaagtatttttttaagattttatttatttaaagatgttatttattcttcagagacacataaagagaggcagagacacaggcagagggagaagcaggctccctgtggggagcctaatgcgggacttgatcctaggatcctggatcacgacctgagccgatggctacgacctgagccgatggcagacgctcaacccctgagccacccaggcaacccaaagattttatttttaagtaatttctatgcccaatgtggggcttgagctcacaatcccaaaataaagagttgcatgctcaatcaacagagccagccaggtactcccgttattaaagtttttaaaagccaccaactccacagcactggtgtaccatttaattgctaaactagaccttggtttttacccatttaggattgttctcacagataataactttttgcttctgctgataaatcttggattggaatgactgaatcaaagataactacacttttttctttttgcactctttcaaaaaatctgaataatggggacgcctggatggttcagcaattgagcatctgccttcggctcaggtcgtgatcctcagttggcaattgcgatcgagtcgcgcattgggctccctgcagggagcctgtttctccctcagcctgtgtctctggctctctctctgtgtctctcatggataaataaatacaatctttagaaaaaaaatctgaacaatgtatttaaagattttatttgagaaagaggagagagagagagagtgagcatgagcagggggaggggtagagagagaggtagagggagaagcagaggccccgctgagcagggagcccaatgagaggctcaatcctgggacctgagctgaaggtgaatgcttaactgactgagccacccaggtgcccctgaacaatgtattttaaaaaaacagttcacccatttcttacacctcactgtccatatgtttgttattgttgttgtgtgtgtgtgtacctttcaggattccacatatgagagtatatgtagtatttgtctttggctgagtaatattctattgtgtatatgtagcacaatttttaaatctattcatctgttgacacttaggttataaataatgctgtgatgaacatggaagtgtgtgtatctttttgagttagtgtttttgttttctttggatagataccctaaagtggaattgctggacaatatggtagctctatttttaatctgttgaggaacctccatattatttttcatggtggctgcaccaatttatattcccactaacactgcacaaaggttctcttttctccacaaactcaccaacacttatttcttgtctgataacagccattctaacatgtgtgaggtgccctctcactgtggttttgatttgcatttccctaatagttgaacatcttttcatgtgcctgttggccatgaagaagacatatgtcttctttgggaaaatgtttattcatatcctttgctcattttttttctaatggatcataggtttatttttttaaggactttatttatttattcagagagagagagagaggcagagacacaggcagagagaagcaggcaccatgcaaagagcctgacatgggactcgatccagggtctccaggatcacgccttgggctgcaggcggcgctaaaccgctgcaccaccggggctgccctcctttgcccatttttaaattagattgttttcttgctactaacttaaatgagctctttatatattttggatattaatcccttatcagatatatgacttgctaatgtctcctattcagtaggttgcctttgcattttgttggtggtttccttcactgtgcagagctttttgtgtagtcctgcatggtttttctgcttttggtgtcagattttttttttcttttttttctttttttttttttggtgtctgattcaaaaagcactgccaagacctacatcaaggagctaactgcctatgttttcttctaggagttttatggtttcaggtcttatatttaagtctttagtccaatttgagttaacttttgtgtatagtttaggatagtggtccagtttcattctttagcatggggttgtccagtttccccagcaccatttattgaagagactgtcctttcctcattgtatattcatggctcctttgtcataaattgaccaaatatgcaggggtttatttctgggctttctactctcttccactgattgatgtgtctgtttttatgccaataccatactctttaagcttagttatatagtttgaaatcagggagccatgatgtgatgcctctagctttgttccttcccagattgctttggcttttctttttttacaacattttatttacatcttatgagacataagttattacctgaggcacattgaatactatcttatacattaaggaaatgtgcatgtctgggtagaactaaatcaaaatgtgaacatacatggggaagtttttgtttgttttgatttgcttttttaaaaaatgtcaaattttatactcttgccttttttttttaataccacaggtcatctatttccctgacaatggaaaattaaggaatcaaattcttcagagataagaactttttccttccatgcttccctgtccttggctactataggcctgatgttctcgttctgaagcctttcatgataggattagaacctgacattctcctgagacaagacagaaaacttacaagtgaagcagaactacagtgacccgcatcaaagatattcagagagacaatgggtggtactctacccaagccccagctctcttcttatcccctttacaccagcgatcactttaccctctagaggcttctctgtaaaatgagagggctaaatgaatccatgtattggggcccccgaggtcagattctccgacagactgcattgaacgcacattggaaactgccactcagctctaaaagggcagctgagaaagaggtgattgtaagcctgctagaccatttcagattgaggtattgggggtcctttgcttcttctcacattttttaaaaagatgttctttatttattcatgagagacaaagaggcagagacacaggcagagggagaagcaggctccatgcagggagcccaacatgggactcgatcctgggaccccaggatcacgacctgagcctaaggcggtgctaaactgctgagccacccaggctgcccacattttgttttcttattgatgatcaggggtgggtaaggaatggaggggccactgaacctgaatccatcaggaagtcctattaagactgggtgaacacaaaatctaaaaacttaggactttagactactccctgcctaggggatggtacatagaaacagggttttgttgatcattcacagtggataaacctgaggaacaggtgtttttttcctggtcgtgtgcattcactaagaagatgtggctgctggtggagaggagaggaggtaaatgatgaactgtaatggatcttgttacttgaccaaggagctgtcactaacacagtaaaccataggtttctcattcctgggctgcaaggcatgcttttttttttttttttccttaaacactacccccaacttataacctaggcgagggtcccatgttctactgaatgagccagccaggtgccccatagggcatgctttttaaccaatgcaccaacaacccactcagtcagtgtggtttcttgtacagttcagatggattaggaatgagtaccccaacactgtcctgttgttggtaatgggaactagtagaatgggactcaagggtgatgatgtttatatttttgtgtgttgataaaattgtcaggcattttatgcagacctcatgaatgacagactcccaacaaattccatagcttagtgccttttcgagttatattcgtttacttctcataattttacgttttatataacttttctaaaagtctaccttctaaaaatttcttgctaaaatagtaactgtggtggtccacagaagcttctggggcacttagggtgcgcttgccaacagcctgcaccttgctcttggcaggaacagcacgtttcaccaaagcactcaagagtcagtttaccaataaccagtgctgggaaggatctgcagatttaagtcagatgacccagatgaccttttgctttatgttaaaaaaaactcagaattcaacctctcaaatcacagtattgattttggttgatatctaagtaactgtttatcagctcaagtggctttccttttaaattcttttttaagatttcatttatttattcatgagagacagacacacacacacacacacacacacacagaggcaaagacacaggcagagggagaatcaggctccatgcagggagcccgacctgggactcaatcccaggtctccaggatcacgtcctgggctgacggcggcactaaaccgctgagccacccgggctgccctccttttaaattcttaaaggcaggaatctcatctctgaaagcattagagaatcagtaaagtcagcactcctctaaccaagtattcctcacttcaggcttgcctctgttgggctgggctgttgggctggttgtgaggcccaactgttaccaacagtgactaggcctgagtagatgtggtcgagaggaccagtcatttgtatcagagatgtgaactggaaggatactggaaatgctttcattgtcttacatccttgtattagttatctgttgctgtatacctaacatgttaccacggaactcagtgacttgaaacgttttaatttttgtgggttagagatctggcaagagttagttaggtgtccctgtctcaaggtttctcacaaggctgcaagttgtctaatcattctgaactcagtggttgtctgcgggaggcagtttttcacaagcagctggactgagggcctccccagaaggttctcacatggcagcttgcttctccagaagagttccaggacagagcaagggagaggcacaaagaacagcagccacagccctttgtaacccatctcagtaataacacctgtcatgttcaccttaatctgttacaacagtcacaaagtcggcctgaagtcaaggtgaggggattatacaagtgcattagtatcaggtgggaatcactggggtcttttttaaagttgtttttcaagttattcatgattttctgccgaaatgggcacttaccagaatgcttttattgaaatgaaggttagattatagtaatcttacttgctgatggctacatgtgttttgtaataaattacattgaagatcaaatgagggctcaaaccctcaaaactcaccccttttgttatctcaattagactgatagtagggtccactaatttccaacaccaatagtaccttatttacttatgaaatccagagcaacaaatgcattgtcctaagggcacaacttctaggaacatagttcaaattgtagacagccaatgcacttatacaaagtccagttttggcaaatgggaggacaaggcttgtcactaaaatgggcaaaaagtagatctgaatgaaggacaaagattatgatgacaaagcctcctcgcttataagaaatggtacagccagcaacactacatacctaatgtaaatttgcttgattttaaagaacttctaaacatgatctcaaattttctggctttttaactgggttataggatatcacaaggagttggtatgaatatttgtgcaaatacttaaagtgcaaagacaaatgtgtatcggacatgtaatttttaaattccaacttttaaaaacaagactagagacataaaaacaaacttccttctcaggaagtctcaaggttcatagattttatgtatgtttacatatttaatcttcatatactgcagagtgtgcaagacatcttagttaccaatgccctgctaactccaaagggaccaaattggtgggcaaaacaaaaaaggactattcaagtttctctggtgtcatcaggccttatttttcgaacaaatctctaattttattatcaataactcaccagtatacagtaatttaacagcaaatccctttcctcgtagggacaaactggaagactcaacaggcttcaaaaatagaatgggcagtaataaagttcacttgcaacctgggctggctctggagcagctaaatggttcccctgtggacacctgaaccctggtttgctggttctcctaggatagcggttaagtttccccaaacccttgggagttccaggccatacatttaacacaaggcttagagagactgcctacattggtcagtctggggagcacactggcttgataaattctagtttaattgtttaggttgctttttaaatgttacattctcttctggtcaactacaatatgaacacaactatgtatgtcttatatgacgcaattaactagaagattttatatagctcagggctggggaagaactttctatgaacaacacttaacaccacaaataaaaatgaaaggcaaattaaaaactggagaagtaggtgatggaaaaatgactaaaatgcatgatctttaatacagaataaatctttatcaaatatggaagcacaccaaagaaaaaagctgggcaatgtagcacataacccaaaaaatacaaatggccaataaaacccatcaaagtttgacttcactagtcatccactatgcaatttaaaacaagattctcttgttttttggcaatcaaattggctattgggaataaaacgagtgtgatcataacaggcccattcacatactgttcatagcacaagtcttcactcttcttcacgtaagttaggggacattacaaaccataaaaatttgcttattctctggcccagtcatcccatttttaagaatttatccgaaggaatgaattagagaagggtacgaaagcctgtgtacaatagggtttgtcatgccagtccttaggctgagttcataaacctttggcatttgcatatactgtgattgtaatctgagggtggagtggtaaggacacactacaaatattctgggaaaataccattgaatatagggaataacaactgtcctaagattttccaagacgtactctgttaatgtcacctaccccccaatttcaagatagaagaaagtgcaccttggtggctcagttaactgtctggctcaggtcatgatctcagggcctgggatcacccgtattgggctccctgcccagcagggagtctgcttcttcctctctctgctcatgctttctctcttaaatatttaaaaaggaaagctaacatcataaaatgagtatgttccagctgtacagtttcactgcatatttaagttcaaaaagcatactcaacctttcctgcattttgaagcatggatgagaccaatttgggcaacaaaggaacagaaatgctctggaaacatgtaggttattaaataatttgtttattgtactgcatttataaagaaaacagacaatgcacccagtagaaagaataaaaatgcatttggggttgtaactgacagcaatagaaatcctttagtgagatcatggcaattcgacagtattatgattaagttcaataaaggtaaatggggtacttggaagatcaaattctatagctgcctctttctacggcttctaattcatctggctccttaaataatagggggaaagcccttatttggtgggaaaacatttccagaaagaagttataggttctctcttattaaaatttcttctcacaccagttgataaaacggggccttctgtatgtgttttggttatttcacttttaatatcatcaccagaattcctgtaatttaattgcacaattgttattttacagtatagacaagaattcagttctagtctgctattgctttagatgtatatatcgctgaaaagccaaagtggattagaattgccgaaggattttccctgccgttgttggatacaatcgcttttctttattcttgataggtgcatagacagcctcacttaaaattctttctacaggaacatgtctgatttcaggactacccaatcaaggatccgatgaatggctggccatagttacttagggttctaggtttatgagttaaatggattgcataattgcaccactttttcctttgctgttgttggtggggaaaatggcagaatctggcctccaatctcccatgtagagagtcagctacctgaaagtctcataggcagctctgctagtagagcctcaacttgcacctccttggctttcggtcaatcagtcctggagccgcctccgcagaatgctgcaatccccaaggcccacctggtctgtgctgaacaagtggctgggaccccaaacctgcccttctcttgctttccaatatgacccgaggaataggtaatgtctaggacaagtctagaagaggcccatcctaaaataagattcgcaaagccttttctcgtttaaaaaaaaaaaaaaggtaaagaaaaaagcctcaagtacatcttaattatctcaaaattgcagttaaaaacttacattatacaaagaaatagcagcagagagtggctaatcttaaaccaaaaaacaaacaaaaaccccaataaacaaaaaaacccaacccccaaaccccaaaaagtgccatcccccctcctacttggccttggttcttttatgttgggatttcattcaagacctgaagcctctgagaaaatgagaatggcaaagccacagaggaaaactgcttcatggttaaattttggacaaggtaaagaaaatgctgtaaatagaagtaggggactgactggaaaagaaccaggaattctaggacattttcttcttagatgggaaatctcaaacccagatctcctttctaaagtcatcctgaattctttagttatggggcagtaaactcaagtgcaatgagtaaagtgccagccagatattaaaacaaaaaccaaaacaaccaatcaaagtaactccgcagttagggtgacagaagacacacagaaaaggactttttgtagaacatctgtggttctgaagaaatgtccatggttctatctgtgtccaccaaaaatcagaccaaagatttaagaatctcagagtcacgggaggatgaaaggaatttcatagtgctttgaacagtgataaaatggtacccaaatttggtgtttatatagcacacttaaaaaaagatagtagcttcaaagtcgcaggacaaaatgtgaacatgagaacaacagaaacaatccaggatgatgatgcagcctagatacagcaagtttaatgtctctgctgtacacagaagtaacacccttttcccgttctcatccttatgatggcaataggagatgcactagaaaatttgactcttagagtcagtgaataaaaggatgagctcatcatcttcatagctctttttaaaaaggatgcttataatttaaagggtgttctaatggaaagacaagggtacagggtgagaggctgtttcacattttagtctttggcagagcccaatcaaggccaaattcacttaggatgcccaattgctgtggggggtggtgtgtggggtctccacagggtcaagtaagcaaacccaaatgaacatattgattaaaaaaaaaaaaaaaaaaaaaaaaaacaaaacccaaaaaacccaggaaacccttgaaggaagagcttcaccctaaaaagggaagagggaaatgcctggcagagaggggcgagggtcagcatgtgatctctgctgcggtgctgggctggggcttaggagttgagccaagggtgccggagacaatcggcggcagtggctctcttctcgggtatcagctccagcatgggcagtaagaaatccgtgaagccagctgcctcttcctgagaccactcatacttctccactagaacctcaaaaaggccccagggtttcagtttcgtgatgtgtttcaggtcacctacagtaaagacaatacaaaagaaaatgactgacatggacaagtgaaaagatcctttcatggaaatccaggaactaatccaggtactctataaagagccaaattttgccaccagaatctaatccttttctattcacaaagctcttccttatcacattccttggaagtgtctccattttcagtgagggtctaaaaacttaagaataatttgtttgctctaccattttaggacattttgtcctggtcaaattggataggcctagcaggaactaggcattcattaaagtaagtattaaatgctcatatggtgttcaaagacagtttatcatcacataacaagaacaatttgtcagacctgtaaaaaagcaacaagactaaaagaacaaaccccatacagctttcagatatagctacatcaacactttgtactattctgaaatgtcattctaattcttgcttgacattgaccatctttacttatacaacacttaattgaagccttttctgttagcagcaactgcaactgtctaattaatcacctactaggcacacacatgtcattaattggtctttgcacaaggaggaattcttatgaagcacttcacaattttcctgccaaaaaagaaacattaagaaatgtttctgaggatacttgctgtcaagtgtatagaggttgtgaggaaaaagggaaccacagcaaacaagggaaaggaggccagttttctagtcctttctaagtcacattttcaaatatgagcttttaaattttatttggatgcataagaaatacataactatgccaagatatattatcaagtcaaaaatttgaggtgagagtattatctttgtttgcctccactaatcggtgataacaacttataaaactggagggtaaagttaatttgtgggactaatgtgcttcagtgactgtgttaggtatcattggactagaagatgagtgagatgtagttctgcccaaagcttaaactaaactacttgccctttgagaagaggcagttcttagatcaaatgctaccaaaaatctgcccatttttcagaagtagtgtagtagaagtaatcaaccaattgtgtgccaggtactacacacacagtaacttatttagtgtgacgtaaacacttaaaatccccatttagaaatcagcagaccaaggtcgtgtacaagcagctggaatatgaacccagatagtgcggctcgtttctgctcttgaccacactaattcacctttctgctgttacagctcagcattcaaagcaggatcattcttctgtaggtgctgggaacaggtacccagctgtacttacctttccatttttaaacactttgcccccttaatgtctgggaacaaacacatttattttaccttttttggtgaaaaattccttggaatattttcctgccacaatgagcttgcgaggcaccttccccagaagttctatgatcaatgcaatgtgatctgtatgtttcaaacgtttcaggagagggggaaaaaaaacacatacataacaggggtaacaaatgcagttctagacaatggcagaaagagtagcatgcacacctctttgtaaagcatttcagccttgctttctgtcctaaataggaagaggactctatccatctaatggagaatccaggaaactataaaaaatcaggtgtccactccagtgggacttgagtggtaactaaaaacaatcttggtgtgaatgctctgcttcctgaagttgtatccctggggcctagatgaaaactcatgttaataatactacctctgcgattgaagaagtcctgtgaatatttcccactgagggcaaagcgtcttggaattctgcctatcagctctataatgtgcacaatgtggtctaaaatagaagggtaagaagaacaggatcaaggacaagctgtaaaagagttttttaaaaaactgaatagatttctcaggactgtttaaaagtaactacaaatataaccaaggatactccatggcagactgggaaggtcaagaattatttcaggtggttaatcacctgatagcagctggcaagtcccactctatagagtctgaaggtttatttacatctttagttctattttgtctatacatctacatttaagtgggttaaagtaaaaaactaccaatatgctttagacattctagaacctttatttatgatactgctcgagatttcaagtagtaataatatcaccttaatttttttttaatttttttaaaattatttatgatagtcacacagagagaggcagagacacaggcagagggagaagcaggctccatgcaccaggagcccaatgtgggattcgatcccgggtctccaggatcgcgccctgggccaaaggcaggcgctaaaccgctgcgccacccagggatccccaatatcaccttatttaatgaagttcgtgacaaagcactcacatgattatctcaatttttattataactctgtaaaacaggtcaaaattaataaatacccccattttaatgatgagaaaagagaacctccgaataaatggcctacttgaaggtacagggctaacaggaactagaactcaaaatgaactcacatcttatcatgtttagttcggagctgcgtgtttgttttaaaataaatcacatcttaaagtagaaattagcacaaacatctacttgacttctgtagaacactaaaaggtgtccatatcatagtagtgccttgttatgtcacagcatgaatatggactgtgagcatgctagggagtgtgcatgtcaccaggcagtgagcctaggaacaggcggcatccacatgtacaggtaactctactacttttttactctgcagatgaaagcaactgagaatatgaagaaattttaaaaagtgatgggtgttagtcatttttgtaaatgactttaatcctgtagttatatacattccttaaggtaaaaaggaatgagtataaaacttcgactaatattatctgacagggaaataataatatgccagagacattaatctatctgagaatttgtaaaagtttcaggtcatatttatttctcatataaaggactcagtgctgtcattttaaaagggctttacatcaattcactacaaacttttgtcagttttgactgaacttagtttgctgacaagaacattggctgccaagaaatttctgcctattttaggcaaaacccgcaaataaaggtctttgtataactaattataagtgagactacagtttatcttactgtaaacttccaagtgaagtactggttcttttaatttttttcctagaccaaggaattatttttcccttgaatgtgttattttacatttaattccagcagtctatctctggcatatcagttaatcatagggctgatatacctgataggcaaaattgtcaaatattattccaagagtcagggctgtagaacaccaagacatcagaaaatatgcttcccaggtagggcccagtcctatcctgatttgtaataaactatgcatacactagctaggggttaagagtttgctttgtttctgctcttgtgtgccaaattgcaatagtctgaagtttcatctaaggactattagtactgactggtatgggaggaaataaatttggatctaaatacctagaatagatggttctcccttgctgcttactttggactttttatatacatttcaattttcaggtttggtagtttaagatcctacagaatataattccagctgctatctgtgtattctgtaacacatactatttacagggagtctaggaaagtaatgaggggaaaaaacctcaattactctcttaaacagataaagtagggcatttctaaaagtttatagccccaaacttaaaactggcacacacacacacacacacacacacacacacacacacacacacaaaaagacgcagattagggaaaattgtgtacatagatagtaattacagtatattcttacaaggactcatatatagaaaacactgtacccactaaaagaagtatttggttaacgaaattagtgtaacttttcccaaactacatgtgttaagagtaacattgtgtattaatatcccaagggaccatggtttaagaaatggagaacattcttggtttcagagaataaacctgattttcctaagaactgaggaaagtgcagaaaataaaggacgtgttttccacactgggagggagggtacattgctagtgttccctcaaagttaattcccattaatcctaaaaataaaatctgctgaaactgtataataaagaaggcaaaaacatttctctaatagtttttcgactcacgttattatctaagttatttggacaccaccatgatttaaaaaaaaaaaaatcacatattcagttgtgtgcttttgacaacccgtcagatggagcaactgacagcttgggcctttcccatcagctatcacaaaatgttaaatgagtaacacttttattttattttattaaagattttttacttatttgagagaaagcaagagagcacacacacaagcatggggagggacaaaaggagaggaagatgcagtttccctgcagagggacttgaaaccaggacccagggatcatgacctaagcccaaaacaacagtcagctgcttaactgacggagccactcaggtaccctaataacactgttttaaaatagaattctaaatgttagtatcatttacacacacaaaaaaagtatggctttaattttaatttttacaaagggtaaaaagattgctaaattttagagaatttatataaacaaacagaatatagtctttgcattcacaaatactacttaagtagtgtgtctgtatataaaatgactgacatccaaataaagttacaggcataactcagcagtaagttgatgagcatgcaattcaaagtgggtaaagaatgaatcactgatttatatataaagaaaaataaccagatgttttagaagaaatcatctggcaaacacaagttgtagtgtaatgaattgtggccgttcctctcgtcctcagagttcttaaatagccattataaaatatctagttacctaaaacttaatatacataaatcctatatatttctatcttttctggaatttatatatccttggcacactaaaaagaccaagtgcttcagtactaacaaatcatgttagccacatgtgagaagtgtaactgccatgcatagacatcctcagttaaggagacttaccttcatctcgagtgtactcttccccggaatgaggttcaaacaaatagtcgcctgtggccagttcaaaggcctaagaaaaggaggacagcatatgaaagcattaaaacaaaacaaaacaaaacaaagaggcagcctctgggaagcttattgcttgctatttatttagctcaataggaggtaacattttcttctttgaaaaagccgcaatgatcattcaaaaaaaagtctgatattatttctaaagagctttccttccacacctgtattttagtaaaatacagaaggacaagagcaaaaactgttaacatcaacatatggatgttgataacatccccttatcagtaattcagctctcttcaatttctttttgcccagagagggccatatgtggacattaaggtgattctaagttaattaaattattcgtgagaagagcacgtcttattttcttataatttcacatggctagaaattaagattctgtacacaaaatcaaaaccaaaaaactcagacatctctcttcttatgactcttaattataaaagtacatttttaagttttcctttgggaagtactccctaaactgttgagcagaagccccaattcccaaatttatagaaaaatcagaaaaatattatgtgtaaatgcagtgaagagttattcatgttttatgtgactagcaggtttggcactcacccaccaggaagagataggtacgtgtcttctacacgaaaaccttttgtaaacagtgttcaagaaataggaaaaagtgatttcctttagaatacatgccgagcagtatggaaaaacagcacctgagtgatagagctatattaatctttcattgattaaaaggactatactggtataaaagtatagtttaagtgccagttgcaggtcaattttgattaagtcaatggtctggacaatttcaggaactgtggggtggattctggagtacattctctaatttggtcctaggtattaggtctcagtggcttgccagagtcagcttctgcagtttcatgagagaacagcttttctcaaaaactattattacctgaactgtactaccgcccaggtatacctggttttatactgaaggtgatactggctctaccctcccctctaactgtcctgaggcttagagtcccaaagcagaacagaaacgaactgtgattctaatttatcaaaatttgttaatctcttcagaaactagtattttttcaaagccttgtagtgtgacttcagtaaaaatactgtaattaaaattcaaagaaataaagaaaatgcacaactaaaccaaataattacaatgtcagaactgaaactagcagaagctctaggttacaaaacactttagtcccctccctttatagatgagaaaactggctataactgaaaggcaaaaaaaagcccagcctagaatccaggtttcctgattcccacttctgtgcttgtctcacactaaccaaagagcctattctgtgacagtcatgctgacaaacagaggcaacatcagttatgaaatccagtgtgctggtgtatctagacaatgcagtattatttagtgcaaaaaaagaaaaagctatcaagacatgaaaaaccatagaagaaccttaaatgagtatcacgaagtaaaagaagccaatctgaaacatctacatactttatgattccaactacatgacattttgaaaaaggcaaaactgtgaagacaataaaaagatcagtggtggggcagccagcgtggctcagcggtttagcgccaccttcagccagggcgtgatcctagagacttgggatcgagtcccacgttgggctccctgcatggagtctgcttctccctgtgcctgtgtcgctgcctctctttctctctcatgaataaataaaaaatcttaaaaaaaaaaaaaaatcagtggtggccagatcaatggaggagatggagcagggataaacaggcagagcacggaggaattttaaggcagttaaactactctgtatgatactacagtggtagatacatgtcatcatacatttgtcaaaatctacagaatgaaggatttaaaaacatctattctttgtcaactctaaaatggccttcacagaacactcccttgttataactgccctctcactgggtagtctcaatcactacggaggcaggcaatttcttttatctctcagcaaagactcctatctttccattaattaccctggatgtaggatgacctacctttccaggcatttcagatattctgggatttatttatctttacttcctggttatggctaaagggaaagcaacattcctacgtctgttagcaaaaggagagaaacttcgggaatgggaataaaggggctcaagtttccatgacacggtctcatgtcaggtaagtgctttccctctcttggtcaagaaattcctgcatatgagctgctccaaacagggggcaaggttaattccctttttgtcttattgccttagtattaatatactaaatagtaagcaggacttactgtccccaaacaacccatgactaagaaccacatcataataaatcagatgtgatctataaactgttttgtatttagtggcagctctatcacttattttgtctcacaaatcaaattcctcaaaatacaaagctttaaagtatggcaagaaagaagctagattttcttttaatattctttgatcttgtgcacacagtataaacttgaatttcacacagtctaccatctgaacagactactggtgtgccataacacaaacatttacaaggtcatgccatataaacaatacggttttaattctattacctttggaagacaaagtttttttaagaatgtggatatcaagaaatctacgacctaaaataggttggggcctctagtctgtagcttctcaagttttcccccaaagctgactttgaataatgttaattgaaatgacagtttaataggtttctggtttagtttactcattcgatggtccatcaacattcaggaagtactattatataatagataatttgtttggtcttggaagcctctcaaagcttggtatttccacttgatgagtgccctttgtcattcatggtaccccttccaggtgactcacggtgactcatggtgggctcctacgtagtttttaagaagcttcacctttgctaccctcttaggcctcactctatgtgtgttttcatttgactggttctaatttgtagcctttatgacaaaactgtaatagcagttgaacgctttcccaagttctgtgagtcattccaataagatactgaatctgaaaggataatggatcctcccaacctgtagccagtggtcagaaatgcaggtggcctgtggactccagagtttgcaggcagtgtctgaagggagggggcttgtagggaattatgcccttaacctgtgaagtctgccataactctgggtagttagcaccagaattgcactattagaacctactggaaatgtgccaggccctgaaccagacactaagctatatataacagacatggttcctgtcagcatgacacttaaacctagtaaaagagaaacaagtaaagaaacacataattacaaactgaagagtgcactccatagaacacattccaacataggctatttgtgggaaaccattcaatatcaagtacttgagtactcgagtagttgtttggcagggacaaagcagcagtttaagaaatttaggatgactgggctttcacatcttttgaggtacaaagatgtttgaggaactgtcaaactatacagaatgaagtagtttccaagggtttccctaatctgagaacaggtcagagctgaaaggacaaaggtactcgtaaccaggggcctgggtagctcagtcagttaagcttctgtctttggcttgggttgtgattccagggtcctgggagagttctgcactgggttccctgctccacagggagcctgcttctccctctctgccattccccttgtttgtgctcttgctctctctctctgataaattagaaagaaaaaaaaaaaaaaaggtactgataacctcctaatcaaaagtggtttaccactttagagcagttgtttttaatcccctttgccaaagcccacaataagaaagtctgatgctttcaaccaacagcaatttggcagaacaaaacagaatgctggatttttttgacagagagggtaagagtgagcatgcacatgtgcacggatggggttggggggcttggggttagggggagaggcagagagacaatctcaagcaggctccacgcccagaatagagcccaatctcatgaacctgagatcatgacctgagctgaaatcaagagctggacgcttaaccgactaactactaaccacttaagccactcaggtaccatggaatgccagatgtttttaactggcttttgaattcccacctctctagacagatttaaagtgcatcacatgaagtacatcacaaaaaattttcctgtttgtaaatttgcaggtctactaaaattaacaaacagggcaaggtgtagaaataccacataaggggaaaaaacattaccatgcatgctgtgctccaaatgtcagcaggggtattatagccagatcctatcagaacttccaaggaacgatattgccttgtttgaatatcttcagtgaaatgtttgtgctgagtaaatagagaaggaaacagtattttaaaatttatttattctaaaaagtaacaaatcatgaagaaaaatggaaattaaaataatttctcttaagttttcctcaaaccagttttcatttaagtatcattttgatactatagcttcaaagagtactttaacacactttctactccaaattatttttataaacacatgtgtctaaccttaatatagatatacattcttaaaaaatgctatttaagaaatggaaaacttattaccccaaacaaaaattaagttggtcatttgtctacagttaataagcacttcaacaaatatatgacaccaatttagattcaaatgaaactttccttcttatgtgctcattatgaagaaataaaagatttggtttcaagtttcaagaatcttgtaaccacctataaagaactcttggcctcattctcccccatccccatcactccaaaaaattcaaacatgattctaggggaaacagagaccatgttaagtaccatgggaatgcaatcagcaaaaccactggaatttctttaacacataaactgtatgggaagaaaagggaaaaaagtatagtaaaagcaattcaagagacatagtacctacttttgtatttatagattttacttggatcccatttcaaataaacaaaattgaaagaatgtttacaaggtaaaaactgattgaatacttgttattggtgaattgccaactttttaggtaacaactgtgtcatggttacctgcaagaatcgtcttttagagagccatatttaggaatgaaaataagatacctgggatatagttcaaaataatttggaatgggtgggagactggggcaatagatgcaaacaaactggcaatcagttgataattgctgggtgacactagtttaatggcacaggatttcatcactgttctattctctctattttagtacaggcttgaagttggccataataaaaaatattgcagaaaaaagtttagaatgagtcatacatacagaacacaatacagataatattaaaaaacatttaacaagaatgtgtggaagatgattctttaattttcctggaactcataaacaagatcaattgctttttttgccccattcattcaagttttatttatttaaagtaatctttatactcaacgtagggcttgaactcacaaccctaagatcaagagttgcatgctcctctgactgagctagccagaaactccaagaaagaacatttgtgaaaaggagattattaggaagagaaagcttcagggagaaaaccagtattgaccagagcttctaagggacaaagactgaccaaaaagagcaacttttgtacttctggtagagacaacatcaccaattgaacagaaagacatctgttgaagccaaatacagttaaccgctaggttaaacagtttggatttcatctggcatcactgcatgttaatgcgcaggacagagtgctacaagaagactgacaagggatccctgggtggcgcagcggtttggcgcctgcctttggcccagggcacgatcctggacacccgggatcgaatcccacgtcgggctcccggtgcatggagcctgcttctccctctgcctgttgtgtctctgcctctctctctctctgtaggactatcataaataaataaaaaaaaaatgtaaaaaaaaaaaaaaaatttaaaccccaagctttggcctttaaaaaaaaaaaaaaaaaaaaaaaaaaagactgacaagaaatctgaggacatcattccagtgattttctggttggtggccagatttaggtttaggaatgaaaatctgaacactggttgtggagataggagagggaggactaaacataaggacagtcaaagaaagaataagcagaatttaaaaatttgatggctctatgtgggaggtaaggaggaagagccaaaaagaactcagtggcagaggcctaatggattagctgtctgttgaaaaaccagaaaagacttagggaagtggttttacagaaaaacaatgggttcagatattgagtttcaagtggaaatgtactgtaggtgattgtgtgtgtgtgtgatcattcatatgtatgcatcattcaaaatgtatttctcatatatatttggtctttatccactgttcttggctcacaactccctaaatccctggaatttctggagcactaagagtaatgggaacatatttgatataaattgtctcctgtcctcagttcctgaaaacactccagaactgtaaaggtaaaatgggtgtcttattattctaagaagcccttttctaccacaactgaatctatgttcatgaaccaacttttggaacccacctaaggatggggactggttgctagaggaactaactatgactagagggtgggaattttcagtccatatctctgatttctgggtggggggagaggggtaagggactgaatagtcactggtggtgagttaatcaatcatgcctatgtaataaagcctccataaaaacacaaaaggagggggtctgggaagcttccacatgggggaaccaaaatgcttccagcacatggcactggggcaggcccccagctctgtaaggacagaggtgcctttgagacctcaccctatatatcccttcctctggctattgataacatcctttgcaataaatcagtaacgtagtgagtaaagggatttttctgggctttgttagccattctagcaaatcaatcaagcccaaggaaagggctgtgggaatctctgctttacagccagttgagtcagaagtacagggaacaacctggacctgtgattggtatcttgagttggtcaagaagcaaaggtaacatgggcttgccactggcatctaaagtggagggaggtcttgtgggactgaccccttaccctgtggaatctcattatctccaggtagataatgtcagaattgaactgaattctcagactagtgcccaagaattgtttggtgtgagagagccttcacatacacatacactttagcattgggtccaggcatccttttcagtgatatatttagaaaaatggacacactgttcaagggagttatctttactcctcctgtctcactactgcctttaaaaagacgctgtaaaaaaaataaataaataaaaataaaaataaaataaaaagacgctgtagagatgcctaggtggctcagtgattgagcatctgccttcggatggggttgtgatccacgatccggggatcaagtcccacatcaggcttcctgcatgaagcctgcttctccctctgcctctgcctctctttctctgtgtctctcatgaatagataaatggaatcttttttttttttttaagacactgtaatgataaatgaggtccagaatcagcaaaagtaaagaaggtggatcacatacacacatttactcactcctaaaactctaccttagtaagaattgtgttaatttttatttatcttttttaaggatttatttatttatttatttatttatttatttatttatttatttatttatttatgaatgagactcacacagagagaggggtagagacacaggcagagggagaagcaggacccatgcagggagcccgacatgggactcaatcccgggtctccaggataaggccctgggctgaaggcagcactaaactgctgagccaccagggctgccccacagtgttaatttttaaaggataaactaacgaagataatggcaaagaagttagagtaataaaatttacaacatgaaaaccagatcactggtaaatatcttaatggatccaagaaaactgaataaaccactggtgaaagctgagaagcagcgtgatgtataccacagtaccccttgcctcaaggatcagggtttggcagtatcaggtatcacaagaaaacaggggtgagggtgggatttaatcagaaatgtgctttataaaaacatcttttaaagatggggcacctgagtggcttagtcagttaagtatctaactcttggtttcagcttagatcatgatctcagggtcatgatatcaagccctgtgttgggctccatgctcagcagggagtccgcttgtcccactccctttgctcctcccctctaccccacacctctcactctttagtacactctttaaatacataaaaataaaataacaacaaaaacatcttttaaagaaacagggctccagaacagagggcatcatgcactctaacagcccctttcttggccagacagatcatttggaggttttctcccaagtgggtaaaacaggatctatgaaggatgctccacacaattgaggggagagtacctctgagaggtaattagaaaaccaaagaacttggaggaaataaacgaataagtaaacccccccgccccccaaaaaagaaagaaaaccaaagaactcttgaaaaataaaatgcaataggagaaatgagaaaaaaataaagctagttgagaaatctcccagaaaataaagcaaaaagaaaatgacagaaaataggagagaaaggtaagataagatctgcataaaaggtctaacatttggataatatttcagagctagagaatagagaccaaggaaagaaaagaaagaaaacaaaaaaccaaacagacaaacaaacaaagccaaaaccaaagaactagaatttcaatattaagtgtacacacaccaggggtgcctggctggctcagttggaagagcatgtgactcttgatcttgaagccctacactgggtgtacaaactgcttaaataaacttaaaaaaagtaagtgcacatcaagtccatagtataacggataaaaacagacccaagtgaggcatagcaccatgaaataacaatcttataagactttcacaggggaaaaggttttggatcaagaatcagaatagcattggtctttagcagcaacaagtcagggaattagaagataatggagcaatgacaaacattctgagagaaaattatatctatctatctatctatctatctatctatctatctatctatctatctatctatctattcacccatccatccattcattcatgagagacagagagggagagaggcagagagggagagaggcagagacacaggcagagggagaagcaggctccgtgcaaggagcccgacacaggactccaccctgggtctccaggatcatgccctgagctgaaggtgatgctaaaccgctgagccacccaggctgcccgagaaaataattttcaaccgaaaactgcattgcagccaactgagtgtgaaagtaggacattagcagacatgcaagacgcccctcccagtctcacatattttcttaggaagctacgacaagttgtacatactccaaaaaacaaaacaaaacaaaaccacaaacaaagaacaaacaaacaaaaatgatggagaaaaccaagaaagaaaatcagagggcagcccgggtgtctcagtggtttagtgctgccttcagcccagggtgtgacttggggtcccggaattgagtcccacctcaggctccctgcatggagccagcttctccctctgtccgtgtctctgcctctctctctctctctctctctctctctctctctgtctctcatgaataaataaataaaatctttaaaaaaaaaagaaaataagagagacagaaagtagaggatataaagatagagtaaacataatctccaggaatgatggggaaaggaaatctgaatggcagtaatgccataggcatatgaggcaatccaacagtgaactcagggtagaagactcaggttccacacagagctcttcaggaagaagttgaaagagtacccaaggtatctgtatgcattagagtatatgtatttataccacttggtgaaagtatgcggttgaattaaagtaataaatagtacaaagacaactaagcaaatgaaacacagtgttaggcagaaaaggaaaaggaatcagtacaatttatgctcaaaacagcactgggtcccaataatgcaaacatggaataaataaccagccaaaatcatatattaaattgggaacatgggggatgggtttagtgatagtatgtaaatcctgttttctaggaagaaataatgcttaatattgaaagaaaaaaattgggagcagtatagcttagatgtttattagtgatatgaaggtaaatactgtcgtgtggggagtaacaaattggcaaagggaaagggcagattttttttttaagattttatttattcatagagagagagagagagagagaagaggagagagaggggcagagacacaagcaccatgcagggagcctgatgtggggcttgatcccgggtctccaggatcatgccctggactgcaggtggcgataaactgctgtgccacccgggctgcccaaggggcagatttttgaaacaacatccaaactatatacatgcaaaactagtaagaatattttttaaaaatcaagcaatttgaatatcatatacaatcccattactgaatgctagatgctgctctgctgcagagagtagtaagattcgagatttgaccaggatccagcaggtaagataccgttgtctagttcacactgtgtcctactagtaggtcagagcatgtgccaatgtttgctgaaggagtgaattaatgaaaagaaggcaaagtcttttatagcacagagacacatttaaaaagagaagagacatgcagattaaaaaaagagagtaactgtaaaagtgacaggaaaaatgtagcagaataaaggtgtgtcaaatgtgttagaaaataatggaagaaggatgcctggatggctgagtagtagagtgtctgcctttggctcaggtcctgatcccgggatctgggatcgagtcctgcatccggctccttgcagggagtctgcttctctctctgcctaggtctctgcctctccgtgtgtctctcatgaataaataaataaaatatttaaaacaataatggaaaaaaaaataaaacaataatggaggaaggtgtcctatacacaaaggcacagaagcttgaagcatctgatgcttgtacaacgtggtgtctgggacagagccaatgtgtttcttacaattcatttacttgcatatttatttatttttttaaagattttatttatttattcatagacacacagagagaggcagagacataggcagagggaaaagcaggctccatgcagggagcctgttgtgggactcgacccggggtctccaggatcacaccccaggctgcaggcggcaccaaaccgctgcgccaccggggctgccctacttgcatatttattgagaacctcttaggtaccaggttctgttataagtactattatacagctgtgaacaaaaaaaatctgtcatgatgggatgtacatttagggagagggatggtaagcagacaattatatagtatcagactgtgtgtgataagtgctatggggaaaaaaaaattgaggggagagaggaagaaagagaaaatacatgaatgaatataatacaggtgtacgggtttggagagtagtgctttgctaaatatgttaggtgttcagggaaggagctccctggtaagacgacagctgaataagaacttgaagaaaatgagtgagttgtatacattatcttgggaagagaatttcaggcagaaggaagacatcatttgcttggtggtgtgtgggacatggtaaagactgtggcattcatcttgagggaagtcactgcaactcacatttaaaaggatcactgatagctgtgttgtcaactccgtagggggcacaggcagctgaagggagagagtgagtaggctactgcagtaatccaggtgaaccccggctggcctagaccagagtgatttatcgtaataattttaataacttatcataacttatggtaatttgatttatgataaattaatagtggagtaattctaattacttgaagagtttttccccattcctaccagtcagtgctaagctctgacttcatttttttttctaaaaagttatcacaatatcctagaagtgaggtacagaatgtctcatggaataaaaaatctgaagtataaaataagtgtaaaacctattaaagtcgattttcaacaatgcatagtttttgcttcagcaatcttcaacattcctgttagaaagtataggattccaagtactgtcatttatgtgcaaatcattctactgtcgatttttgagatgttcattcaaaaataatgtgcccccctcttaattcttcactaattcttaactagataaacaacagtattaatatgacactatacatcaaaaaccccttttttaaaaagcacccaacttttgactttggaattctatgtctagggtatgtcctaaggacaaccacacaaggatcatgagcaaagatactcatcacaatgagccatccaaaatgtgtaaaacgtacaataccttagggaatattacataataatcataatttgatgtaaatttctgggtgacaaagaaaggtgtccaaaatatgttaagggacttaaaagattacaatgagttaagttagatgccaattttgaaaaagggaagtacaaatataagcactgtgcatatgaaagtgaatgaggatacagataaaacaagactggccaggagttaacattactgtatctgggtgataggtacctggagtgggagtgaggagtataccactctctctacttctggaaatatatttgaactttccaataacagaaggctaataagaaaacagtgaaaaaaatgttcactaaaatgttaactggcaacctggatatagatctgcagatgttttttcttccttagcacaattaaagttcaagttctcatttattcctagtcacttcaaaacacagcactaagataaaataagtttaacttaccacccaacaggcatttccaagatcagcaatcttcacttggagcttttctgcattttttggctcaaggggattaacaagaaaatttccagcagtggattttcctatagacaaaggataccattagtaagactgtttagtgaacacacaaataccccaaaattaataaaactctctgaagcaatatacctaggtccttgactggcaaaatttatctaatttttgtaagataaaaagagtatagtgacaccttcagtttacacaattaaaacctacctctaaaaaaaaaaaacacacacacacaaaaaaacacacacacacacacaaaaaaactacctctgcctttggagcaaaaaagtgaaatgctgtgcgcatactacatgactaatacaactcaaaattagttagaaatgtacacagtggaaggtaacttgggtacttgctgtagagctttatttataaaaacaatgaatggtagcttcggtctagaaattcatgaatatactattcagggaaggagtattggggcagtatgtctatctaggtacctttgttgtccaatggtccattttgttcttgctcttgctcatcttcacagggtatctctgcccggatgctttcctgaagttggctgatgtcctgttcattgaatgactgctctgcatttggtgaagcctggcacatcatggtatctgatacctcagaggttataggtgtacaagagtctgtttcttgagatgtgctgctgtctccattttgggagcctaggaaactaggttcctgcttcaaattttggacatcacagtcattagcattatgtagatcctccttaagcctcaatgtttctttattactgttttcagtataattaatgatttcagttactccattgcaattaatttctggtgcaccaccctctacaccacgttccataagtgtttgatcctggtcaatggtacttgactcttctaagaacaaacagacaaaaaggatgtatgtgttatgtgtatgagtaaaagaacaaaaaaattttctccacaagattaaaacgttttctagaacttacacagggtgacataaaaacatgactgaacatctacgacctatttatggaaggacaaagatcttatccttattcaattgcaaaatgaagtctatgttgcatttccatagaaaattcagaaattacatttaaatattacctgcctgacatttatgaaggttctgtactcttactgtataaggacacccccagagatgtgctgtatgcatgaaaccagtaatattatagaacaatgataaattaatgttaaagtaaatttttgtgtatgctctatttataccaagtttttcttgggtcattttattaggtgggttctctttcaagggtctttcaacaggactctctgattcttcttgcttgtttggtcttttttgcccagggcccgactctttctccatttcctcaatttcctgcattcgcttctctagtaattctgcctggcgcttctgcttcttcttcaatttcttcttcttattctttgacattttgtcagcctgggcggagattacaaacagataaagccttcaggtggctaatccattacccccagttggagataactgttaactttaatatttcctaattacatttcaatctttccctaacatagcactgaagtttctcattaacttaaacaatgtggatacccttatgaaaccaaataaaaacaaacttaacaataaattttggtcctctgagctgtgtgtggggctggtgtactctcagatacactcaagtttacagaagcctcaccagtacaaacttgttaaaaatgcaagagaatttattggagaaaatatagaagcgcaggaatatgtttttctttggttttcatactctatacagtgatccctaaaacaagaatccctgcccactgcccagagatcagaattaaatatagaaacaccttatacttactggtttaggctggggcgcagtactgactgaaaagaaaagaaaaccaagtaagaatcctggcattcagcaagcaatgcaggtttatgttacagagaaaactactgtttttaagcaacttcgatagaagtaccatttaaaaaaaaaagaataatgcatatacaacttggcaaaattaattaagtttaaataaattctttcccagataaaacctgtaattgcaaagagccaagtccccatattttgtttccaccattaatgctgcaaaaatctcactcctatatatgcttaaaatagaaaatgacaggcaataaccccatcgttcccacccagaaccccgtctcttacttcttccccttggcagtggtcagttttaaatggagcatggcatcaagaattatatagtaatttattacacatcatgttatagatgttagtttagcttaggcaggaggtagaatcttccgcaagaaattttttttaaattgtaggaaaatccacactaagtaaaatttccctctgaaccattcttaagcatacagttcaaatagtgctaattatactcacacttttgtgtaatatttctagaatgttttcattttggaaaaaatcaaactctatgcctatcaaacaccttctcatttccccttctttaggcttcattattattatttttaaagattttatttatttattcatgggagacagaggcagagacataggcagaggcaggagcctgatgtgggacttgatcccactccgagccaaaggcagacgctcaaccgctgagccacctagacatccctaggcttcatttgccttgaggatcaagaaagttcctcaaaaaacccctcaaatataataaaactattaaaattaaaaaatatatattccaaatggcaaaaaaaccatcataatcagccatcatttatttggcacaacactgtgtggcaacctattaactgctttaacatggaactaaatctcaagaactcctgcatgaaagaaaagaaagtcaaagcaagtcaagaacttgctcaagaacacccagccagtgatgaagccaggattcaaaccaggtctgtccactccagtgcttaaattcaagttcttaatagcaaagttattttgctcccgcacagatcacactgatctataagcaagcatacaggttatgctcatggtaagaggtaaacacaccaaaaatggacactaaatcacaagagaaaatattttaaaacaagaacatgagggcagcccgggtggctcagcagtttagtgcctgccttcagcctagggcctgatcctggagacccaggatcgagtcccacgtccggctccctgcatggaaccagcttctccctctgcctgtgtctctgattatcttgctcccctgtgtgtctctcataaaataaataaaaccttaaaaaaaaaacaaacaaacaagaagatgagtcagcttttatagcatacaaatgaatgagtagcagaattaaaataagaacttctcttaacttttttttttatagatttatttacatatttgaaagacacagagacagagtgggtgagcaggaggtagggtagaaggagaagggagcaagcagactccctgctcagtggggagcccgacttggggcttgatccaaggaccctgaaatcatgacctgagctgaaatcaagagttggacatttaaccaactaacccacccaggtgccccagaacttctcttaacttctaatgagaccaaagtcctcaaagaaaacatacccgcagatccagaaggtggaggagctccagatcgctgccactctgttgcttctgcagccagtcttcggatgtactgctcattcactgacaacaagatgttttctggtttaatgtcagtgtgaatgatacggcacttggtgtgtaaataatcaagaccctgtaacacctggatgggaatagagcaatagacttgcaaacacagaatacaagtctttctggagaagaaagaaatcacaacacaacatttaaaaaaataaaaatataaaaacaatatggtagttttcaacagagaataaagcatttttaataaggcagaaagaaacttccccagaaagataacttgtcaactaggagcaaaggtaagagtttataataaagttttaaaaagctaattgtatttggagatatttaatgaagtacacaaagactcagaaaaaaggtcattatgctctttaaatgttgacatatgtgtgatgaaagagatttggattatgtctttaattcaaatttccttgctgatatagaactgagatctcttgattcctagtttggagctctttccaccaaaacacattacccaaacaattatttgccctttcaaatactaatattttcctgagagtaaactcctttactgtatattgaaacctatttagaatattagaaaatgcccttgaataatattctataatgatattaataatttgacatagtaattctctattaccacataatcaatatttgcaacagaactcctgggtacgggctccaaatttccaacatcagtcactgaacacaccttcccctctaatgattattacaggagatgaatctggaaaaatggttattgctaagacacttaatgacagaataaacactaggggctaaaccacttaattttagcaaataaaattctctagtttttaaaataaaaattctattggatataggaaactcttgccacttttaagaatctaaaacaatcagcacatagaaaatactaaaatacatacttgctggataatttttttaacacaaggcagtggaagcccctgataattagacttgatgatccacttgagcagatgatgccccaagacttcaaacaccatgcagatatctaggagtttgttaaggaaggaagaggaaggcacaagagaagaaaagaggcaaaataatgcgctccaccccaatgaaattattactgttttattccttcagtatacaaagatagagtatgactaaaaagatatctggctgtcaatattctgaattccaaagattcatgaatgctttagtaactgaaaacagccaagaaatagaaaatttcagggggtgggacgggactggtttatcaataaaactgtgcacattaaaatactcagtagtgggcagcctgggtggctcagcagtttagcgccaccttcagcccagggcgtgatcctggagacccaggatcgagtcccacgggctccctgcatagagcctgcttctccctctgcctgggtctctgcctctctctgagtgtgtctctccataaataaataaataagatctttaaaaaaattaaattaaaatactcagtagtaaaagaacagggaaaccacatccaattagtggaagcactaggcttaggcacttttccctgatgcaaaattaatgttcagagtaacaatccctactctcacagtctcaaagcaggaaaaaaataacttctgttttaacaacaggagataatgtaccaaaacttaacctaaaaaaaaaaaaaaaaaaaacaccgtgaaggccaacattttctaaaaataagaaactggcttgctttatgctctgtagattacaaaactaatcttgattctactgccaccatgtgttctctttatgtatgagaacataagcccaatcaacataagcaggaataactctacaaacctactagcctgcagggcactgctgggatttcagtagtatgttgctaccttgtacctccagaaatggcaaagtcaagatatacatatgtaataatgacctagtacccacatttttccattaaataagattctccactaaaggaaaacctaggttccttaagaaatggctaaatcccaggcgaacctggaaaccttgctgtgtgaacagtaatggaacatatcaaaaaggaacaggaaccagcttgaagaggataccagccaagctgaaaacattttaaataatgaagttatgacttaactcaaaagtaaaaattgaatgagtccaaacagatactaaaaaaaaaggtatgtgttgtgaataaggaattatcttttttagttttaaatttttattatttttaactttttaaagattttaagttatctctatagccaacatgaggcttggagtcatgactgcaagactaagccagtctgatgctcctgtaaatatttctttatagaaaaagtcaactaggggcagccccagtggtgcagtggtttagcgccgcctgcagcccagggcgtgatcctgagagccgggatcgagtcccacattgggctccctgcatggagcctgcttctctctctgcctgtgtctctgcctctctctctctctctgtgtctctcatgaataaataaataaaatcttaaaaaaaaaaagtcaactaaataagtatacaaagagacagaaatagaaaatcacacttttacaattcctatagtgataattgattcaagtatgaatcaatgaacactaaaactactagtgaaagactgttgggaataaagtcacaatgtcacagtatcatcccagattgcttattaattataaaaggaaaaaggtaccagaccaaatgtagggaaggatgtggaacaattaaaactctcatatttgctaacgaaagtgtaaaattgtataaccactttggaaaactggttggcaattgcttaagagctaaacatttacctagaaacttctgcttcagtcaaaatggagttagcaaggactggactgacctttctagttaaaatgacaacaacaaaagcagacagaacacataaacaacagatttattgaccctgacattaggcaacaaaggcagtgatccttgagaaaggagaaacaaatgaggtgaatcctatgattgccccatcttactgccttgagcctttccagatcccttgagtttaagagatggagctaagagtcttgggagaccaaggcagctacatgtcatagaacaaagtaccagagggagacagctgcagaaagagaatcccggagatctgcagagggatgccctcaagtatttagcacagactaatcagcagaggtatacaaggaaactactggaggcagggggaaagtatctgaagggattagagggaacagtggccactgtttccagaggactccaacaatgtctgttctcatcaaaaaggctagacaaattcatggtcatagtcatgggccagaaataaacccatatatatagtcaattcatttatgacaaggagttgtaaatatacactggggaaagaacaagtctcttcaataaatggtgttgggaaaattagcaacatgcaaaataaagcaacttgaacactatcttacactacatacagaaaattaactcaaaatagagacctgaacattaagatctgaaactataaaactcctagacaaaaacataggaggtaagctccttgacactagtcttggcgattatttttttggatctgacaccaaaagaaagcaaaggcgacaaaagtagaaatgaacagaggactaaatcaagctaaaactctgggcagcctgagtggctcaatggtttagcgtcaccttcagcccagggcctgatcctggagaaccaggatccagtcccacatcaggctccctgcatggagcctgcttctccctctgcctgtgtctctgcctctctctttctctgtgtctgtcatgaataaataaataaaatctttaaaaaataaataatactcttctgcacaccaaaagaaaccattaacaaaatgagacggcaatgtactgaataggagaaaatatctgcaaactatgtatctgataaggggttaatatataaggaacttgcacaactcaattgaaaaaaatcttattaaaaaatgaggtgtggggatccctgagtggctcagtggtttagcgcctgcctttggccttggggcgcgatcctggagacccggggtcgagtcccacgtcaggctccctgcatggagcctgcttctccctctgcctgtgtctctgcctctctctctctctatgtctatcatgaataaataaaatcttttaaaaaagtaaaaataaaataaaaaaataaaaaatgaggtgtgcctggttggctcaatccattaagcatctgtctttggctcaggtcatgatctcagagtcctgcaattgagtccggagttgggttccctgatcaatcgggagactgcttctccctctccctccaccctttctctgcttctgctctctgtcaaataaataaaatatttttttaaaaatgagcagaggatataactagacattcttccaaaaagacattaagatggccaacaggtaaatgaaaaggtgctcaacatcactaaatcatcacagaaatgcaaatcaaaaccacaacaaaatagcacctcacaactgtcagaatgactattatcaaaaagagagagagaacaagtgttggtgaggatgtggagaaaagggaacccttgtgtgctgctggtggaaacataaattggtgcagaaaactacagaaaatagggtcagtggttcctcaagagattaaaaatagacccagcaattctacttctgagtatttatctgaaagaaatgaaactgttatctcaaattaagttacctacatcctcatgctcattacagcattacctacaatagccaagacacagtccactgatggaagaatggataaagatgtggtgtgtgtatacaaacttccagtaatttttttttaagattttatttatttttattcatgagaatacacatagaggagagagaggcagagacacaggcggagagagaagcaggctccatgcagggagcctgacgtgggactcgatcctgggactccaggatcatgccctgggctgaaggcggggctaaaccgctgagccacccaggctgccccaaacttccaattataaaatgaataagtcttggggatataatgtacagaatggtgactagagttaacaatgctatattgtgtatttgatagttgctcagaaagtagatcttaaaagttctcatcacaaggaaagatttacttgttattcagagttactcacctgcaacaggaaaaatgttaactcactgttacaggtgagtaactatgaatggtaatggatgttatcttactgtggtaagatatgttttatcttactgtgtataaatcattcatttgtgtacattcaaaattaatgtaatgtcacgtgaattttctatgttctacgtgaattttatctcaattaaaaaaacataaaggctagaaaaattcatagtcatgggtgtgcttgggtattcagggaggtgttgcctcagtacagggaattaataattagtcctagactgaacactaccctggatctatctaacaaatcataaatgtaaaatctgaaaaggatccaactgtttccaagtgatataactgcatcccagaacaaagctcaagaagatttatgggaatggaaaatatccagcagccaaatgcaaaaaaaaaaaaaaaaaaaaaaaaaatcacaagattactaggcagcaaagatgcaagaaaacaaacctgaaaactccaataatcaatcattcaaaacgaaccagaactgacataggcgccagaattagcagacaaggaaattaagcagttatagctatagtctgtatgttaaaaagtagagacatagtactataaatatataaacctaaaatgaacttctgagatgaaaagtacagtgtaagagatgaaaaacacactgtattggataaatggcagattaggcactgcagaatgaaaagattagtgaacatgaatggcacagcaatagaaaccatgcaaaatgataaatacatggagaaaaaatatcgaaaccaactaaccagcttacccacccacaagaataagctgtggggacaacttcatgcaatgtaaaaaataaaaaataaaaaataaaaaataaaaaataaataaataaataaataaaggaggggaagaagagaatgaagatttctgctctttgccaacagatcaacaaatcataaaagtaatggcagttaacaactccatgacaatgtgtacttctagtgcttagattatgcttgccatttcctactaaaaggaattaaggcttaagaagtaatggccaattccaggttcaggacaggaaatgtacaagagcctggaatatctcgatgtggcaaagaataaagaaattgcaaagacttatgtgtaccctgacctaagtaagaattaaaaactgaaagaacaaaaaatatgagacatttagagactgaaacactgactagattagacactgaataacaaaaaaactggtcccaattttttttaggtgtaataattgtattgaggttatattttaacatccttgtctcttggagacacattcttttttaagattttattcatgagacacagacagagagagagagagagacaggcagagacacaggcagagggagaagcaagttccatgcaggaagcccgatgtggaatttgatcccaggacctcaggatcatgccctgagccaaaggcagatgcccaattgctgagccacccaggcgtccctggagatacattctaagataactgtgagtgaaataatatatctaaggttggccacaaaattagcaggaggtagacagagacaaaacaagattacacaagatctaaaatgggtaatgtgtcttgtggggattcattaaactattctacttttgtatacatgaaatataccaaaacaggattttttgaaaatgcaggttccttaaagaaacaaccccccccccaaaaaaacaaaaaaaatttaagttattctcttatattcctagtttcaatctttaatttgttgaaagcttacaatttgacaatggtattttaatctgtaagcagtgatataaaaatgaccaaacatttagtagcttaagaaacagaaagaactagatagaaggatacatgaaaattttttcttggggaggtggtgtaaagaaaaaacttacaaagtactaaacactgacgagtcacatttagagcacattatgagtaagaggagctaggaagaggcaaaataaatattaaaaaaaagaagtctcctaaagacatagtaggtcatacagatggccaaaaaaggacactcaccagttaatgtcaatagtatatatagaacagttgtccctctttcatcacttcttgccccttaccacctacggaagtagaatgaacgatgtatactgaagtctacataactgactttctagttcaaggccccttatatttcagtatgggaaaggacagtgctctggaaatgctcagatgcaaagaaaaatacagatatatacctccatgcagacatgcttatgttgtgagaagagaacagcataatccattaaccattaactcagtgctctgagttttatccttttcaatctctattagcagcaaaactgcagtagccaagatacttgggagacaagcagaaggaagggcaaagagaaccgggctcaggacaaaggactcagtggataaaactacagagaaaccacctgttaatacttgggaaatcccttggaactttaaattcaaatccactaagatttcaatagttaaaagcaaaatcaaaaacaaaacctttcttcattagactccaaaggtactcagcattactgaagagactatttagaatatttctaattttacttgtaactttcccaaatgagcagagagttggcatgacattataagatcaaataatagggaaacagaatctaatggccatcgtgacatcctaatgtatgattttagatcttggttattagccttattatatgcacacagagtaagccatctacaaagtgaccacaatagtcacaagattctattttatttatttatttaaagatttttttattcatgtattcgagagagatagagaagagacagagaggcagagggagaagcaggccaaaggcagaatcttaaccccagaaccacccaggcatccctgtgatttgtacttttccaaggaagtaactcacaactaaattcagaatggcaggtataatacacattatcacctgttttctctcatttttccattcaaatctcttaccatagtccacatgatgccagaatcagatgaagcccatctccttaaaaaaagatcataattggcaattaacagtatgtgttaatttagcttctcttaagaagctaaatatgtaagaatagtagaatgagaaatgaaatttctttccttttacatttttcagtagtttatgaacaggcagttttagactctccaatccaagtgagattctacttcatcttttattttgaaaagtctgacaggccttcataagcatggctgtcacaacaatcaatcagctcactacttgtcactttgatattaacttaggaaaatatcaggtaaggttccttccaacactagaaattctaaaaatgcagataaaaacataaaacaagtcagttttttcaatatgctaaaatgcaatcatacctgtttaaattctaagcataacctatatgcacagtctcctcaatgctgaaggctggaagataataaaatgtgttacattttttcttcgcccagtgtttctcatgaaaaattacttccattaaagtttctgtactagggatccctgggtggcgcagcggtttggcgcctgcctttggcccggggcacgatcctggagacccgggatcgaatcccacgtcgggctcccggtgcatggagcctgcttctccctctgcctgtgtctctgcctctctctctctctctctgtgactatcataaataaataaaaatttaaaaattaaaaaaaaaaaagtttctgtactaattgataaaaatctcagaacctatactactactgtttttatttttttacgtttttcttttgacttggtttgatttgcttgggaaggggaaaaaatgtaaagcaataccttgacatcgctctacaacactgtaagttacaacatataaagataaacaagatttacatctgtgttcagaagtttacaataacacaaagtagtttgattatactttgccttgagaaaagagatgaatgctataaatctggttcctttcatggagataaggttatttcgtgatttattttcaaacaggttcttaaaaggatacgtgttccattaactcctgatattttaaagtcatctagtagttgaacaaccatttctctatttggatcattagggtctgaattacgaacctacggtgggaaagagacagtatttagtgtaaaggaaatcactgaaataagccaaatggtggggagggaacacctgcaacatatgtaacaaaagattaatgacaaagaaaaacattaaaattttagtaactcaaatatgcaaagaaataaatggagcacaaaaggaaatacaactgacaaagactattgctctaattcaaccatttttctactaaaagtgtgactcccaaattaactgctggttaccaagccataaggaattaaggagttttacaggatgcaaatcaaccattgaaccaacattcatcatgctgtttactcaagctgacctttcccccgcataggaaaaccttctcaatgaagggagcaagcagtactgatttaattttcggacacaggcttgtcagactggcactttgaaaattacttttagagctctcctggtctaacatcctcactttacaaatgaaaactctaaggctcagaagaaatgtagtgatgacctggaggagaatactggactagggctggtcttaaagcccaggttttacaactctgaatttaagctccttctaccatagcttcctaatttataacaaaactaaatttttataaatttgccaagttttcagatataaaaggaataagcagtgtttgttttatagatttttgtaatactttaaagcataaaatagaagtgatatacttattcacactttactctttttttttaattaatttcagaggtatggtttagtgattcagctattgtatatgacacccagtgttcattacatcccgtgccctccttaatgcccatcacccagttacctcattctcccaacctcccctctagcaaccctatttatttcctatagttaggagtctcctaaggtttgtctctctctaattttgccatattttacttttccttcctctatgttcatctattttgtttcttaaattccacacataaaaaaaaattccacatgactgaaaacatacttgtttttctctgacttatttcacttagcattccatccacatcataacaaatggcaaggatttgccatttgatggctaagtaatattccattgtatatacacacacatcttctttatccattcatctgtgatggacatctgggctcttattttggttattgtcacactttacttttaacctcagtaggaaagtaaaacatattttgtgctatctggtatataaaacatgctcaataaacatttccatttatttgaaagtttttttcagtgtttatgatggaaatccaccacttcccccatcacatgcacagaatgtataaatattgttatctgcctctacatctttaaaggatattggaactttacaataaaaattagtcatgctaaaaagtctacatttggtatatcttaattcagtaaaattttgcttacgatgctttttcacacatatgatctaatactcactgatttcagcaaccggatttcatctagtgctgtttcagtataatgttcagcacttttaactactttcattgccacaaacttcttccccctgagaacaaacacaagcagtttagactaatgctctatccttactttaggaaggtaagatttagccataatcgggaggcagtgacaaagtacaaataatgatccatgtttccttgtactttaaacataaattatttctatgcaatcacgtgtaagtggtaatgggactaactgaccagatttcgtttagagaaggaagaaaacctgttctcaggtaatgtcagccacacatattttctccaagttaaagtctatcttctgaatgtttctttgaatccaagtaaaaccacaaaatgggagtaagcaagggggagaaccacatcagaccagaagtatcctgtatatctatctacatgttgaaagctgaaagcttaaaaactataaccaaaaaaaaaaaaaaaaaaaaaaaaaaaaccccacctataaccctttcctataagaagccagaagaaatacttggggtgaaatcaaactgatttaaaaaaaaagtgtttagatctcaattactgtctcatcaaagattatctatatttgtaggtaagcatccaatgttaattgcctatacttttatgtaggaaaaattttagaggttgagcaaatctggggcagccctggtggcccagcagtttagcacctttggcccagggcaggatcctagagacctgggattgagtcccacatcaggctccctgcatggagcctggttctccctctgcctctgtctctgcctctctctgtgtgtctctcatgaataaataaataaaatcttttttaaaaagcgggggggtgggggggtgagcaaatctcttaccaaagcaaaatacaacagaataatttcacataggctgatacaggatatcatctaaaaatataactaccccaattaaaacaaaacagacaaaaacactctatgaatttatataccacactttcattgaatatttgcaatgcttttaatttctgagttccaagtgccttatgaatactaatttaaaacaaccttttgtctttaaggtgcctctttcccagaggaaagacaatcttgctcaagaacataaagattatcaggcggccccggtggcgcagcggtttagtgccgcctgcagcccagggtgtgatcctggagacccgggatcgagtcccacattgggctccctgcatggagcgtgcttctccctctctgcctctctctgtgtgtgtgtctctcgtaaataaataaaatcttaaaaataaaaaaaggaaggttgtgtgtggcataacctccaccgccatccttataaaaaaaaaaaaaaacataaagattatcaacaacaaaattctgatcaagaaatcagcctagagctagagtgaaggcaggattatctctggaaaatcatatgaaaaaactaaggcattacctaactaattcttttgcaggaccactacaacttactgaatatcccatgataaccacactgttgaaaagtgtccccagcccaactttcggatgacgtgatatctcccattgaataaatctccaattttcacaagatgataacctcctggaaaaaacaagaggaagtaaacaatcacttgagtagtaagaaaaaatacctctcatttcattttttaacatctatacaccgttcatcaagtaaaagtggcttcttctatataatcagttgaatagacaaaatttaagtcagctacacagtattactgaactcataagaaaaaatcttagggatgtctgggtagctcaggtggttaagcatccaactcttgatttcaacttagtcatgattctcgagggtcatgagatagagtcctgcactgagctctatgctcaagagggagtctgctagagattctctctctttctgcccctgccccctctctgatgtgctctctagataaatcaataaatcttagggacgcttgggtggctcagcggttgggtatctgcccttggcccaaggcgtgatcctggagtcccagatccagtctcacattnnnnnnnnnnctctctgtgtgtgtcttgtcccatcccctctgtgtctctcaggaataaacttaaaaaaaaaaactttaataaataaataaatctttaaaaagaagccttagggagtaagattaatgatttatttattatttttaaagattttatttatttattcatgagagacacagagagagagagagagagagagagagagagagatgcagagacacaggcagagggagaagcaggctccatgcagggagcctgacatgggactcaatcccgggtctccaggatcaggccccgggctgaaggtggcactaagctgctgagccaccgaggctgcccaagattaatgatttagagtaagcaaataatcttttgttgaacaaccaagttacttaaaaaaaaataagtcattctcgggatgccttgagtggctcagtggttgagcggctgcctttggctcagggcgtgatcccagggtcctaggatcgagtcccacatcgggctccctgcgtggagcctgcttctgcctctgcctgtgtctctgcctctctctccgtgtctctcatgaataaataaataaaacctttaaaaaaaaaataagtcattctcaaacaaaaataaggctatggggcagcccagatggctcagcggtttagcgccaccttcagtccagggcgtgatcccggagacccgggatcgagtcccatgtcaggctccctgcattgggcctgtttctccctctgcctgtctctctctctctctctctctctctgtatctgtgaataaataaaatcttaaaaaaaaaaaaaaaaggctatgtacgacaatattctcacccctcaataatcgattacttatctaaatatacacatttataaataaaatctatttatacttgtagtcttagggtgtatttttatgagattaattaattccatttaactaaaaagagagagtgggggggcagggtgcctgagtggctcagcagtttagcgcccggggtggtcccgaggtcccgggatcgactcccacattgggcttcttcctgcatggagcctgcttctccctctgcctgtgtctttgcctctctctctctcatgaataaataaataaataaaatcttttaaaaagagagagagacagagacagagatagagattcttttcataaaatacaacacaacacaacacaacacaacacaggaaggcctaaaaaggctgccaacagtggcaggaatcaagaatatttttacatctctctctgcttgctcagaataacacaaaccaggttctcctagatggtaagatacattctgtcattacttgccacccagaatcctagaaagtctcacaaagaaacaaaaaagatcccaggtaactttaacagttgaagtatctctaatttcagtttaacttagcttagcaatcaacactatgaaaaaaaggtaatgaaatggttttttgaagtctatataccaaatctcatctgtggttatttctgggtgatacatattacagaggacttttcttttttaatatattctgaaattttctaaggagaaagtgcactagcatttttaaggagaaaaaaggtaaaaacagatttaatataaaaccaagctttaataaactaaattgaactgagaggaaatactattttttatacttcaagaaaaggatgcaagaagcagaaaacatcaaaacagcttatgtttatagaccaaacagtcaggtgagatagggcattacatgaatcaggtcttacttggtatctcctcttcaaaaggcttacctttacaatagtcattgggatcttcctgctcatcatcatcagatccgagaatctcctcttcctgctctggtagatcactttcagagtggggagcagagcctcggtgctgagtttcagatctaagaaataatacaaacatgttcattccataaggacagaataaaatgggacattaagaaaacatcattatcaaaatgtctccccactcaacagataatataaacagaatattatctagtggcatcctaagaaagtattagctacagctaccactttatcttcttaggaaaataatacttaaaggaaaaaaaaggatttatttgagacggagagagtgagtgtgcatgagtgggaggggctgaggggtagggagagagaatctcaagcggacttatggtgagcccaacatggaacttgatctcctgaccctaagatcacaacctaagctgaaaccaagagttgggagacttaactgtgccacccagatgccccaggaaagcaatactttaaaaaaagttaatacatgattaaataaaatctgggaaacacatagaagtacaaaaggaaaaaaattacttaaaaaaaaatatccagggatccctgggtggcgcagcggtttagcgcctgcctttggcccagggcgcgatcctggagacccgggatcaaatcccacgtcgggctcccagtgcatggagcctgcttctccctctgcctatgtctctgcctctctctctctgtgactatcaaaaaaaaaaaaattaaaataaaaaaaatatccaaacaaaattgctgataaagctatttttttcagtattttcctatacttttatgaaaatatagatctctaatcacaaacaacataaacaaatttgtatcctgcttttcctgttttaagttttctcccattcctatgcaatctcttaaatctcacatatttcccttacacatatcaccactcactttggcacatactggttgagtgtttgccttcggcttgggttgtgatctcaggtcctgagatcaagtcctgcatcgggctccccacagggagcctgcttctccctctgcctatgtctctgcctctctctgtgtccctcatgaataaatggatggaatcttaaaaacaaaaaagacagaaacattctccctatttataaaaataacatgttatatatagaaaatttggaaaatattttaagacacttctcctctgaaaaaaattaatattttaaactatttctttccagcctgtggccatgaatggcttttagagttattatataactatgacttttctaaaggagttgtaactgagttatatctcctgccatatctgggcttctggtatttgagtattaacaggtttggaaaatttagcttacttcataggtaaaaatggtttctcattttataatgagttaattttagtaattcctttctctacatgccatcaattaaatgtaacatattttgtacactgagacgttcaaaggcaaaaagacttgggtttgcattcaggttaacacctattacacctccctggtttataaagttttaagcacaataagctgggtacacaacattcctttcaatagttataggaaaaggaattttaattctcatttttcaatacattatttaccttttcatcatcttgttttatcagattgttttttctgactaatgattcagatttagacttttggtgacctttccaacctgcctcaattcttggtacttttttttttttgtcttccaagagtacaaaagtagctataatatatgattcaatgtgttcatttttagtgaaaacaagtctttgggatactcatttagtaaagaactacttggccgactttcttaggtggaaacaaggagtctgaatggatattcctaaatttaagattaagatgaatttctaaaacagattctctaatttcaaacttgtacctttcacaattaaaaatacaaaaaataaattatactttgtaggaactacaattgtatgtgtgctgctgaagcaaacacaagaactacaattgtgaaacttctgaaaagtagtgagatacaagcagtgaaaaccaaacataaaaatactgaaatggggggatccctgggtggcgcagctgtttggcgcctgcctttggcccagggcgcgatcctggagacccgggatcgaatcccacatcgggctctcggtgcatggagcctgcttctccctctgcctatgtctctgcctctccctctttctctctctgtgactatcataaataaatttaaaaaaaaaaaaaaaaatactgaaatggggggatccctgggtggctcagtggtttagcgcctgccgttggcccagggcgcgatcctggagtcccggggtcgagtcccgtgttgggctcctggcatggagcctgcttctccctcctcctgtgtctctgcctctctctctctatgtctatcataaataataaataaataaatattttttaaaaaaatactgaaatgggacacctgagtggctcagtggttgagtgtctgcctttggttcaggtcatgatcccaggggtcctgggatggagtcctgtaccaggctccccgcagggagcctgctttttcctctacttatgtctctgcctctctctgtgtgtgtctcatgaataaataaatacaatcttttttaaaatgccaaaatatgggatccctgggtggtgcagcggtttggcgcctgcctttggcccagggcgcgatccgggagaccctagatcgaatcccacatcgggctcccggtgcatggagcctgcttctccctctgcctgtgtctctgcctctctctctctctctgtgtgactatcataaataaataaaaattaaaaaaataaaaataaaaaaataaaatgccaaaatattagaattctacaaatatcatgggattcgtaacattaaaaaattattctttaaagatctggacattctttttttttttttaatccctgtttgaattttaaagattgattgattgatttatgagagagagagagagagagagagagtcgcagagacacaggcagagggagcagcaggctccatgcagggcccaacgtgggattccatcctggacctggggatcaagccctcagatgctcaactgctgagccacctaggcgccccaatttcctgtatttcaatgtaaatttaatccttttcattatgtctattctctctggaacatgtttttttcagacactggactctaactgactaccttagttttcttatattttctatctccttagattttattgttcttctactttttagatttattttcctaacttgtgctgttacacttctaccatattttaaatttcctactttaggtaaactctatgcccaatgcagggcttgaactcacaaccctgagatcaagacttgtatgctcttctgactgggctgcactccatttttgctcttttttttacagactcctgctgaggagtttaatgatgcactgccttttttttttttttttcttaaagattttatttattcattatagacagagagagagggagagagggagagagggagagagggagagagagagagagagagagagaggcagagacacaggcagagggagaagcaggctccatgcagggagcctgatgtgggtgggacttgatcccgggactccagcatcatgccctgggcagaaggcaggcactaagaccactaagctacccatggatctcgatgcactgccttctttaaccttaaggatactagttatggctttaagtttctttctgatcctgtatatcatcctggttttctcaaactgcccatgtttaactaaagccttgcttttataaacaatgtccctcaaggaatatcaggcaactgaaaaagtctgtcataaaaagataaaaacaaaaataaattttgatgagacagttactattagataatgaagataatatggtgacaggattaaagaattcagaattagtgttaactttcactgatgaggagttttaagaataaaaaaacggaaagaaatgctacagaaaaaaatttcaacttaatattaggagctaaaacccattcttcctagaacaaaaaagagggttctaaaatagtttcagtctgtgcttttgaacttttcatacctacacctcaagcctcaaattttgctatttatgttctgaagaaaaaaaaatatgtcagcactttaaagatctcaaagcgggggatccctgggtggctcagcggtttagcgcctgcctttggcccagggcttgatcctggagtcccgggatcgagtcccacattgggctccctgcatggagcctgcttctccctcggcctgtctctctctctctgtctctcatgaataaataaatacaatctttaaaaaataaaaaaataaaagtctcaaagcatgtaaaatttaaaccattaacatctataaaatctcatacaaattgaaatggacaaaggatcaagtattatttcaaaagagataacctgatcaaaacagcagtactgttagaaatagtaatatacttggctagggtacagaatgaggccaaggcaaaaatctgtgaggaaggcagaaagcaatgggaaagtttgacagttttgctcctttatttccaagctagtcttgacagagaaggagtaaaaaaaaaaaaacacagatgataaaagtcaaattagtcaaggtgtgttcccccttatttctaaggatccccccccttttttaaaaagtttttatcattttattaaagaaaaacagggggggggggagggtgggaggtgggcagagacacaggtagatggagaagcagactccattcagggagcctgacataggactcaatcccaggtctccaagatcacgccctagggtaaaggcggtgctaaaccactgagctgagccacccaggctgtccctctaaggatcctttggattcagattccatttgtgatataatcctcattccttgcttctccctctgcctgtgtctctgcctctctctctctatcacaaataaataaaaataaatttaaaaggggggtggggggatccctgggtggctcagcggtttcgcgcctgcctttggcccagggcgcgatcctggagtcccgggatggagtcccaggtcgggctcccagcatggagcctgcttctccctctgcctgtgcctctgcccctcccccctctcttctctgtctatcataaataaataaaaataaatttttaaaaaaattctcattcctaaccatccttcactccaatctctcatcacccaaataaatagtaaaaccaaagtgccaaacaaaaacttactgtcttttgtgagcaaatactatatattcctaactgccataaagaataggatagttatgagttttcacttacacatttcatgaatttatatattaacattagctacatgagctccccacttggacacctccccccacccctttaaaacgtctattactaacccaggtcatgattctggggtcctgggatctagtcctgcatcaagctccctgcacggagcctgcttctccctctgcctccttgtgtctctcatgaatacacatacataaatctttaaagaacccacttttcaatatatatgtcaattatatctcaaataaagctgaggaaaaaagtaatttaagaagcaagatagggcagcccgggtggctcagtggtttagcgctgccttcagcccagggtctgatcctgaagtcccgggatcgagccccacgtcaggctcgcttgcgtggagcctgcttctccctctgcctgtgtctctgcctctctctctctctctctctctctctctcgaataaataaatgtttaaaaaaaaaagtgaagaagcaaaatgatggagaataaagaaactgagaaaataaaaagaatttgtgatcactaaaccagcccttcaagaaatattaaaaggaatcctttaggaatgcctgggtggctcagcattgagtgtctgctcagggcatgatcctggagttccaggatggaattcacaagagaaaatttggaaagaactcaaatatatggaggctaaaaagcatcctactaaagaatgaatgagtgaaccaggaaactaaagaaaatttttaaaaactcatgtaaacaaatgaaaatgaaaacacaactgttcaaaacctttgggatgcagcaaagaaagtcctaagagggaagtatatagcagtacaagcctttctcaggaaacaaaaaaggtctcaaatacacaacctaaccttacacctacaggagctggttctttcaaagaattaataagactgataagccactggccaaatttatcaaaaagaaaagagaaaggacccaaataaaatcatgaatgaaagaggagagatcacaaccaacaccaaataaatgcaattttaagaacgtattatgagcaactgtatgccaacaaattaggcaatctagaagaaatggatgctttccttgagacatttaaactaccacaaatggaataggaaaaagagaaaacctgaacagatggactaccaggaaggaaatgaagtagttatcaaaaatctcccaacaggggcagggcagcccgggtggctcagcagtttagtgccgccttcagcccagggcatgatcccggagacccgggatcaagtcccacgtcaggcttcctgcatgagcctggttctccctctgcctgtgtctctgtccctgtcctctgtgtgtgtcaaaaaaatcttccaatagggatccctgggtggcgcagcggtttggcgcctgcctttggcccagggcgcgatcctggagacccgggatcgaatcccacatcaggctcccggtgcatggagcctgcttctccctctgcctatgtctctgcctctctctctctttctctctgtgactatcataaaaaaaaaaaaaaaaaaatctcccaataaacaagagtccaggtctggatggcttcccaggggaattctaccaacattaaaaaaattaatacctattcttctgaagcggtttcaaaaaacagaaatggaggggcacctgggtggctcagcggtttagtgcctgcctttggcccagggcatgatcctggagtcccaggatcgagtcccaagtcgggctccctgtatgaagcctgcttctccctctgcctgtgtctctgcctctctctgtgggtctctcatgaataaatttaataaatcttaaaaaaaaaaaaatctgtctttaaaaacaaaaaaacaaaaaacacagaaatggaaagaaaacttctgaactctatgaggcattatcttgatcctaaaaccagacaaagatcccacaaaaaagggagaattacataccaatatccctgatgaacatgaatgcaaaagttctcaccaagatactacccaatagatccaagaatacattaaaaggattattcaccacgaccaagtgtgatttatatctggcctgcaaggatggttcaatatccacaaatcaatgtgacaaactatattagtaaaaaaaaagggacaagaatcatgatcctctcaatagatgcagaaaaagcacatgacaaactataacatccttttttttggttaaaactcttcacagtgtagggatagaggaaacattcttcattatcataaaagccatatatgaaaagccgacaacaaatatcactcactcttcacagatgacataatactctgggtggaaaaacccaaaagattccacccaagattgctagaactcacacaggaattcagcaaaatcaggtgcatttctatacattaacagtgagacagggacgcctgggtggctcagtggtttagtgcctgcctttggcccagggcatgatcctggggttccaggatcaagtcccacatcaggctccctgcgtggagcctgctcctccctctgcctatgtctctgcctctctctctctctctctctctctctctgtctctcatgaataaataaataaaatcttaaaaaaaaaaaaaaacagtgagacagaaaaaaagagaaattaaggaatcaatcccatttataatcgcattctgccccaaaccataagatacctaggaataaacctaaccaaagaggcaaaggatctgtactagaaaaccaaagaacacccatgaaattaattgaggaagacacaaagaaatggaaaaatgttctatgctcatggactggaagaacaaatattgttaaaatgtttgtcccaactagggcaatctatatattcaatgaaatccctatcaaaataccatcaactaaaaaaaaaaacaaaaaacaaaaaacaaacaaaaaaacaaaataccatcaacttatttcacaaaattcaaacaaataatcctaaaatttctatggaaccagaaaaggccccaaatagccaaaagaatgttgaaaaaaaccaaaactggtggcaccacaatcccagacttcaagctctattacaaagctgtaatcatcaagacagtatggtactggcacaaaaagacacatagatcaatgcaacagaattgagaacccaaaaatggaccatcaactctatggtcaaccaatctttgacaaggcaggaaagaatatccagtggaaaaagtctcttcaacaaatggtgttagaaaaattggacagccacatgcagaagaatgaaactggaccattcttttacaccaaacacaaaaacagactcaaaatggatggaagacttagatgtgagacaggaatccatcaaaatcctagaggagaacccaggcagtaacttctatgacctcagccgcaggaacttcttgctccaaaggcaagggaaacaaaggcaaaaatgaactactgggacttcatcaagataaaaagctttttgcacagcaaaggaaacagttgacaaatccaaaagacaactgacagatgagagggtattgcaatgcctatcagataaagggctagtatccaaaatctataaacactttatcaaactagtatctaaagaccaaataatccaatcaaaaaattggcagaagacatataaatggccaagagtcacacggaaaaaatgctcaaaatctctcggtatcaggggaaaaaatgctcaacatcactcagcattgaggaaatacaaatcaaaaccacaatgagataccacctcataccaggcagaatggctaaaattaacaagtcaggaaacgacagatgttggcaaggatgcagagcaaggggaatcctcatacactgttggtgggaatgcaagcttgtgcagctactctggaagacagtatggaagttcctcaaaaaattgagaatagagctaccctaccacccagcaattacactactaggggtttaccccaaagatataatggtagtgctccgaaggggtacctgcaccccactgtttatagcagcaatgtccacagtaaccagtttgggaaaaaaccagatgtccattgatagatgaatcggtaaagacgtggtgcgtgtatgtatatatgtatatacatgcatacacacacgcacacacaaatatatagactacccaggcaccaaaaaaaaaagaaaagaaaaatcttgccatttgcaatgatatggatagaacgagagcgtattatgctaaccaaaataaatcataccaagacaattatcatatgatcaccctcatatgtggaatttaagaaacaaaacaggatcacagaggaacagaggaaaaaactaagacgaaatctgagagagagagacaaaccacaagagactcaactagaggaaacaaatggagggttgctggctgtaagggaggtggggagatggtataactgggtgatggacattaaggagagcatatgatgtactgagcacggggtattttaagaatgatgaatcactgacctctacctctgaaactaataatatacattaagtgaatttaaattttaaaaaaatttaaaataacaaaaaagaaaatacacaacaaattcagagtaactataaattctatagtggatggatccctgggtggtgcagcggtttggcgcctgcctttggcccagggcgcgatcctggagacccgggattgaatcccaccgtcgggctctcggtgcatggagcctgcttctccctctgcctgtgtctctgcctttctctctttctctctctctgtgtgactatcataaatttaaaaaaaaaaagtatttaaaaaaaatttctaggggcagccccggtggcgcagcggtttagcactgcctgcagcccagggcgtgatcctggagacccggaatcgagtcccacgttgggctccctgcatggggcctgcttctccctctgcctgtgtctctgcctctctctgtgtgtctctcatgaataaataaataaaataaaatctttaaaaaaaataaaaataaaaataaaaataaaaaaataaaaaaattttctatagtggagctacaatatagggatatttcaaggaggagtacacatgggcatcaaactccagctcaccagtatctcccagaaagaaattatacactcaactggaggcctgatttttgcaactgctccccaggggacactgccagattgcctggcgagaaaggcatatgcttctggtcccacaggaatgtatatatctgcacacatttaaaaactgctgcctagggaatcctgggtggcacagaggtttagtgcctgcctttggcccagggcgcgatcctggagacccaggatcgagtcccacatcgggctcccggtgcatggagcctgcttctccctctgcctgtgtctctgcctctctctctctctctctgtgactatcataaataaataaaaattaaaaaaatatatatataacaggctgcttggaaaaccacaaaggtttgaaagacaagagagttggggcagggctaaacaacaagattcagggcagccccagtggcgcagcagtttagcgctgcctgcagcccagggtgtgattctggagatccaggatcgagtcccacatcgggcttcctgcatggagcctgcttctccctctgcctgtgtctgcctctctcttcgctctctctgaatgaataaataaataaatctttaaaaaaaaggttcgtctacataaggctactctttcaagacgctgacaggtggttgtttccaataaatcaacagagtcaagcaaaatgatgaaacagaggaatatgttccaaatgaatgaacaaaataaaacctcaaaaaataaaccttaatgaaacagagataaatttgaaacaatggctataaatacactcaccaatcttgggagaagaagggatggacacagtgagaacttcaagagagaagtagtaaatactagaaagtaccaaatagaagtcacatacatagctgaatacaataactgaactgaaaaatacacttagatacaacagcaaactagatgaagtagaagaaaggatcagtcaactcaaagacaagacagtgaaactcaatcaatgcaagaaaaaaaaaagcacggatatagcctaaggggcttatgggacaagatcaaatggactaacatttgcattataggggtcccagaaggtgaagaaagacgcagaaatctcttttgaaaaaataatggatgaaaacttccctaacttgggaaaagatctaggaagccaacagaattccaaataagatgaatccaaggacagctaccacaagacacacataactaaaatctcaaaaattagggagcctgggtggctcagtcagttaagcatctttctttgtctcaggtcatgatcccagagtcctaggatcgagccctgcatcaggctccctgttcagtggagcctgcttctccctctgcttcaccccactcttgtgctttcttgttctctctcaaataaataaaatcttaaaaaaaaaaaaaaactagaaaaaatctttaaaaaaatctcaaaagttaaaggcaagcagaaaattaaaaacagcaggagaaaaataactcattatgtgcaaggaaccctcatgaaaatatgagcagactgttgagtagaaactgcaagccagaaaggagtaacacaatacactcagagtacttcaaaaaaaaaaaaaaaaaagttccagctaggagtaccctatccagcagttattcttcaatgttgaggaagagatgagagttttgcaaacaaaagcaaaaggaaacttctcttctcctctttttttttatgatagtcccccacagagagagagagagagagagagagagagagagaggcaggctccacacactgggaacccgacgtgggactcgatcccgggtctccaggatcgcgccctgggccaaaggcaggtgccaaaccgctgcgcaagaacttctttaagctgaaaaggcactaattggcaacaagaaaacatatgaaagaaatctcactggaaaagtaaatgtaaagaaaacagattcatcatttataaagctagatggaagttaaaagataaaagcaataaaaataattatgatttcaataattagttaaggatacacaataaaatgtgacataaaaaacaaaccacaggggtgggagaataaaaatgttaagctttagaatggcctcaaatgtaagctgtcagtaactttataaaatagattattagatataagatgttatatataagcctcatggtaaccacaaagcaaaaatctatacacaaaaggtaaaaagaagggaatatataattataccactaaagaaagtcatcaaagaaagcaagaaaagaagaaacagaaagggactacaaaaacagacagtaatcaattaacaataagtatatacctgtcaataattacttaaaaatgtaaatggagtaaatgttccaattaaaagacacagaatggctgaaaggataaaaaagacaagactcatatatatgtggcctagaagagactcacttttgaggtaagggcacactcagactgaagtaaaagtatggaaaagtattctatgcaaatggaaacaaaagaaagctgaaatagctatacttttatcagaaaaaaatagattttaaaacaaagactgtgggatccctgggtggcgcagcggttttggcgcctgcctttggcccagggcgcgatcctggagacccgggattgaatcctatgttgggctcccggtgcatggagcctgcttctccctctgcctgtgtctctgcctctctctctctctgtatgtgactatcgtagataaaaaaaatttaaaaaataaataaataaaacaaagactgtaataagagacaaagatggcattacaaaatgataaaggggggatccctgggtggcgcagcggtttagcgcctgcctttggcccagggctcgatcctggagacccgggatcgaatcccatgtcgggctcccggtgcatggagcctgctcctccctctgcctatgtctctgcctctctctctctgtgtgtgtgactatcataaataaataaaaataaaaaaaaaatgataaatgggtcaatccaacaagatgacttaacatttgtaaatattattgtacctaacataggagtacctaaatatattaacggacctcaagggagaaaatgatacaaggcaataataataaaaatcttaatgtcctacttacatcaatatatcatccagacagaaaattagtaagataactatggccttaaatgactcatcagaccaaatggacttaacagatacatacagaatatcccacccaaaggcaaaatacacattcttctcaaatacatgcaacattctccaagatagaccacatactcacaaaacaagtaataaattttaaaagactgaaatatatcaagcatatattttctgagcacaatggtatgaaactagaaataaactacaagaaaactagaaaatagagattaagtaacatgctactgtacaaccaacgaattaaagaaatcaaagtaaaataaaaaatacctggagacaaatgaaaattgaaatgtaccaaaatttatgggatgcaacaaaagtacttctaagagggaaagtcatagtgataaatgcctaccttaagaaacaagaaaagtctcaaacaacgtaactttacacttcaaggaactagaaaaagaaaaacaaagcccaaagttagtacaaggaaggaaataacaaaaactagagctgaaatatataaaacagagactaaaaagacaatagagaagatcaacgaaactaagggtcgatttttttgaaaagaaacaaaaccgacaagcctttaactatactaagaaaagataactcaaaatcagaaatgaaagagacgttataactgtgctataaatatacataagatcctaagagaccactatgaacaatcatatgctaataaactggacaaactagaagaaactaataaactgctagaaacatacaacctataccaataatgaatcaggaagaaacagaaagtctgaaaagaccattaactagtaaggagactgaattaacccaacaaacaaaaaccaatgggttcactggtaaattctaccaaaaagtcaaagaacaatgctaattcttctcaaactcttccaaaaaatagaaaaggagggaactcttctgaattcattttatgaggccagacttaccctgataacaattacaggttaatatcctcaataaacatagatgcaaaaaatcttcaacaagatattagcaaatcaaattcaacagattaaaggatcatctctacaatagtgggacttattccagggatgcaaggatggttcaaccttcacgaatcagtcagcatggacacattatcaaaatgaaggattaaaggaatatgatcggggcagccctggtggcccagcggtttagcgccgccttcagcccggggtgtgatcctggagacccaggactgactcccacatcaggctccatgaatggagcctgcttctccctctgcctgtgtctctgcctccctctgtgtttctcaagaataaataaataaaatcttaaaaaataaataaataaataaaatatgaccatcttgaaaaaagagaaagatttaacaaaattccacacccattcatcatacaaactctcaacaaagtaggtataaagagaacaaaccttaacacaataaaggtttatataaatacagcccacagctgatattgtattcaacaatgagaaagccttttctctctaagatcaggaataagacaaggatgttcatctcactgcttccagtcaacagagtactaaagtcctaaccagagcaattaggcaagaaaaagaaataaaaggcacccaaactggaaaggaataaataaaactgtcactatttgcagacaacatgatattatatacagaaaaatctaaagactccaccaaaaaactgttagaagtaataaattcagttgagttatggaatacaaaatcaatacacaaaaattggttgtgtttctatatactcataatgaactatcagaaaattaagaaaataatgtcatttacaattgtatccaaaataacaaaatacctaggaataaaacgagggaaaacacctgtatattgaaaactataaaaacttaatgaaagaaaattaaaaagatacaaataaatggacagtccaagctcttggattaaaagaatcaatgctgttaaaatatccatactacctgccgcaatctgcacattcaatttaattaccatgaaaattcaaatagcattttttcaaaaaaatggaataatattacaattttttaaatcttgcaatttgtatggaaccataaaaaaacctcaataaccaaacaatcttgagaaaaatgtacaaagctggaagtatcatggtctctgatttcaaattttattacaaaacaatggtaatcaaaaaaacaaacaaacaaaacaatggtaatcaaacagtaatagtactagggatgcctgggtgattgagcctgcttaagattctttctccttcttcctctcctccctcagcccttgcttgtgctgtctctctcaaaacaaaaacaaacagggcagtccgggtggctcagcggtttaacacctgccagcccagggtgtgatcctggagacccgggatcaagtcccatgtcaggctcgctgcatggagcatgcttctccctctgcctgtgtctctgcctctctctctctctctctctctctgtctctcatgaataaataaataaaatcttaaaaacaaaaacaaacaaaaaaccagtatggtactagcataaaaacagacatatagatcagtggaacagaatagagaacttagaaacaaatccacattgggatgcttgggtggctcaggggttgagtgtgtctgccttcggctcagggcatgatcctgaagtctcaggattaagtcccacatcaggctccctgaatagagcctgcttttccctctgcctgtgcctctgcctctctctccctctctgtgtctctaatgaataagtagataaaatcttaaaaaaagaaataaaatatttttttcaatttttatttatttatgatagtcacagagagagagagagagagagagaggcagagacataggccgagggagaagcaggctccatgcaccgggagcccgacgtgggattcgatcccgggtctccaggatcgcgccctgggctaaaggcaggcgccaaactgctgcgccacccagggatcccttaaaaaaagaaataaatccactcatatatagtcaattagcttatgacaaaggagctatgaatatacaatggcgaaaggatagtctcttcaataaatgttgctgggaaaactggacagccataggcattaagaaagaaactggaccactatcttacatcatacacaaatagattaaacacttaaacataagatcggaaacaatgaaactcctaaaagaaaacataggttgttaactcattgacaaaagtcttgattttccgaatttgacaccaaaagcaaatacaacaaaagtttttaaaaataagtgtgaaatcatacttaaaaaaagcttctgcagagtaaaggaaaccatcaataaaatcaaaggtaagctactgaatgggaggaaacatttgaaatcatgtatctgataaggggctaatatccaaaatattgaagaattcatacactcaacaggggaaaaacaaacttcaattaaaaaatgggcagagggatccctgggtggcgcagcggtttggtgcctgcctttggcccagggcgtgatcctggagacccgggatcgaatcccacgtcgggctcccggtgcatggagcctgcttctccctctgcctatgtctctgcctctctctctctctctctctgtaggactatcataaataaataaaaattaaaaaaaaaaatgggcagaaaaaaaaagggaaaaaaatgggcagacgatctgaagagacattttcgccaagaagacatacagatggccaaaaggtacttctcaacatcagggaaatggaaatcaaaactgtaatgagatagcacctcacacctgtttgaaaggctattatcagacaaaaaataacaagtgttggtgagcatggggggaaactggaacactcacagactgctggtggaaatgtgaaataatgcaaatactttgggaaacagtttgtcagtttctcataacgttaaatatgagcattaccatttgacccaataattctacttctaggtatatatccaagagaaatgaaaatatacccacacacacagaaaaaaaaactacaactgttcacaacagcattaactataatagtccaaaagtggaacaactcaaatgtccatcaactgatgagtggatatataaaaggtagtatatccatgtgacaaaatattattcagccttaaaaagaaatgaagtactgacatatcctgcaacatgaatgaaccttaaaaacattatactaagtggaagaagtagccacaaaagaccacatattatattattccccttatatgaaatgtccagaataggcaaattcccagggacagaaagtagattagttgccagaatctgagaaaagagtataatggtgagtgactgcagtgagtttgttttatttttggggggaggagggtgcaggggcagtgaaaatgttctaaatttagactgtggttaagactgtacaactctgatgtcagaaaggagagtggaagtaggataaatgaattaaatcttctttaatcatagcacaagttgatggtaatagctaaagccgatcaatcaagaaatagcaataagcatgatggagctatacattaaacaaaagaatatgaaatgaaggacgcctgggtggctcagcagttgagcatgactttggctcaggatgtgatcccaggagtcccaggatcgagtcccacactgggcttcctgcatgaagcctgcttttccctctgcctatctctatctttctgtctttcatgaataaataaataaaatctggggcagtcccggtggtgcagcggtttagcgccgcctgcagcccagggtgtgatcctggggacctgggatccagtcccacatcaggctcctgcatggatcctgcttctccctcctcctgtgtctctgcctctgcctctctctctctcataaataaatctttaaaaaataataaataaaatattttttaaaaaatgaaatgaacataatgttacatgtcaattatatctcaataaaacgaaaccatcaactacacagacacaggtcaaaaatagttgctttaagaaagtaggctcaggactcaggaaagggtaggacaaaagactatatatatatgtaccttttactaaaaggtttccattctggggtgcctcggtggctcagttagttgagtgtctgccttcggctcaggtcatgatctcagggtccaggattgggcctccctcacataggttccctgctcaggggggagcctgcttctccctctccccccatgctcatgctcttactatctcaaataaataataaaaaaaagtttccattccattttttaataccaagagacataattccttatggaacaaacaaaaagcctaaacacccagcaagaaagggctaagtaaatttattgactgtttaaatcaccatttatgtaaactttgattgctaatttgttcttttaatgtaaagattgtaatttctgaaaggattatctatttgtaccctttaatcaataccttccactttattttattttttaaaatattttatttatttattcatgagagacggcggggggggggggggggccggggagccggaaaaccaaaaccccagccaaagaaaaaacagggtccccccaaggagcctggtgtgggactcaatcccgggactccaggatcatgccccaggccaaaggcaggtgctaaaccactgagccacccaggtgtcccaataccttccattttaaatgtttactattccttaaaatgtttctgtgcaatgaacttcgaaagtatatattactatctttttttaaatagtcagtttatcatactatcacatttttccagtgtcccatatctactttcttgtctacgtgttttccctaagacttccctcttagcaccttttgacctctggctccagttcagattttccaaaacaaacaaacaaacaaacaaacaaacaaacaaacaaacaaaagacaacaaaaacattgtatattaacacatgcaggaaaagaaaaaggagttattagcattatttctgcatcttcatagtcccaataagactaaaggacaatataagggaattcatggcaattcagattatgtagaaaaagaaaacaggagcacttggtggctcagtcggttaagcacctgcctttggctctggtcaggatcccagagtcctgggatcaagccccacattgccctccctgctcagtgtgggagtctgtttctccctctccctctgtctgcctgtgctttgtctcaaataaatattttttaaaaagaaaaagaaaaaagaaaaagaaaaaagaaaaagaaaaaagaaaaagaaaaaagattctcctctatatgaattgaccgtaagacctttgattctatagacacatatgtgccctgttgtctccactcttccagaacctcaatgccaactatcacatcttacgagacattataatagagtgtaaaagcatggactgcagcataacatgtttgtagtcaaatcttggctttgcttttattctgtgtgatcttaggcaagtaatttaacctgtttccttacctataaagtcataaaaataaaagcactaagtttatgaggttgcaatgagcatgaaatgagttagcagtacttataaaaggcttaggatagttgtctggcaacagatactattatttcaaatagagaaatttggatagtctctttggctggagctcctctctgtgacagtttgatattaacaaatattggcagtgaatctgaggaatgcaactttaaagttctgggagaaaggtacatgcatataacccaaataaaattaattttaagacaggatacttaaaaaaaaaaaaaaaaaaagacaggatactatttgagagaaaaatactctctggagggacgcccgagtagctaagtggttgagcgtctgcctttggctctgagagtgatcccgtggtcccgggatcaagtcccatatcgggctcccagcatggagagcctgcgtctccctctgcctatgtctctgcctctgtgtatctctcatgaataaataaaatcttaaaaaaaaaactctctggacttaaaaaatgtttttttttttttcttttctttttagagtgccttttttgtcagttgaatcatcacttactaggatacttaaagccatggatgcacggattctatatgctatccctgtcaataaataagggatcttcttttgttgcttgacacttaaaaatatatatatatatttaaattacttcagtaaagcttcttgtgtgatcatgtacacaaaaagcactctgatacagaaagaataatgggggtttttcctgtaattatgaagttgcttagctgtgctcatctatttgtgcttaatgcttatcaaacactgacatgccagcaaacaattaattttgttgcttctctcaagggagagtaattgttcatcaaaagtagaaaaaggacaggaagaaaaaaaagtcttattatgtgattttcctcctctttattctattgggagatagtcaactcattcatgactatgcaataatttgctggtaacaataaccttaaaatatctcttgacttcaaattattatgttacctagaaaaggcaagggacatctccaatctaagacagtttctgcactccaaaagaatatagtttagaagtttcaacccataagccacgttacaatcttccctctccaaagagggatcagatttaaaagaagcaatagttttttttttttttaagattttatttattcatgagagagagtattcatgagtatgtctctcatacacagagagagagaggcagagacacacaggcagacagaaaagcaggaagcagagacacaggtagagggagaagcaggctccatctgtgggactcaatcctgggattccagaatcacgccctgagccaaaggcagacgctctaccatgagctacccaggactcccaaagcaataggttttaaacaacaaaaatatcaaccttaaaaaagttcatacacccctacttttcaaattagtaataccaaaaagaccaagcctccttgtttcagtctaattcaaaacacaaggatattaaactctaccattaaataaataaataaataaataaataaataaataaataaataaataaactctaccactgctttacgtagtgggtatgtacataatggaagaaaagttgttttgaatattttaccaaagtacatgtgaatatagaacaaaattgcaaaaacacccaaaaaacaaaattgcattgctgatccagaaatgaagccattatacttcctgtccagttctttaagcactactgaaaatagcagtccaggagaaagtatgcgagaaaataaaaactcactctcctgtttgagggacagagaaagccatcaggttcaatacattcacaaatattaatgttttctagtgtaatcaaaggggatgtacattgtaacacggttttaccttaaaaattatttaaaaactagcttccaataaccatatggtcaaacttcccattacaaataatgatacagggatccctgggtggcgcagcggtttagtgcctgcctttggcccagggcgcgatcctggagacccgggatcgaatcccacgtcgggctcccggtgcatggagcctgcttctccctctgcctgtgtctctgcctctctctctctctctgtgtgtgtgactatcataaataaataaaaattaaaaaaaaaaaacgatacaataatatgcagtatacagcatcttgattgctctcaacaaaatatttaactaaaacctaatcaatcttttagtctgaacttccagttttaagaaaatacaatggagagagaacaagttaaatccagaatgtgggatattttccaagaaaatatgaaaaaaaagaaattcagttattggggtagtggaggggagggagatggttttagatgaagagataaacatacacctctaaaataggagaacctggggaaccctgggtggcgcagcggtttagcgcctgcctttggcccccagggcgcgatcctggagacccgggatcgaattccacgttgggctcccggtgcatggagcctgtttctccctctgcctatgtctctgcctctctctctctctgtgtgactatcataaataaaatttaaaaaaaaataggagaaccttgttttaatcaagatttaaacagcagacatttattaggcaactggggagatatgactattaactggctgtaagatgatactggggaattactgctaaccataacaccattactgcagctgacaaaaatatgtaaaagaacatccttattcttctgaggagcaagctgaagtattcagggatatggtatcatggtttctgcagcttactttcaaataattcagccaaaaataatttatatgcatatgtctacatatacatatcaatataatacatatatacctaagtaatatacctaaatagccaaatatacaaagtatttataatgctatctttcaacttttctagatttttgaaatttctcatcactgagataaaggattaggatagaatcgaactgtcttatgttttatatatattttattaaacattttatagccattattgcacttaaaaacattaatattccacatagatgcattgttatttctaattttctgaaaatttaggtttctgtgattaacaacctcaaacataaaaaagtgggatacacaggaaagcattaaatgagcactttcttgacatggtgtaactataaactaataaatgattttcttgtggcttacagaaacttagtataggtatattcaataatgaaaagtgttttgtgtgttttctttagagacagagaatgcacgcatgtgtgtgcgcgtgtgcacgcacatgtgctagagtgggcaggagaatctcaagcaggctctacattcagtgtgagtccaattcagggcgcttgatcccatgacctgagccgaaatcaagagtctgacacttaaatgactgagccatcgaggcaccccaattaagtgtttttctgacacctggcaaaccagggttagtcagcagttagaatatctgtgtaataatactaatttttctttgccctcaccaatctgaaactaagctgtaattttcacaaggacagggactgtgtcttatccatttttgttttacatgtgccctaatttcataggcattcaaaagtttactgaaaaagacttgacacctattaataaatcataatcatctttcaattttacagaagtttttatattatctaccgatttccatgaaaaggaatgctttcttgttaagaaaacattttgaggtttctcccaggtccaatcctagtgaaatgaaaaggtatgttcaaagatttatacacaaattcatagaaactttattcttgggcagctcgggtggctcagcggtttggcgccttcttgagcccagggcctgatcctggagacccaggatcgagtcccatgtcaggctccctgcatagagcctgcttctctctctgcctctctctctctctctctctctctgcgtgtctctcataaataaatgaataaaatcttttaaatatatatatacatttaaatatatttcctacctttaccctctatgcctgctgaaaaagcctagaaacaacagaatcctaatagcaatgagcaggaccagcaactagaccctcatttccatatataattcctcactaaaaagcacaaagggattctttggagcaataggtgattccagtcttgggcagagaaagcataaagaatctggaatatctccttatgcagaataagacataactaaagttgaagagatgtaaccaaatgtaatgctcaaactcttgactaaatcctagatccaaaaaaaaaggtgtaaaagacatatttgaggggatccctgggtggctcagcggtttagcgcctgcctttggcccagggggcgatcctggagtcccgggatcgagtcccatgtcgggctcccggcatggagcctgcttctccctcctcctgtctctctgcctgcctgcctctctctctctcataaataagtaaataaataaaatttttttttaaaaaagacatatttgagataataggaaaatcaaaatatggtcagagtgttagatgatattgaattaatattcactttcttaagtgtgatcattatcagtataataacattattgcttttattaaaggaaaatgtgattcttaggagagtatcttgaagtctatacagatgatgtgtcatgagatctgcaacttccaaatgtttcagcatcaaatttaccatgtcgacagctttatttcataaaggccaaaaacgggaaacaacctagatgattatcaaaaagtgaatggataaacaaactgtggtatatccataaactggaatactgtgcagtaataaaaagaaataaactaccaatacacataaagcatggatgcatctcaaaatcattatgctgaataaaagatgccagggatccctgggtggcgcagcggtttggcacctgcctttggcccagggcacgatcctggagacccgggatcaagtcccatgttgggctcccggtgcatgaagcctgcttctccctctgcctgtgtctctgcctctctctctctctctctgtgtgactatcataaattaaaaaaaaaaaaaaaagtattaaaaaaaaaaaagacgccaaatacaaaagaatacatgctgggcagccctggtggtgcagcggtttagcgccacctgcagcccagggtgtgatcctggagaccctggatgagtcccatgtcaggctctctccatggtgcctgcttctccctctgcctgggtctctgggtctctgcccctctctctctctctctctctctctctctctctctctctctctgtgtctctataaataaataaataatatttttttaaaaaagaatacatgctgtgtatttacatttatataaaactctagaaaaggtaaactgatgtataatgtcagagaacagagcagtcattgcctgggggcaacagtataggaagggatgggagcatgaggaaacttctggacacaatgaaattttgtgtactttggtggtggtttcatggatgcatacagctagctgccaaatcatcaaattgtgtactttgttacagaaagatggaagaaaacagggcaaaatgtcagcagtaagtaacagtaacaggagaagaattataggttatcataccattttttttttcaactttactacaggcttaaaattttttttcaaaaaaggttgaatggagaacaactcacaaaaagataaaaatgacactccacacatattttttaaaaaggtcaaacaccctgaaagagaaatgtaaattcattactgagggatcatttctcatctatcagactgccaaataattacaacacattctgttggtgaagcagttggaaaatgagcacttacacactcaaactagtgagaatgtatgcatagtacaatcttgctgaaaggaaatctggtaatacttaaatgataaatctacttgggttccaacccagcaatccaattctaggaatctgtcctgaaagatacaccttcaacaaattggaaatacatttacaaaaggctattcactgcagtcttgtttgtaatcacaaaatattgaaaacatcctaaatgcccatacatgggagtggctgaatacagtgcgttatatgcacacaattgaggaacattgtacagggagcccgatgtgggactctgcactatgcagctgcaaaagaaaaaaaaaaaaaaggatgacgttctttatgaactgatataaggtaatagataaccaagacatacagccaagtgaaaaaaggagagtgcaaaggagtatctataggacactaccctccagggaagaaagaaaagggtattaaaacaaatacacatacctcctcacctgtgcaaaataaagcacaggaataacagagaactaaaacaacaacgggcaatggaaagaggtggaaaaagagggatctggggtatctgggatgggaaggaagtgcacttctgagtagaactctttgtatagctctggatcttcagaaccacacgtagtgtgttgtctggctcccaaaataaaaaaataaaaccaaccaaaatgcaaagagaacccaaaatgaaacacaaacactaacaaatgaaccttactgcatgtcaaatgaacatcgcactttgagcacaggttgaaaaggattttttccctggtattttttggttttgattctgactttcttccttttgtcatgcatacactttttattcttatgagataaaatatttcaagctttatatatacagcttttggtcatgcgtagggggcctgccagcttctaagatgatttcgcttttaactttcacattttttcttatgtgttcatggtttcttttttattttttttattattttttaattttttttcatggtttcttttttaatgtttaaatatttgatccacctctaagtaattctttttttaaaaggttttattttttttttttaaaaggttttatttatttattcatgaaagacagagagagagagagagagatgcagagacacaggcagagggagaagcagcctccatgcagggagcccgatgtgggactcgatcctgggactccaggatcacgccctgagtcgaaggcagacgctcatgctctgggcaccacccaggtgtccccacctctaactaattgtgttaatagggcaagaataattttttttttaaccctagttattccaatagcagttggaatccattttttctgaattcatttgaaatacaacttttatggtgttaaattcccatgcatttactgcctttttagattctctgttctgttccaccatcttgtttattcaaggattaagtatcaagcaattttaattattataacttcacagcatttaaaatacctgggcagttcccaccacattcttattattacactttttcaagttttatctacatgacacagaaagagagcacagagggaagagcagagggagaagcaggctccctgttgagcagggaaccagatgtggggctgggatcatgacctgagcctaaggcagacgcttaactgacctagccacccaggcaccccttactattacacttttcacaatttttattattcttacattcgtatttttccatgaagtttaaaatccgctttagttcttcacagaatattgtcactagataggacatttatgtattaatttagggagaactaattattatttaaatgaatcttcatgtattcaatattttagaggacttattaataacaaattctacaatgtactatttcaagaatagaaatatggagcttcgctacgacattaattaccatcgcttcagtagcctactaaatgtagagtaatgccaaaggtgtgagatcatcacaggttctgccacctgagattttcattggaaataaagaactgactgtgatgtcacagaaacctactagtatgccaacatactgtacaacataaaattttgaggaccttaaaatcataccctaatattggtttctaaataccaatctttactaaaaggaaccagggctccttagagaaaggactgatcccagggttgcaacacacaaagtacaagatgaacttcgaacactttgtgctaaagtatgtaagtgctcaaaaagaatgcaggagacttgttgaaagacaaggtgccagcttgaagaggctcccactgaccaaatatgaaagagtatgagcatcaaataatgatggtactggattaaaattgactgaataaaacagactccctaagatcataccaatgttgaatacggaaggaggaaagttttttgtagtaacagaatgctgaccagtaactatagaaggaaatgggagaatcatttggtaatcaccatttacaactgtcataataactgatttaggcaagaatcaacaaggatactaaaatagtgaatttttaatgaggaaaaagttatttacacaggtcaaagtatctctccacaaagaatttatgatttgcaaaggagaaaaacatgctgaagaaacttggtagtcactaccttaaccaagcaatcaaaggtaacactacccatactgggacagatataatgtgtctgttgatgtgatgcaccaaggaagatacaatttacttaggtggtaccaacatgcataacctgaatcatgaagaaacagacaaacccaaactgaaggacattctagaaaataccctatattctttattttttttttaacattttttttttaattttttaatttatttatgaaaggcacccagtgagagagagagagagaggcagagacacaggcagagggagaagcaggctccatgcaccgggagcccgatgtgggattcgatcccgggtctccaggatcgcgccctgggtcaaaggcaggcgccaaaccgctgcgccacccagggatcccccctatattctttaaaaatatcaatgttaggaaagacaaaggcaggctatggaactattctagtttttttttttttttttaagattttatttatttattcatgagagacacagagagaggcagagacacaggcagagagaagcagactccacgcagggagcccgatgtgggactccatcccaggactccaggatcacgccctgggccgaaggcaggcactaaaccgctgcgccacccagggatcccggaactattctagttttaagagacttaaaaacaaaatgcaatgtatgttcctgggttagatactaggccagggaaaaaaaaaaaaaaactttatttctataaagacattgggacagttggcaaaatttgaaaaagatccaaattaagtattaatactgtatcaatgttttatttcttattctggttatataagggaacattcttgttctaaggcaatacatgaagtatttaggagtatgggggtcaatgtctgtaactaactcttaaatagttcaaaaacaaaagttttcttcaggcatacacattttccatttacatgactgagctagcaaaactactgtagagcctagttgtctggaaggctcacccacgtctatgataaacagccagtagatggcactctgtgatcgatctcccaatcccagcagcctggttttccgtagacagcattttagacttcattatatttagaaaacaaaaacacaactgatctgtaaaaaagcaccaataccaggcaactactacattcaaaacagatgctttcacaacggccttacatagcctttcatgatccaatttttcattgcccccaaacccatctctgaccatatctctttagttgccttttcagagaactttctcaacactcctatttaaaatagcaggtggctgcatgctctcccctccacccacttaccctgctctatttttcttcagcacttgacattttcttgtcttccttcccacgatcccagaatataagtctcatgaggacagactttattttgctcaatgtctgcatcccaaatgcctagaaaagggatacacataaggcatgtatctatcttctctttcatccctaggtattaccacacttcgtttgtccattacaccccaaaccagtcccttaatggaaggagactgcaaagagccttaaatcttaaatgtcccagcactgacttattttatgtggaagtcatcaaaacaggtaagcagcaaaagggaccttataaaaacagcgctttagaaaaattctttggtcaaggtggtaaaaggtaacagaagtagaaaccaaagatacaggagacactggaaaggtagttgttataagcaaggcctctgatgccaggagacttaggtttgatcctggctctttagtttaccagagctccaggactttggataaaccgcaaattcaggaagctttgttcttcagcccagtggataaagagaggacgggggaaaaaaaatctacgttatagagaacatagactttatatgcttatcctatgcttagtacaggggactgatacataaattttagcactgcctgtaggaataaaggaaaacaaataagcaatcatctgttcgttagccaactaatttttactaagtatttgtgtcaggcacttttctaggcactggaaatgcagccatgagcaaaaaaaaaaaaagaagtagtagtccacggtcttcatcatgtttacatttgagcatggggtaacaaaaaatagccctcaatatctgaatctatctggttcttgagtttctgccatgaataactaaagttgggtcagcaaagtcccatcaaagtcctatctcaatgtatctcaaggagatacatgttctataatgccagactacaacaagggctatgaagaaaaattaaggcaaggggacagagtagattgtcattatttcaaattggattgtgacatttgagtgaagaggtgagagatgctggagtttaatctggaattgatcaaaataaaactgaaatccaggaggaagaactgatttgaagatactgggttttcggtcttataaatgatttagttctggcttcaaaagacaaactaaaaagctgactagagaaagcaccctagcaactctagtttacttgtaaactttagtcttcatttcttttgacttatggggaatgaataattgtaggatcatctaatatagagaactgtcttctagggactgtgttacgggttgcattgtatctcccccgccgagttagcttagcctccagtatctcagaatgtgactttatttggagatagtatctttatagaggtgaacaagctaaaatgaagtccttgggatgaaccctaatccaatacaaccaatgtctttattaagaagggaaaatttggatacaaatcaagacacacacagagggaagatgatacggagggagaagatggccatcttcaagacaaggacagaagcctaaaacagatccttccctctcagccctcagaaggaatcaaccttgctgattccttgatttctgacttgtagcccccagaactgtgagacaataaatttctttgggttaagacacccagtttgtggtacgttgttacagtaactctaggaaactaatacaaagagaaaatcctgtctgtatgctcatctccccttgagaagagctgaccctacttgaaatcatctttgtatctcttctgaagtacctgatctgatgcaaaaatttaataagatactattttaagttacagcacctaaacacagtagagttcaataagaactcaaattctcccactacttttccatacatatttttcctgacagctatttctttcttttgcaaattgacaagctgaacttaacttctgagacatattcaagtagtaatctcaactcaggaatcctaaactggagctagggtttggtaccatcaaaataaaagtttgagtgcctaagtttatcaagtattaattaaatataaatgaaccccaatctttaggcaattataccccaaattagactttatatttagagattcatatagaggaaacaccaacagagaagttaaaaccatttgtttgataacgaataatagtaagaaatgtcacataaaagtcaaaaggtaaaatcacctaaggtcaggaagaaagcatgaggagggaaggaagtaaccaccagaacactttagttagtgctaggctaggcactcatatgcaacttcaccctcagaatctcagcatttacagataagccaagtcagactcaggggaagtcaaatgacattgtccaagttcacccagcaatggcgtagaaggaaagctggaacccaggactgtgtgatttaaatggacaagctctttttggtaaagagaacgtgtaccatgaatacatgtttctaaccttccacttagaaacatgatgagcacaagtcacctaatttaatcacattgtactattaataatattagcaaagaaaaaatgcaaaatacaacttctgttaaacctattctcaaaggcacaggtaggtgtcgaagggaaaaggaatatcaagggacctcgccatcacgctcacattgtaaaaagaacctgacatctttgatcaaactccttggttaaaaggactttcaagaacattcacaaactggaacagcaccacaattaaaggcaaagtgaatgagaagatacagttgccataaattacatttataatcagttacaaaataagactaccttggtatttcaggaaacaaaggttctcaaaatcacctccaaagttctggcagcctttcaaaaaatgtctagccactcagaacaaaaactttagaatttgagtaaattaaatacacaaagatcatcaacgtggctcatggtacctaccaacaccaaacttaatggcattgatgtttgtacatcactactggttacaatttctatatatagtagtaaaaatatgtagtaagcagagtctggctggctcagttggtggggcatgcaactattgatctcggggttctaaattcaagccccacattgggcacagagattacttaaaataaaaaaatatttaaaaaaaaaacctatgtattaaacattctcaaacttctttacaagctatcctaaaatacccatccatattgtccaaagtatttaagccaccaataaacatattacccaagagcaacacattacacctgactttaatcttcatctacacaactgaaagcacatcatgacaaatgaacatgatttttcttttttttaagatttatttatttatttatttatgtatttatgagagagagagagagagagagaaaagagacagagacagagacacaggcagagggagcaggctccatgccgggaacccgatgcgggtcttgatcccggtactccagaatcttgccctgggccaaaggcaggcgccaaaccgctgagccacccagggatcccccgaacatgatttttatttagctagctcctgccaaccgacttttgtgtccagtgcgacgaattttctctgcaaaggaacaaagtatatttaacttattttgtggcttctgataactttctgaaatcattttgtcaaaagagttgaaaaactagatactccagtctacacagctggtatcatgggtttttttcaaattcccaaagttaattctccagcaagagtacacagaaccacagggctcttccacaattgtgtctactctaactttaggaaagggtacttgagatagcattaagcctaggcctattaaggcctaaccctcatcctgttcagaatctatggcagagattacaaactccagactagaagccaaattctgcccctgaacttttgtttacaatgactgaaaaagaaaaaaataatcaaaatagctataaacaaataatctggagaatcacatgaaaacaaagatttccagagtctgttgaaaaatctgaagatgggacatgtgggtggcttagtggttgagcttctgccttcggctgagggtatcctgagtcccacattgatcctggagtcccaggattgagtcccacactgggctgcccacatggagcctgcttctccctctgcctatgtctctgcctctctgtgtctctcataaataaataaaatatttaaaaaagaaaaaacaaaatctgacgatctggttacactgggctcatctcacaggacgagtgctaagaagtcttttcttcttcagatataaaggaggaggcctactccacacattctaataatcactatcctcttttggcttactcagagtatgcttctaagccacattctaaaaataaatcaacacaattacaaattacatacaatattcattttgtttttatcattatttttaaaagattttgtttgttcatgagagacactgagagaaaggcagagacacaggcagagagagaagcaggttccgtgcagtgagcccaacgtgggactcgatcctgagtctccaggatcagtccctgggctgaaaggcactaaaccgcttggccacccgggctgcccacaatattcattttaaattaagaacacaggtgacccaaattctgtaagacttggaatctttggggaaaaatgccgaagatgatgtaaaatgacaaataaatctgtgttaaccaggcagtaacataattacacaggaaggaactggcccaagtaactttaaaactcagttaatttgggacgcctgggtggttcagcggttttagtgcctgacttcggcccagggcacgatcctggagacccgggatcgaggtctccctgcaaggagcctgcttctctttgcctctgtctctgcctctctctctgtgtctctcattaataaataaataaaatcttttttattttttatttttatttatttatgatagtcacacacagagagagagagagaggggcagagacataggcagagggagaagcaggcttcatgccgggagcctgatgtgggattcgatcctgggtctccaggatcgcaccctggtccaaaggcaggcgctaaaccgctgcgccacccagggatccctaaataaaatcttaaaaaaaaaaaaaaaaaaactcagccatttgactatacccttagggaaatataccctaaggtttaaaacaataaaacaacaacaaaccattagctttcctcaataatcatattgctggtggtagatttggcattgtcattctgagactattttgtatttatactatgggaaaaggaaaacaagttaatcatgtagacactgttgaaaactaggggttttcattgttagagactggagatgtaaaatcaaagaagattaagggaaaagtccctgggtcatttattttgatttttaagtataacatgaactcattattttttttaagaaaagaaaaaaacacaacttattttctagctccaatcacaaataaggcctcgaaacaaagtgtttcttcctactgagttagtcatgaagtgcctagattgtgatcttgaaaagccatttcccactaaaaagcttcacagagaaagggctatttcctggtctaggcagaaaatgtaccacaaggtaaatatgaacaaattgtcataccagatagcaaaaaagttatcaaagatgccttagactgagtcaaatggactttggggctaggccattgcaaagggactccaactggccaaagaagggacaatcactaaaaataactatacatgctacaaaatacatgaatactgggcaacccgggtgactcagaggtttagcatcgccttcagcccaaggtgtgatcctggggacccaggatccagtcccaggtcaggctctctgcatggggcctgcttctccctctgcctgtgtctctgcctctctctctctctgtcatgaataaataaaagaccacttactagtatgattccatttatatgaactgttcagactaggcaaatttagggacacaaagtggattagtcagtgcctagggttggaggtagaatactgttagggggtaatgaggagtgactgttaatgggtacaggtttctttttggggtgatgaaaatgtttcaaatttattagatcatggtgatagttacacaactctgaccaaactaaaaaccactaaattatacatgtaaaacaggtgaatgtcatggtatataaattgtacctccataaagttgtaccaggaaaaaaaaaaataactacaatggactgaaccacaaatgtttaaatctgttgagtttatattaaaataaatctttagggatccctgggtggcgcagcggtttggcgcctgcctttggcccagggcgcgatcctggagacccgggatcgaatcccacatcaggctcccggtgcatggagcctgcttctccctctgcctatgtctctgcctctctctctctctctctctgtgactatcataaataaataaaaattaaaaataaaaataaaaataaaataaatctttagggcagcccgggtggctcagcggtttagcgcccccttcagcccagggtgtgatcctggagaccagggatggagtcccaggtccagctccctgcataaagcctgcttctccctctgcctgtgtctctgcctctctctctctttctctctctgtgcctctcatgaataaataaaatcttaaaaaaaataaaatagggcagccccggtggctaagtggtttggcgccaccttcagcccagggcgtgatcctggagacccaggatcgaatcccacatggggctccctgcgtggggcctgcttctccctctgcctgtgtctctgctcccccctcttatgaataaataaataaaatatgttaaaaaaaataaatctttattgatcactatggaggatgctaggactctaattatatgaaaaccagaaattatcaaatatataccctgcgtcttacatatatttagtgtctctctgagtaaccaaagggaggagataaagtttctctttacagaacaatacaattaataaattaaagaacagaattattaacactttgcaaccctaaataaaatggatctaggcaataatcagtggtcgctaacatcacaaaaagttaaccagacagcaggtgtttcctagtagaagtatatacatcattatctatgaagcagtctagcaaaaacaagatggcaggagaaaaaaaaaaattaaaaaaaaacatgaagaacctatagataaaaagaccaagagagggcagcccaggtgggctcagcggtttagcgccgccttctgcccagggcatgatcctggagagccaggatcgagtcccatgtcaggctccctgcatggagcctgcttctccctctgcctgtgtctctgcctctctcactctctctctcatgaataaataaataaaatcttaaaacaaaacaaaacaaaaagaccaagacttttcaaacaatagcaatataatgaatgaccttatgaatcctgattcaaacaaaattaaaatttgaaccctgactgggtatttgatattaataccttggtggctcagcggttgagtatctgccttcaactcaaggcatgatctcggagttctgggatcaagtcttacaacaggctccctacagggagcctgcttctccctctgcctaggtctctgccttctctcatgaataaataaataaaatctttgggggaaaaaaaaaagaccgtggttcaaaaaaatttttttaaagattttatttatttactcatagagacagagagagagaggcagagacacaggcagagggagaagcaggctccatgcagagagcccgacgtgggactcgatccagggtctccaggatcacgccctgggctgcaggcggcgctaaaccgctgcgccatcggggctaccggttcaaaatttttaagtgtgaaaataatactgtagctatgtttagaaaattaaagagttggggtgcctaggtgcctcagtcagttaagcaactgccgtgggctcaggtcatgatcccagggtcctgagactgagcccccatcaggctctctgctcagctgagagcctgcttctccctctccctgccactcctcttgcttgtgctctttctctgtcaaaaaaaaaaaaaaaaaaaacttaaaaaaaaaaaaaaaagaagaagaaagttaagagtctgtatcttacataatgatatgatatctggggtttgctttaaaatagaggaaaaagggatccctttgtggcgcagcggtttggcgcctgcctttggcccagggcgcgatcctggagacccgggatcgaatcccacatcgggctcccggtgcatggagcctgcttctctctctgcctgtgtctctgcctctctctctctatcataaataaataaaaattaaaaaaataaaataaaataaaatacaggaaaaaaataaataaaatacaataataaaaaataaaatacagggatccctgggtggcgcagcggtttggcgcctgcctttggcccagggcgtgatcctggagacccgggatcgaatcccacgtcgggctcccggtgcatggagcctgcttctccctctgcctatgtctctgcctctctctctctctctctgtatgactatcataaataaataaaaatttaaaaaataaaaataaataaaaataaaaaaaataaaatacataaataaaataaaataaataaaataaaataaggggggcagcctgggtcagcggtttagcgctgcctttagcccaaggcctgatcctggagacccgggatcaagtcccacatcgggctccctgcatggagcctgcttctccctctgcctgtgtctgtgcctctctctctctgtgtctctcatgaataaataatcattaattaattaattaaaaataaaataaaataaaataaaataaaataaaataaaatagggggagtagaagggaataaggatcaaacagtagccatagttggtaactgttaaagttgagatggttacacaagggtttttttttgccattttcttgtttgtatacatttgaaaatttccacaataaagcttttaaaaagacaaaatgctgccaagcccttcattggaagtattgcatttcacaaattcaaacacaaataggtctcccaaccatacccatatgtctgaaatcaagatgcatcttacagtgaatgatcagttttaagtggtagtatttttcctacgtggtacataaaatggtgtaatttaaaactgactgggcagcccaggtggctcagtggatcagcgctgccttcggcccagggtgtgatcctggagacccgtgatcgggtcctgccatcaggctccctgcacagagcctgcttctccctctgcctgtgtctctgcctctctctctctctttttctctgtgtctctcatgaatggataaataaaatcttaaaaaaaaaaaaaaaaatagggcagacctggtggctcagcggttcagcgccatcttcagcccggggtgtgatcctggagatccgggatcgagtcccacatcaggctccctgcatgaagcctgcttctccctctgcctgtgtctctgcctctctctctctctctctgtggtctctcatgaataaataaaaaaataaataaaatcttaaaaaaataaaaataaaaataagtaaataaataaaaaactgcatctcaaattcaatggggaaaaaaaagccctccaagattacaaatacatctagttatcttctcaccttagctaaatcattatttgcattgtactggaaatgagttcaaaaataccctcttggctatccaaattttttttacttgtatggaattaattcagttacagtcagagaagcattaaaataatacgttagccaatataggagtccttaatctcccattagtgatagagaagatcagatgaacatggagcaagaagtctccctaagatggaggagaaaaaaacattgccacagttatctcaccatgtcaaaaaaaaaaaaaaaaaaaaatagtaaaaactgagtccagttgactagcctgtcttttcttcatttttcataaaggagtttctaagtacccaccactttgacacttccataaattgcctgtttcaaatattctaaaggaacatagtattctggcaagcctctgctattaatggactctccattataccagaaagactaatgtaaacaaaatttaccaacattatataaacttactaaggaagaaaagaggacaagaaacgatttctgacaactgcaattctagaaatccaattttgcaaccacatatttcaatggaatcacaaatataaaactttatttaatgataactgacactgaaaatttcagatgaaaagcaaaggaaaaaacagatttggggcagccctggtggctcagagggtttagcaccgccttcagcccagggcgggatcctggcggcctgggatagtctcaagtcgggctccctgcatgcagcctgcttctccctctgcccatgtctctgcctctctgtgtgtctctcatgaatgaatacatacataaaaaaaaaaaaaaaaaaaaaaagatttgccacatttaaaaaaaaaatcaatgtatgtaaaaaacacactataaatgaaatcagaaaggctatcaacattctgagaaatataaatctgccacatgacaaaaggtatattcttaaacagctcttaagatcaagaaaatgatcaacaatccaatataaaaatgggtaaaagataggagcaggccaataaatacatctcagaaatggcccaccttattgtaacagaaattataacaagataccttatcaattaccaaatttgggaaactttttaagtaacactgcccagttctactggccaagcaggatgtgcaagaatattcccacttccaaccctttgcttggaacagtcttccttcattccctacgtggtgttatcttctcagtatggcttcaattaccctattttaaactgcaccctcctctccacttctcaatttgccttatcttcctctatttttccaacttattgccttacatgccacgtaatttacttattatgtacattgtttattctctgcccccacctccatgaaaataaagtttctttttttttttttttttttttttttttttttttttttaaatttttatttatttatgatagtcacagagagagagagaggcagagacacaggcagagggagaagcaggctccatgcaccgggagcccgacgtgggattcgatcccgggtctccaggatcgcgccctgggccaaaggcaggcgccaaaccgctgcgccacccagggatccccgaaaataaagtttccaaggacaaagatgctcttccttcactgacatattacagggatggaaaactgcttgggatatgggagatgttcaaaaattatttgtttaatgactaggaaaatccaactagttaattcctaattaaactagttaatgtctctggagaaaactttgttgatgacataaatttaaaaacctttattatttatttatttgtgagaaagagcacgagaaatagggagagttagagagagaggaagaaacagacacctcgatgagcagagagcccgactcagggtttggtcctgagccgaaggcagatgcttaactaagccacccaggcgctccaaatttaaaaacctttaaaatgtacataccagtaatatcatttctaagaatttatcctaagtaaataatcactgacatgagcaatggctatccaaaagcttattcatcttcactatgaattgtgaagaactagaaacaacgtatactagaacactgaaaaggatgtggaatatttaatgctatggtagctggggggaaaagtatacccaatgattccatttttgtcttgagtatatgaataataaatgtttgggatccctgggtggctcagccgtttagtgcctgccttcggcccagggcgtgatcctggagtcctgggatcgagtcccacatcggggtccctacgtggagcctgcttctccctgacacaggcactgtgtcactgacactgcctctccctctctctctgtgtctctcatgaataaataacaaatctttaaaaaaataatgtttattaataggcgctaatataaataatgatataccaattaacagaatgatggaatactagatgaagctactcactgtgtcatgatacagaatcatttattcttctttttaaaatttttttaagcaggctccatgcccagcctggaacccaacacagggcttgaactcacgactttgaaatcaagacctgtggggatccctgggtggctcagcagtttagcgcctgccttaggctcagggcgtgatcctggaatcccaggattgagtcgtacatcaggctccctacatggagcctgcttctccctctgcctgtgtctctgcttctctctcggtgtctctcatgaataaataaataaaatctttaaaaaataaaaggaatcaagacctgtaagccctgagctgagatcaagaatcggaggcttgcttaaccagctgagccacccaggtgccccatacacaatcatttctaagcctcatgaaagaggcagacttaaaaaaaaaaaatagtaaggctatactataaagaactgatccaaggtacattgttaagtgtaaaaagcatccaaaaccatttaattaaaaaaaaaaaagtttcgggatccctgggtggcgcagcggtttggcgcctgcctttggcccagggcgcgatcctggagacccgggatcgaatcccacgtcgggctccctgcatggagcctgcttctccctctgcctatgtctctgcctctctctctctctgtgtgactgtcatgaataaataaataaaatctttaaaaaaaaaaagtttcaagtttatgtactctactaactagataaaaatgttagacattttcaaccatctttttttttttttaaagatttatttattcatgagagagagagagaaaggcagagatataggcagagagagaagcaggctctccacagggagcccgatgcaagactcgatcccagatcccgggatcacgtccagagccgaaggcagacgacgcccaaccacttgagccacccaggtgtccccatcttttcttcttaattttcaatgtaacaattagtttaaattttttttttcatttttttggaaaattaggaaataaagccatctctcctttgactccatagatcaaatatgagcaaaatcacttctccaggtcaaataattttactaccaaatttatactaaacccatgaagttctttaactgcaaagaaattaaaaattactgtccaaacatcctaagctaagtaatacaatcattagataagaaatccattctggaattatgttccatagaaataatgccaaaagcaaacataaaatgtgttaaattataaaagcttatggcagataaaagcacacacctattagtgtatatatactgaaaaccaaatgaccaaaagacaacagagaattgtgcccttttagccagtaggccatgaaagggtacttaaaactttaccccaggcatcctgaggtactttattaagaagacccagtttgctcagtttctaccttgtttgtcctcccagacgtatcaaaaggaactgtcacttggagatagcaatggttagtactgaggcctttgggatggatatatcagacccagatatatgttggtaaagagtacagtgtctgaaaaagtgaaatggagacaaaattcttcaaaatagactagaaatccccaaagtccaatctttcagcacagtgaaagaacccaaaggaaatactagagagcactgacctggaaggtaggagccctggatcccagttctgatccaactacaaacagctccagctccgtggacatattatttcatgtatgtaggttctagttttaagatctacgaaattagggatccctgggtggcgcagcggtttagcacctgcctttggcccagggcgtgatcctggagacccgggatcgaatcccacatcgggctccgggtgcatggagcctgcttctcctctgtctgtgtctctgcctctctctctctctgagtatcataaataaataaaaatttaaaaaaaaaaaaagatctacgaaattagtagactgaaatcctttccactggtaccacaccatgactgactaaattactaagatgtggttacagctgtactcctaagttttctaaaattcttcatttaaatgcttaacttgggcagccggggtggctcagcggtttagcgccaccttcagcccagggcgggatcctggagacacgggatggagtctcatgtggggctccctccatggagcctgcttctccctctgcctgtgtctctgcctctccctctctctgtatctctcatgaataaataaataaaatcttaaaaaaataaaaataaataaacgcttagcttctgtaactttttaatcagtttttgccatgactaaactaccagtcataacaacatagaagaccatttccttaactaaattttccaaggtcagattgctaaaagtggcaaaatcataattcaaaccagatctgactcactttgaagaccaaatttatggcatacttcttcctcagaccttctccctgactaatctagtaaccaactagattagatactaatcttaggggatccctgggtggcgcagcggtttggcgcctgcctttggcccagggcgcgatcctggagacccgggatcgaatcccacatcaggctcccagtgcatggagcctgcttctccctctgcctgtgtctctgcctctctctctctctctgtgactatcataaataaataaaaaaaaattaaaaaaaaaaaaagatactaatcttagcttgcttttgcaaaatgactggaagtccggaatgcagtcagaagtcagggagcaaagtcaagttacttgagttaggtgggacttgaacttctgacacagtattctaacctaagttaattagacatttcaggatccctgggtggcgcagcggtttggcgcctgcctttggcacagggcgcgatcctggagacccgggatcgaatcccacatcgggctcctggtgcatggagcctgcttctctctctgcctgtgtctctgcctctctctctctctgtctgtgacttaaataaataaataataaataaaatattaaaaaaaaaattagacatttcagctacttaaaaaataagaaaggtaaaattgtcaagaaaaactattaactgaagacaaaaataaaacacctctgaaactacaagtaaacaagggtgattcatttacataaagtttcatatacatagaacctgtacaagatgaaatatacagtaaaacaactgctagattatctgtgctattcacttgcttttgtgaatgtaaataatgaacacaaattatccagcagtgaaggaaggagtaacagataatccaaaacacatatatttggctttagaaataaagcatacgtctaaatagataatccaaaagtaatgaatatctggtgctaaaaatatattatcagggtgcttggctggctcagttggtaaagcacgcgactcttgatctcagggtggtaagttcaagccccatgttgaatgaatgaatgaattaatgaatgagtatcacctagatatattttcctcccaaatgacaagttattcaggttaatacaaaattaatttccaagtggagagaccaggacacatcattcctaaacaatacagaaaataatgaaattaccatctccctacatcagaaaataaaacgttttataacattcacatcagctccagagggaataacaaaactaaggcacatacaaaaaaaatgtaacatttacactcccactggagacaagaaccaggttagctcctcagctatttccattaaaccaacctgggattaaaaactagttttgggggatccctgggtggcgcagcggtttagcgcctgcctttggcccagggcgcgatcctggagacccgggatcgaaccccacgtcaggctcccggtgcatggagcctgcttctccctctgcctatgtctctgcctctctctctatctctgtgtgactatcataaataaataaaaattcaaaaaaaaacaactagttttggaataatccatatgtggataatcaagaggcaaacacacacaaacacatgtagataaactcacatttaaatgcataggttacctaccaagcaccttacaaaataaaaaatttcgtaagacagttgacagaaatggagcaagcggtgaggtcacctaccacgttagctacattgataaaagtcattacgtgctcatctcaaacattaggtagccaccaagacccacacttacacacacaccccgcatgtgggaacattcagaaaggtaacctaggaaaacctcagaaactgctccttttaccagctcaagaatgaagttgtattcaacaagtaaatggaaaagggtcaagaaaataatgcatttccccccttcaatccaaattgtctaaaagacaactttcaggaccctcggcaagtaaacgctggtttgagctaaagttctttagactaagcctcgctggcaggagccctctaccgggcgtttctcagatgtgaccaacttttgtgtttcccacagtagcgctaaaccacggttacgcatcctgctgataaaaccggacttgaggcacttaacaccccaaaccagattcaccagcggtgtggctaaagggctctcccgtcactactgtgaggcccactccagcagggatccgcaccgagcgcgaggacttagggtttggagagaagattagcagcaccagccgccggctgtgtcctcagtggtccgcccgcacttaacccagggggaaagctccatgccctcgtctacaaaagacggcgtgcggcgggcagaccccaatgcggaaaattcactttaagaacttcccaacggcctaccgtgctgacttaggggtccagttaggacaccgggaagcaggtagggaagagaccacagtccacaaactgatcaggatcaaccagccccgccgggaggcccaaactcggggggagctggggagctaaggcaccggacgggctccggtcctcctccgacagccctgtccagcaggcccggcgccgctgagacccaggcccggccctcagcaacaccagctccgttccacacggttcaggaggcgcgaccctccggggccactccgaggccatgcggccgcggggcgccccaacccggcgcacgttcaagaggtgaaaccagagggcaggaggtgcgggaggaaatccaaagaaggaacgagactcacttcctttgggctttgtccttcttggccttggtccttttctttcgggcctggagcgcaagcactgcaggagagagggatggatgaagggcgaccgtggaggaaaggagccgaccaaggtgagggcggagacccagcaggggcgcgaggcccgggtgcggggcctgcctgaagggcggctccggggcgagcgccgcggcttctgccgggcggcgggcggccccccgggtgcacagcagcgcccaggctgggggcgccggcgggggcccgggccgggtcagggggccggcgggccggggtctgcccgggtcgccgagcgtcgggccctgcagcggccccaggacgcgggccggcctggcggggaacaaggggcgagggctgccggcgcggaaggacgccggggctgatgggcgcggaccggcagcccagaggcggggggtgaggcgcggcgccacctcagcgggggggcgccgcacgcccggggactggaccgcggcggttaggaggggctccagcgctgacccggacctcgccccgccggccgatgcccctcgtggcagaggccgctccaccgctcacctttccgctccatggggagaccggtaaccgccaggcgcctgcgcactcgagtggcggtgactcccgctcccgccgcggcccaaaacccagccggcgcacaccccgccctccaggccccgccccgccccggccccacgacggcgcgcgcctgcgcggtgagcgcggagcctaccacctgctcgccaggagagggggggctgtacgggaccgggggcggggaggagggaagaacgccgccgtgaatgccgcacaggtgcggagaaccggcttggaagcctggcggggtcaggttcgttccgccggcggggcggctgccgctcaggagagcaggaccgcgtggctttgagggttccctgtgtgctgagtcagtgctccgcagccacccggagtccgcctcagtttcctggtctgtaaaatggatttggtcaggcctgccccagtttcttcgctgagctctcgcgagggtctgttgagaggaaagagagagagagaaagaaaagaaagaagggggggggggattgtaaatgaggaagaaggaaaagttggagcgacgcagaagactggaaagagggagcctgtgaccctccctcctcactctaaaagtgaaaactgggatccctgggtggcgcagcggtttggcgcctgcctttggcccagggcgcgatcctggagacccgggatcgaatcccacgtcgggctccctgcatggagcctgcttctccctctgcctgtgtctctgcctctctctctctctctctctctctctctctatcataaattaaaaaatatataaaaagtgaaaactttaaaagtgtgtttttcttttgaaatttcgagtttatacgaaggctgtaagggaaggaatggggagaataaaaacagcgttttctcattttaacacttcatcttttcagtacatgagaaatatagttatctcttaggatgtctttatacttttgtaagcgcattacctcatttgatatttatgacaacctaaaagcaaaatattacctccaccatacaaagaaactaaaaattaaaggggatgtgtactcaatcttgatgtcccgatgcaaagattcaatcatcaaacccgtatcataaaacaaggttagcaaagtttttctgtaaagggccatatagtacattatggcttgtgggccataggatctctttctcagctactcagttctgcccctggagctcaaaagggaaatagaaaataggggctgtgttccaataaagctttatttatggtccctgacatttgcatttcgtgtaattttcacgtgtcatgaaatactattcttctgttgatccttttcaactatttcaatccctcttggcttaggccaacccctgttgtaaagcactaacgctggacagggtggcagctctgaagacctttgccctgaaagaagttagactctatggggaagacggacaagtaattaattgactaagaagggaagatgaaagtataatagtactgcgcaagtgaagcatggggacttgggcgggattttattgagcaaagtaaataattaaatccagccagggaggaggcagcttttgaagtgggtcttgggaaatgtgtaagggtttccatagatggagaaggagatgttaggcatttctgaatgagaaaatcaattgagcaaaaaggcacaggtttggaatcctaaggcgggggcgggggctggtaacgactgaagtggatcaagtggcatgtgaggccagaaatgcaggtttgccaaattcaaaatttagataattaatatctgttgcatggaacctgaatgataacatttctggacatattgccaaagaggacagcacctgttggccaaggaaaactgcatcccagtttcctctccactctacttgagaacaaaaggagagctggggcagacagtgaacccctggaacctgaggattccactagcttgggaaaacctcgtgtgattcagaaaagacaggaaagctgcagtggctgagaaaaagtcccagattggcaaagtactctccaccagaaagtaaactctatgagggtaggacactgttttgaattttccttgattcctttcctggattttccttgatcctcagtgcctcgcatagtatccagcacttaaggggcttaaatatctgtctaatcaaagaataagtgatgtgcagtttatgagaaagttctggacgagagagagagaaaacaatgagagggacaacgtgaagctgtgctagtacccaagtaggttactgcagattcatcggaagggaaattcgtttaacttggcatgaattcacctacctattctggctcggagtaatcattgcttctttctctaagagcttactatttaacaacccatttgagaatttttccaaagtcggtgtcatgttcactggattaagttccctgaattgaccatttcgcccttttttcatttgtttttttccccccattctttcagcgtacttcattctccacactttttctaaactctgtgtagttgttcatatgagctagtttgtaccccccctttctaaagcctatgcctttaagaaacaaaacagatgaccatggggtgggggggaggcaaacccggaaacagactcttaactatagagaacaaacaaggtcactgaaggggaggtggggtggggggttaatgggaaaggggtattaaggagggcatttgtaaaaaaaataaaaataataaaaaataaaaataaaaaattttttaaaaattttaaaaaaggagggcatttgtgatggtgttgcacccagcactgggtgttgcatgcaagtgatggatcactgaattctactccggaaactgatgttacgctgtatgttaattaactgtaatttaaatagaaacttgaaaaaaaaaaaaaagcctctgccttttttgtgcttcttgctttaaaagtaactttaaaaattactccccaccctctcatccccagtttcagagggcttgtgccactctggacttcacccttcctcctcaagtggtggccattcttacatgcatatccctcttgaacaactgtttttctcaagttcttttatttatttatttatttatttatttatttatttatttatttatttttagagattctatttatttatttggcagagagaaagaatgcataagcagcagggggagaaataggctccccactctccccactgagcctggaccctgatgcagggctagatcccaggaccctgagatcatgacctgagcagaaggcagacatttaactgactgagccacccaggcgcccctgctcaagttctttcaaaagtagaattatttggagaatgaagcagtgccagaatttaatttctgaaaagatcccattccccaggagtttatttatgaagactcccttggatcttccttaatgcgtctttgaagtttttgaaatgtgatcacctaaggtttaggacatatatttcattaaacccaacattccctgctttggttaccacaaatttgtattctttgtccaaagttttgatctgaattaaaaccaaagtatttgtgagatgaaacagacaacggaagaaagtggaactgtatcagatgctttattttgcagattcctagtagatgtctgcataattggagaaccccaacagaatcttacatagttttgtgaactatattgggaaaacaattatattctaggctgagtttcaggaaacacatggcatgttcaacaaacgaagggaattgaatgaaaggattgagatgtgaaaaaaaaaaaaggattgagatgtgggtaaggttaagagaaatgaagaagggatggtgaggcatccagggactgacattcctaggcttgaagggacaaggggtggaggtgttaaccggaacccaataatacctatgttggtcaacttagggttgccaaaacaaagtaccacaaattaggtggcttaaacaacaaaaatttatgatctcacagttctggaggctagaaatccaggtgtcagtaggactgggtccttttggggaccacgagggacggatctgtcctctttccttggcttctagaggactctgtgtctctttctagtttcttttatgtatgtctcaaactgtgtccaaatttctcctttcataagatcatcggtcatactggattaggactcattctaaggatctcctttaacttggttacttctgtaaaggccctatctcagaataaggtcaatttcagaggtactgaggggaggggttaagactccaacatatcttttctgttgttgttggggaggggacacaattcaactcatatcagaattgtagtgaggcggggcagcccggtggctcagcggtttagcgccgccttcagcccagggcctgatcctggggacctgggatccagtcccacatcaggctccctgtggggaacctgcttctccctctgcctatgtctctgcctctctgtgtctctcatgaataaataaaagataaaaggacataaccactgcctagcaggaaatgaaatgcccaatttctttctcctcttatcctctcagactagtgcctcccattgactgaacccacctggaagttagaaggcaagggtgcctgggtgatgcagtctgggcaagccagcctcccagggtacagggagggtggagaagggtggagggttcatctggaggggcaaacagagaatatccagcacagcctgtctgggcagtctacatgatacacccaaagtggctagcactttccaagcaaagtaagccagccttttgggctccctggtccctgaaaaggcttgagaaccaaagctgcttggagataatcccctttctggcttttttttctttccccccataaaagcttaagcttcacaaggaaactgtgctggagcaaagggtcggggagaggaggtaggagagataaaagaataaaaactttggtttggtggagtggggaactaaatgagttctttgcagtctccgtgctctgtcctcttggatgctctgtccacagcagcaaagttggaggagagaggagatgctctagcaatgaggaggttacagagatccgtggttccagagacaggtagagcccttgctctgcttcctgggagagagccaggcgttgcaagctggcctgagctgatcacatccaactctgcattcttttttgttgctaacgataccttccagcgaagtttgaagggatgaggaattgtctgcctcacatcctcactcccgcatatgaaaagttgcagactaaaatctgccgcacacacacatttgtcaaacatttgtttgcaagcaggcacaaaaacagctcctgtgactatgtacattctttgaggtctctgtcctctcggatgctctggccactgtgtgaaagctttactgctcccctccctccccatggggtaactatcacagaggcaggactctgtcacccgcagagtaggcatcagggaaccagagagagggtcttttgtataattcattatgctattccaatcctgatcaacaccagaggtgtcagcagaagcaggtttcctttttttttttttagaagcaggtttccacttgtgagatgagttgcctattaatttgtgtaatggatgttatttttttttaaagctgctgttggcagaatttatgtaatcgatgactctgaacccctttgttgaagccaccttctgattagaatgttcgcaaactactcctggcctgggaattgcagattagaatataagccgcacctgggtgtaactataagtaactagcatctacaaatgttatccggtctttgtcaaaagttttcatatgcccaagtattttattttgaaaaggtggattcatttctttaaaaatgccaattaaaaaaaaaaaaaaagagtccatccctaggggaatggattaaaaaagttttacaacacatcccctctaggtgagttgccaaaacagggatacattgaattctttctaagtttctgtaagtaccggaaaaacatcctcacctagactatgcttctctttccttgattccaatggggaatgtcaaaatattttaaggaagattgtaaacaacatgaggtagagtgcccctctgaggctgccaggccaggcgaagatgctccactatactaaatatgttcatggagccatgcagacttggacaataaaaacaacggactgaagatcaaacgtattttccctattttctgagcaaggcataaacctcctagactctctaaggggaccccagggagaggaagcacgtaatgagagcgatctaatttctccagcttggcaatctcaggttcagagcaaaggcagtataggaaaaacatagaaatatgacttatgcacttgaattctgatttctacctgcgatgcaatgttgaatccattttgcttttctttctttcagatacttctcaccacatcaccctcgtgatgaacattcattgagcatccactgcaggccagggccgtgagaagcagagaaggaaaaaagccaacaccttgccctctaggacttaatagctaactcatataataattactatttgtccctcagctgtcaaaacaactctaccaaaaataggtgttattatcaccctctctggcagatgaggagactgaggcacaaccaagttcacgcaagcaaggaagaggcagggttttgaatataggccgttgggttctggaatccacactcttggctacacaccatatcacctagtttagtgggggatggacatataaataaataattcacacagtgcttaatgtgtgggagcacaaaaaagaggcccactcagctcaaggtcctaggaaggatgaggagagaggcatctcttgaatgagatgacacctggatggcggtggagagcatgaatagatgtcagctgggaatagaaagaggagaaagaaaactccagccagataagacagcatggtattggagggtggggcgagggggagcagagacaccatagaatcactggagaataaaatgccaagggagcgatagggaagtttgctcctcaattgtttgctgggcctcttctatgtacaggactattcttgttgctgtggatatagcagggctagagcatcgaaggagcttcaacttgaacttccaaacattttgcacccttgctcactgaaataacttttaaactaccaccatgcaaaacattcaacaaactagaaacagaagggtgcctcctcaatctgataaagagcatctgtgaaaaccccacagctaacatcatatctaacggtaagagattaaatgtcttcaccctaagatcaggtataagacaaggatgtccactcacaccacttctattcagtgttgtactggaggttccagccaggatcactaggcaagaaaattaaataaaagcatacaaattggaaaggaagttgacactttgaaatacaagtgttacatcagctttgaatgccaatttgatacctgcatctatccattaatataagcaaaaaaagtaaaattactttaactacaagaaattttacattactttttttctcctttaacttgtaattctattccattttactgtcacagtagcttatcctaaagtcatataattttatactttaaagtctttattgaaagttgagaatagagctcccctatgatacagcaattccactactaggtatttaccccaaagatacaaatgtagtgatctaaaggggtacctgcaccccaatgtttatagcagtaatgtccacaatagctatatggagaccccagatggccatcaacaggtcaatagataaagatacacacaaacatacatagacacatgcacacacactggaatactactcagccatcagaaagaatgagatcttgccatttgcaatgacttagatggaattagaggatattatgctaagggaaataaatcaattagaaaaagacaactattataagatctcactcatgtagaatttaagaaacaaaacagaggatcatgggaaaaggggggaaaaataaaaccagagcaaatgagagagggagacaaaccataagacacttttttttttttaaagattttaattatttattcatgagagagagagagagagagagaggcagagacctagacacagggagaagcaggctccctgcgggagtccaatgtgggactcaatcacctgaccccaggatcaccaccagagctgaaggtagatgctcagccactgagtcacccaggcgcctccctataggagattcttaactctaggaaacaaactgaggcttgctggaggggaaaggggtggggagatggggtaacatggtgacaggctttaaggagggcctgtgatgtaatgagcaatgggtattgtatgcaactaatgaatcactgaccttcttaaaccaataatacattatatgttaatgaaatgaatttaaattaaaaaagaaggtatgagacaggaataaaatctcacctgggcaagaaaataactgcaaaatattggagttggaaataaagtccagttgacttatgatgaaaaaaaaaagtctttattgatcatcctgtcatacttctctaacacataaatgcgcatttacattgaaatttaatttttgggatccctgggtggctcagaggtttagtacctgcctttggcctggggcgtgatcctggagtccctggatcgagtcccacatcgggctccttgcatggagcctgcttctccctctgtctgtgtctctgcccccctctctctctcctgagtaaataaataaaatcttaaaaaaaaaaaaaaaaaaaaaagggatgcctgggtgacgcagcggtctagcgcctacctttggcccagggcgcaatcctggagacccggaatcgagtcccacgtcgggctcccggtgcatggagcctgcttctccctctgcctgtgtctctgcctctctctctctctctctcactgtgtgcctatcattaaaaaaaaaaaaaaaaaaaaattaaaaacgtttcctgagatcataatcttttaaaaactttcttttaaaaactcttttagggacgcctgggtggctcagcagttgagcatcagccttccgcccagggcgtgatcctggagacccaggatcaagtcccacatcgggctccctgcatggagcctgcttctccctctgcctatgactctgcctgcctctctctctgtgtctctcatgaataaataaataaaatctttaaaaataaataaataaacaaataatcttttaaaaaaaataaaataaaatatttaaaaaactttcttaccaagaacaacaacaacaacaacaacaaaaaaaacactttcttacctattacaagtattcttattgcaggattaatcaaaataatgtatagcataattttttgatacatggaattttattgcaaatgcatctcattagaatggtgggtgatttttctccaagagtcctgcatcattcccttccttccttccttccttcctttctttctttctttctttctttctttctttctttctttctttctttctttctttctttctttctttctttctttcgtaatgaccaagaaaactggcccatataaaacaagtggatgggaaccaaaagggttttgctacagtaatatagttcttggtgttcttttggaactccttccaaataatttgccaaaacccttcagtaatcatcaccaaagcttgttttaatcactcatcacctgacaattcctggaggtgtttttttgtttttttttttttcctggaggtgtttattcaattttgtcaaaatcaaataatgggaaaccatctgaattgcaaaaagatgtgttacctggtcattaaagttatttactttctaattcagacatcagtatttcattatgtccctttgtttgaacccctgaagggaagtcagtctctgggacaaaggttgcaggatactgtgagtttgtgtttttccatgagaatttacaagcagttaaagcccttttctccccctcccctccttttttttaatgaaagaaaaatacacctgtctgaattaatccttgcaaaccgcccttttcctgctggctcagatttagttccaaaatggcatttgattacatagtatagaggccctgagaaaccacattcaacattttttgatacacttgatccatatttggcttctacagaagataaagaagataagcttagagggagaagatgacctagtattgcagatggggttgacacctctcccattgcacatacattgcaatgtacatacattgaagccactgcacaggttaacttgtattaactaggaccaaagttagctcatggattgcctgaaataagcagggataattttgccatttcataaactaattgtgactcagaagaggacacaaccaccctgtgtttgcagtcacgtaggcagaagcaacatcaggtatctggagacaactatgcccacggtagcggactgggagcttgggaagtctatccacagattgattacatacacagcctcatgtctgatttgcttctgattccaggtaatcaagaaaacagaagcctttcttgaagggagagctgcaggcacatttttgctcagggactctgcccaagaggactatctctcctctgtgagcttcctttgccactgcagatcccttcgtgcccaaattgaacagtagaaccacaaactttagttttgatgtccatgacctgtgtgtatttcactcctctgctgtaacagggcttttggaacattaaaaagatcccagttcttgcatatattttgaaccattgcttactatatcactagacgactttcccttttagtctgcaatatatccgccattcaataatctgcagatgcactgcatataatggaattgatgggcttcctttaccatcaatggtgcagaatttttagagtgtaattagggcagccccggtggcacagaggtttagcgccgcccgcagcctggggtgtgatcctggagacccaggatggagtcccacatcaggctccctgcatggagcccgcttctccctctgcctgtgtctctgcctttctctctctctctgtatgtctctatgaataaataaattaaaaatcttaaaaaaaaaagagggtaattataagggtacctggggtacccagtcggctgggtgtcagactcttggtttcagctcacatcctgatctcagtcagggccctgggattgaactctctatcaggctctgcactgagcacagagtctgctggggagtctctctccctctcccttggccccacccctgcttatactgtctctcaaataaataaataaatcttttttctttttaaatatcgttataaacaaaaagttaagagtgtgccacttaacaaagagttaagagagaactctcctgttctcaaagggcattaactagatctgcttttatgtgcatcggacagtatacctacagcaagcacacatgtcacctttaggctttttcaggacagtatacaagcttagtgttagtatctgtcagatgtgatctgttgttacttagataaatgtggtgcctattgagacagcagaggataaagctacaggtacaggtgttcagtaaggttacaaaaatattttgctgatttagctaacagtttggtttttaatgtctgtggtaattgagtgaggcaactctggggcatttgctatgaggaattctacttcttactgaagagtgaattattaatattagatgagtatttcaccagtatgcctaatgtttaggggtttttttaaaagaatttttctataaatttctcaaagcagaaatgcttgtagttctgtaaattaaacttaggaagtccaaaaaataataactatcttccttttacaaaaaaaatgcaattttctggccccaagggcatagtagaattcacttacatgttgatatagtttatattcagtttctttgtctcttctgcaaaagatactgtttataagccaggtcttaaaaataatagttctaaaatttcagatttataaagttggtaataaaattgtatttataggttaggtattaatagtttaatgggtgctttaatttaaaacagacatttgggggatccctgggtggcgcagcggtttggcgcctgcctttggcccagggcgtgatcctggatacccgggatcgaatcccacgtcgggctcccggtgcatggagcctgcttctccctctgcctgtgtctctgcctctctctctctgtgtgtgactatcataaataaataaaaaaaaaatttaaaacagacatttggagccttgtagacactgctgccttggagccatccacaccaaccaaccttgatcaaccccaagaatccatggggttctttgacattgctggtgagggtgagcccttgggtcctgtctcctttgagctgtttgcagacaaagttccaaaaacagcagagaactttcatgccctgagcactggggagaaagagttttattatagtttcctgctttcacaggattattctaggatttctatgccagggtggtgatttcgcacaccataatggcactggcaacaagtccatctatagggagaaatttgatgatgagaatttcatcctgaagcacacaggtcctggcatcttgtccatgccaaatgctggacccagcacaaaagctttccagtttttcatctgcactaccaataccaactgggttggatggctagcatgtgatctttggcaagacaaaagagggcaggaatatcatcgaagtcatggagcactttgggtccaggaatggcaagaccagcaagaagatcaccattgctgactgtggacaaatctaataaatttgacttgtgctttacctaagctgccagaccattccttctgtggcttaagagagcaccctttcactctcatctacgtgaaatatcccataatctttgtgcttttaatgcagttttatggattccatattttccttactcccctccaagtctagctggattgcagagttaagtttataattgtgaaataaaaactaaatgacaaaaaaaaaaaaaaaaactaaactaaacaacaattacaaaacacacaaaaatcccagacatttgggatagctgctgcaatgtaatcctgtgtgtgacttttgattttaagattttatttatttatgagagagagagagacaaaggagcagggtgacaggggacagagggaaagggacaagcaggcaagccctcctcagggctccatctcaggactttgagatcatgacctgagccataaatcaagagtaagacattcaactgactgcaccacccaggcacccccgtacatgacttataagttgacaaatgtagtctaatcattgattcccatactgagctcctattcctatgttgagtttgtggaccatgaaagaagtgagactagaggatgcctgaacaagtcagataataataagtgcagtggctgctgatgttgagtttattgttaaactataattaatagtttggatagcagtatttctcttcgctataaactctcatagcccagttacttaagtacaatttataatatttcagtgcagttaatttttaatagaaaatctggaacctaaattacagatttaaaaggtactgtatggggatgcctgggttgctcattggttgagcgtctgcctttggctcaagtcatgatcctgggattgagtcccacatcgggctccccatggggagcctgcttctccctctgcctgtgtctctgcctctctctctgtgtctctcatgaataaataaataaaatctttttaaaaaggtactgtacagccattgtctgtgtaaatgagtttacgcagcacccttttgtcacttagaatagtgtgcaatacttcttgagtgagctattttggaagaaatatcaaattctagtatttgctccttggtattaagctgaatttacagttctgtgctagacatttttcactaaagtggtcaaatccattcttgtgtgtttttcttaatgtgctcaaaactactggtgagtgcccctcagtttcctaacctgctgctacaaaatgttcttttatatccctatggctagtgccaaagctacaaaagagaaaatatatatttgtatataacactaaccctttgattgctaatgtgtgttcctactttttaaaaaaaaaattttttttaattttatttatttatgatagtcacagagagagagagaggcagagacacaggcagagggagaagcaggctccatgcaccgggagcccgacgtgggactcgatcctggagacccaggatcgcgccctgggccaaaggcaggcgccaaaccgctgcgccacccagggatccctgtgtgttcctacttaatgggactcataacagctggattttttttttttttttgctaataaaatatgtttggtgttcttgtaaaaaacagaaaccatccaaccaaccaaaactaaaattctttcctgttgctcccagcagagggcaatgcagaatcctgcctcatgctttgccctcaaagccctgcagcattttccaacaggggtttggtgtatttagcattacagtccttgggttatatgctgtctcctcctcccgcctataatttcctccagagcagagaggcattttttaaaagcccagacaagcataaggctcagcaattggcaagcacacaaatgttccctaagtgaaaaaaatctggagacaaattgctaacatcacaggttggcccaggacaacttgccctgaacctggaggagcagccatgacccaaggtttcctaaaaaagagtgtcagagaatggtcacagcttctgtctactgtctggtagttccttgagtttattaaatctgaagaaaggactctagaaacaaacttgtaggcctgggaggtccctgtagggctggggccagatgtgggcagccagcagcacttcccagattctttatcaatcaacctgaggtcaagaaatgcatattagcatgggttattttcttctagatttaatcgaaatactctccctaatttgttgaagttttagaaagttctgtaactatggaggggagaatccttgcattactaggggaaagcccatgctttctagtaaagcaaaggaagcttcttggaatgttaacagagtggaagtacaagggatttttttccctgtgtttctacattttgtagatttttaaaaatttaatttaatttttaaagattttatttatttattcttgagagacacacacagagaggcagagacacaggcagaggaagaagcaggctcacatggggagtctgatgtaggacttgatccccggactccaggatcttgccctgagccgaagacagatgctcaattgctgagccatctagggatcccctgtagatttttttttttaaaagaaggttttcggggatccctgggtggcgcagcagtttggcgcctgcctttggcccagggcgcaatcctggagacccgggatcgaatcccacatcgggctcccggtgcatggagcctgcttctccctctgcctgttgtgtctctgcctctctctctctctgtatgactatcataaataaataaaaaaatgtttaaaaaaaataaaataaaagaaggttttctagggcagcctgggtggctcagcggtttagcgccaccttcagcccagggcatgatcctggagacccaggatggagtcctatgtcaagctccctgcatggagcctgcttctccctgtttgtgtctgtgtctttctttttctgtgtctctcatgaatatataaataaaaattttttttctaaaaataaataaaggttttctttctttttttaaaaaaagattttatttatttatttgagaaaaagtgctcacaagctgcttggaggggtaaaaagagagggagaagcagactccccactgagcagcaagcttgatgcaggccttgattccaggactctggacttatgacctgagctgaaggcagactgagtcacccaagtgcccctattttgtcaatcttcatttatttattattttttaagattttgtttatttattcatgagaaacacagagagaggcagagacacaggcagagggagaggtaggctcacatggggagtctgatgtaggacttgatcccaggacttcaggatcatgacctgagccaaaggcagaggctcaacctctgaggcacccaggggccctgtcaatcttcattttttttttaagatttatttattttttaaatctttttactttattttatttttttattcctaagagagagagagagagagagagaggcagagacacaggcagagggagaagcaggctccatgcagggagcctgaggtgggattcaatcccaggtctccaggatcctgccctggactgaaggtggcattaaacctctgagccaccggggctgcccctcaatcttcataaaaagcaagtattagggatccctgggtggcgtagcagtttagcgcctgccttaggcccagggcgcggtcctggagacccagcatggattctcagatcgagtcccgcatcaggcttcctgcatggggcctgcgtctccctccctgcgtctctttctctctctgtgtgactatcataaataaataaaaaattttaaaaaattcagataattaaaataaaataaaagcaagtattcttcttctttttttttgtaattcatgagagacacacagagagaagcagagacacagggagggagaagcaggccccatgcaggaagcctgatgcgggactcgatcccaggactccaggatcacgccctgggtcgaaggcaggtgctaaaccgctgagccattcagggatccccagcaagttttattcttataatgaaatattcttataatgatttactaacaaatctgtatcatgagctcaaaaaagtctccatctgcaaatttataaaataacacaaattaaagcataaggctcctttgactatgttaaatctaatattcagagcattgggtatatttagactttgtctccgtttgggggaaaattagccctagactaaatgctgctctggtctcacctaacaaagcataaataagtcatacttaaagtgatcaaaatgtttccaagtcatttaaccacatcccagaacaaaggtcaagaatatttataggaatataattatatttcaggccccaaaagataaaatttacaatatctaacataattggtctactatctaataaaatttaatgtatatacaaagagtcagaaaaaaatgacccttaatgagaaggaaaatcagccaattgaaactgacctaaaaagtaccttgatagaatcaatagaaaagaacacacacacacacacacacacacaaaatagaaaagaacacaaaaactattactatattctgtatgtttttttatattctgtatgtttaagacactagaagaaataataatatgttaagtagagatgtagaagatataaaaagaccaacactgaacttctagaaatgaaaacaacaatgtctgatatggaaaaatctactgtatgggattaccagctgagtagacattacagaagaaaaaaatatctatgaatctgaagatataaccagaagccatccaaaatgaaacacaggaaaaaaaaaaagaaacacagagagaaagcataaagaaaataaatagagggcagccccggtggctcagcagtttagcaccgccttcagctcagggtgtgatcctgaagacctggagtcgagtcccatgacgggttccctgcatggagcctgcttctttctctgcctgtgtctctgcctctctctctccctctgtgtctctcgtgaataaataaataaaaatgtttaaaagaaaataaatagaaaaggggaaaaccaaaaccccagtgtatcagtttgctacaggatgacttcaagtggactaataacatgttagaggagttcctgaagaggaaggtaaagagatagtaaatatttgaagaagaatggccaaaatttttataaatttgatgaaaactagaacccaaaggattcctgaagctcaatgaaccgcaagcagaagaaacataaagacttacttaaaaataaaatcttagaaaaagagaactattccaaagcacattataacaaattgcttaaaaccagcaataaggaacagtcttttttttttttttttttttaagatttatttatttatttattcagagagagcgagagagaggcagagacataggcagagggaaaagcaggctccatgcagggagcccgacgagggctcaatcccccatctccaggatcacaccccgggcttcaggcggcgctaaaccgctgcgccaaaccccaccggggctgccctaaggaacaaattcttaataaaactaagcaaaaataaaaattctggtacttcttctttttttaaaaaaaatattttatttatttattcatgagaggcacacacagaaagagaggcagagacacaaacaggctccatgtagggagcctgacatgggactcgatctcgggtctctaggatcaggccctaggctgaaggcggtgctaaaccgcaaagccacccgggctgcccagttctggtacttcttaaaaacaaacaaatgaacgaacaaatcttaaaagcaatgggagataaaagacacattacatataggggaacaggaaaaagatgatagaggatttctctttagaaaaacgatgcaagccagaagagagtggaatagactctttagaatacttaaactgtttttttttttttatttattatgatagtcacagagagagagagagagagagagagagagagaatgaggcagagacacaggcagaggaagaagcaggctccatgcactgggagcccgacgtgggattcgatcccgcgtgtccagattcgcgccctgggccaaaggcaggcgccaaaccgctgcgccacccagggatcccaagaatacttaaactgttaagcctagattctacttagtgaaaatatctttcaaaaacaaagatgaggggacacctgggtggctcagtggttaagcatctggcttcagctaggggcgtgatcctagagtcccaggactgagtcctgtattgggctccctggcagaagcctgcttctctctctgcctatgtctctgcctctctctctgtgtctctcatgaataaataaaatctttaaaaagcaaaacaaaaaacaaagatgagggtgctcagtcagttaagcgtctgccttcagctcaggtcatgatgctggggtcctgggatggagccccaagtcaggctccttctttagtggagagtctgcttctccctctccctctgtccctccccttgctccctctctctctctcttgctcattctctctctttctcaaataaataaaatcttataaaaaacttggaaaacaaagatgaaatatggactttttcagatataaaaaattctgaaaaaaaaaatctgaaagaccgacacttcaagaaatgttcaaggaactccttcaggcaaaaggagaacaattccaggtggaaatatgaatctacacctaggaatgaaaagcaatagaaatgtaatatgggtaaatagcaaaaaatttttcttattattcaaatcttcttaaagataagtgattatttaaagtaaaaataatagcaatatgtttgggggcttctaacatacatggaagtaaaatgtatgacaacaatagtatgaaggctggaagggaagacgtggaagtatacggttgtaaggttcttatggaagaagtcacacaatattacttgaaggtagactatgataagttaaatatgtatactataaaccctacagcaacttctaaatcaacccaacaaagagttgtagctaacaacccaacaaaaaggataaaagtgaatcactgaaaatattcacctaatccagaagaaagcaaaaaaagggaaaagtggaacaaagaacaaattatacaaataaaaacaaatagcatgatgataggctcaaacctaattatatcaataatcacattaaatgcaaatagtggggcagccccggtggctcagcagtttagtgccgccttcagcccagggcctgatcctggagactggggattgagtccatgtcgggcatggagcctgcttctccctctgcctgtgtctctgcctctctctttctgtgtttctcatgaataaataaataaataaataaataaataaataatctataaaaaaataaatgcaaatagtctaaatcccaaataaagatgagattttcagagagaaaaaaaaaagaccaaattacataccacctacaagaaacccactttaaatttaaagatacaagtatgttaaaaatgaaagcacagagaaaagatttaccatggtaacactattctaaagaaagctgtaatggcaataataatattagacaaagtaaaactcagagcaaaaatatcaccaggcacaaagagtgatgttgaataaagaatgaatgggtccattcatcaagaacacatagcaaaggttaagatatctggctggaaactaacacacttctaaataatccaggatcaaaggagaaatcaagagtgaaatcataaaatattttgaattgaataaaaaaacaacatattaaaatttgtggaatgttgctaaagcagtagataaaaatttatagcattataaaccagtattaaagagaagaaaggtctcaggtcaataacctcagcttccacattaagaatctaataaaaaagggcaaatgagggcagcccggatggttcagcggtttagcgctgccgtcagcccagggtgtgatcctggagaccctggatcgagtcccacgccaggatccctgcagggaacctgcttctccctctgcctgtgtctctgcctgcctctctctctctctctctctctgtgtgtgtgtgtgtgtttctcatgaacaaataaaatcttcttttttaaaaaaagggcaaatgaaacccacaacaagcaaagcaaaaaaaaaaaaaaaaaaaaaaaaaatcggagtagaaatcaatgaaataaaaaacagaaaaaccatagagcaaatcaataaaactaaaagatacatgaatataaaataagcatatgaaagaattttcaacatgattggtcattagaaaaaggcaaattaaaaacacacacagtgagaattactagctattagaaagtattaaattaaaaaaactgaacatgggacacctaggtggctcagcagttgggtgtctgcttttggctaagggcatgatcccagaatctcaggttcgagtcccacattgggctccctgcatggagccatggagcctgcttctccctctgcctgtgactctgcctttctctctttctctctttctctctctctctctctcatgaatcaatcaatctttatttttttattattttttttatttatttttttttaaagatttttatttatttattcatgatagtcacagagagagagagagaggcagagacacaggcagagggagaagcaggctccatgcaccgggggcccgacgtgggattcgatcccgggtctccaggatcgcgccctgggccaaaggcaggcgccaaaccgctgcgccacccagggatccctattatttttttaaaaaacatttttaaaagattttatttatttattcatgagagagagagagagaaaggcagagacccaggagagggagaagcaggctccacgcagggagcccgatgtgggactcgatcctgggtctccaggatcaggccctgggctgaaggcggcgctaaatcgctgagctacccgggctgcccataaataaatctttaaaaaaatgaaatagttcaaacatttcagaaaattcttaaaatgttgatcacacactcagccattctgttcctaagggaagtgaaatatgttcatccaaagacttttgcattattgcttatagcaactttataatagcccccaactggaaacaactcatgtccataagcagatgaatggataaacagatcgtgagatagttatacgatggaaaattaggaataaaaaggaatgaattaggggatccctgggtggcgcagcgatttggcgcctgcctttggcccatggcgccatcctggagacccgggatcgaatcccacgtcgggctcccggtgcatggagccagcttctccctctgcctggggctctgcctctctctctctctctgggggactatctttcccaaaaaaaaaaaaaaaaaaaaaaagaatgaatttaaaaaaaaaaaggaatgaattcttggtacataaagcagcatgcatgaatcttaaagtaattatgctgagtgaaagaagccagctcccccgccttgccagagacagcacatactgtatcattccatttatgtaaaagtccagaaaataaccaatgtatcgtaatagcaagcagatcagtggttgtctgggagtgggaacttagttgggtagggccaggagcatggacttatcaatgggtacgaggaaacttttgggggtgactgatatgctcatctcaattgtggtgatggtttcatgagtgtatacataggtcaaaatatcaaattgggcacttaaaatatgtgtcatttattgtatgtcagttatgattcaataaagctgtttaaaataaaaactaacctgaaatctggaacaaaaaaaatcaattaatcaaacaaacaaaacaaaaaatgaataaataaataaataaataaataaataaataaataaataaacaaatcatcaaacaaattcaaaaaccctcctttggctcagtattaatattaagaatctccaagatacaaataaaattttttagaaagattatttatttatttatttattcttttttttttttaatttttatttatttatgatagtcacagagagagagggagagacacaggcagagggagaagcaggctccatgcaccgggagcccgatgtgggattcgatcccaggtctccaggatcatgccctgggccaaaggcaggcgccaaaccactgcgccacccagggatccctatttatttattcttgagagacacagagagagagagaggtagagacacaggcagagggaggagcaggctccatgcaggaagtccgatgtgggactcgatcccgggactccaggatcacgccctgggccgaaggcaggcgctaaatcactgagccacccaggcgtccctacatataaaatcttaaaaaaaaaaaaaaaaaaaagatttacttattctattttacagagagtgagagagaatgtgagagggaggaggggcaaagggagagggacagaaagaatcctcaagcaggctccctgctgagcatgcagcttgacaggcggctggatcccaggaccctgagatcatgacctgagccaaaatctagagctggcttcccaactgactgaaccatccagataccccttttctctattaatttttttaaagattttatttatttattcataagggagagagagagagagagagagagagagagagagagagagagagagagagagggagaagcaggctccatgcatggagcctgatgtgggactccatcccaggactccaggatcacaccctgggcagaaggcaggcggtaaaccactgagccatccagggatcccctattaattttttttttttaagattttacttatttattcctgagagacacagagagagagaggcagagacacaggcagagggagaagcaggctccacgcagggagcccgatgtaagactcgatcccagaactccgggatcacgccgtgagccaaaggcagacgctcaaccactgagccacccaggcatcccttctctattaatttttaattatacctcttttgcactattattttaatagtttccctggacataataatatgcatctttaacttattataatctaccttaaattagttctttgctactttgtgaatagtttacctccatttactatcttgtcttttgtatttttgtagtcatataacatacttttatgcatcataaactgcacatgatagttattattattgctttaaacaattacaagctatattcttttatacgtatccatatatttagtccttccaatgctcttcattccttttttatagttctgagcttccccctgcagtaattttcattcatcctaaagcacattctctctctctctcttttaagatctgatttttaagtaatctctacatgcaacagtgggtttagaactcgtgaccctgagatcaagagttgcaagctctaccaactgagccagtcaggtgccccagcctgaagaactttctctaagacttcttgtagagtgaacctgtaggtaatgaattctgtcagtttctttgtctaataaaatctttatttcatcttcattttcagaggatattttcactgggtacagaattttaggtctgcagatttttcatttctttcagaacttaaaagatgttactctttggtcttctggctccccataggttttgttaaaaagtcagcagtaggggatccctgggtggctcagctgtttagcgccaccttcagcccagggtgtgatcctggattcctgggatccagcctggcatcagggatcgcgtcgggctccctgcatggagcctgcttctccctctgcctgtgtctctgcctctctctctgtttctcatgagtaaataattaaaatctttaaaaaaataaagtcatcagtaagtgttgttattgttcttctgcaagtatgtgcctttttttctaactgcttttaagactttatctttggttttcagcaatttgactatgatatacctgtgcttggttttctttttattttgcttagggtttgataaacttcttgaatctttgagtttgctatctttcatgttttggcaaattctcagtcattatatcttcaaatattatttcccccattctcttctttcttggactccaaaaacacatacattaggtcatttgattatgtgttacatgtcttgaatgctctctcttgtttttacctcgtttttctttatgtacttcatcctgaatatcttatgttcattgtctttgagtgatatagtcctatcttgtgctgtgtccagtctgttgttaagcatgtccaacgaatgttcattttccagtcttagaatgtccatttgattctttttctgtcaattataattctcttttgaaattactcattttttcattcattttgtccatattttacaccattttcttaaatataatagttattttgaagtcttttactgctaactatgacacctgggtcatctgtgggattgtttctattgtatactctttctttcttctttctttctttctttctttctttctttctttctttctttctttctttctttcttttctttttctttcttccttccttccttccttccttccttccttccttccttccttccttccttcctccctccctccctctctctctctctctctctttcttctttctttctttctttctttctttctttctttctttctttctttctttctttcttctttctttctagtatgttctatgcccagcatagagcctaatgcagggcttgaacttataagcctgagatcaagacctgagctgagatcaatagtcagatacttaactgactgagttacttaggtatctctatacattttttcccttaattgtcagacattttccctacttcttcaaattccttgtggtttttaaaaactatatgctggaagttgtgtaaaaaagagactgaagtcaatgttatttcttcccacatacgatacatacttattaggcaaaaaagtgagagactgatcatcctaattgtatcagaaactgagctgtgttgtggctttacttagactcagcccacctctgacttcaaatgtctcaagggcaagatcttttgtatgcttattaaagtcgccttcctttagtagactttgtctcaagttcttttccaattagttcaaattgaggtttgaacaaggtccacatattccatccttaagactctgaaattatatattttccattcttctttttgtttttcaatttatttgttgaaaaaactggctcaattgccctgttgagttttttggattccactgattgactctactttgtatcatttaacatattcctctgccccctatatttcctataatctggtagttagatctgcagtattgataagattcaggtttaatatttttggcaagattatttcataggttatactgtgtacttcttttatcacatagttcttatatattcttttttcaaaaaaacccttattttaaatatatatatatatttatttatgaagggggaggggtagaaagaggggggacaagcagactccgtgctgtgtattgagcccatctcggggcgcagtcccacgacccatgagattatgacctgagccaaaaccaagagtcagaggcctagctgactgagccacccacgtggccctcaaagaaaaattttaattgaagtatagttgccagttcctacatactcttaatgcccagctcaaatgtcatctcttctcaatagttttatttgatctgtattcttttttctttttttttttatttttttaaaaatttatttatgatagtcacagagagagagagagagacacaggcagagacacaagcaggctccatgcaccgggagcctgatgtgggattcgatcccgagtctccaggatcgcgcccccggccaaaggcaggcgccaaaccgctgcgccacccagggatccctgatctgtattctttttaacccctcctgtcatctctatttccatactactttacctctcatcatcttttcatttaggagttcatgacactccctcccacaatgactgtttgtagtttgggagctccttgaggcagaaatcatactttattcattcttttatcctcacgccatggtgtttcatctatttgggtagttataacaaagtaccacaaactgccagcttataaacaacataaatttttcttctagttctggaggctgggaggtccaagatcagagtgctggcagatttggtgtctggtgagaacccacttcctgattcatagatggccctcttcttgttgtggaagggagatggtggtggaaagtaagagggaatctctctgaggcctctatttatttatttatttatttatttatttatttatttatttatttttaatttttctttaaagaattatttatttatgatagacatagagagagagagagagaggcagagacacaggaggagggagaagcaggctccatgcaaggagcccaatgtgggactcgatcccaggactccaggatcgcgccctgggccaaaggcaggcgctaaaccgctgcgccacccagggatcccgggctttgtgatatttaactagacacagctatctagtttcttttgactggtttcttttccagatttacctttcttcttttttttaaggttttatttttaatttttttttttagattttatttattcatgatagagagagagagagagaggcagagacacaggcagagggagaagcaggctccatgcagggagcctgatgtgggactccatcccggctctctgggatcacgccctgggctgaaggccgcgctaaattgttgagccacccgggctaccccagacttacctttctgtaggtctagtgattccagttagtttttcacatttaaaaatcacacctcatgcttaaaaaaaattgaatcccatttgtgttggggctccctgctcagcaggcagtctgcttaaaaaaagggtgagggcgcacctgagtggcccctttagtgtcaaccttcagttcaggtcatgatcttgggttcctgggattgagttccatgtcaggctccctcctcaataggtagtctgtttaaaaaaataaaaatcataccccactccatatttttttttcttttttttttttaatttttatttatttatgatagtcacagagagagagagagagaggcagagacacaggcagagggagaagcaggctccatgcaccgggagcccgatcccactccatatttaatgtaactgttttgaggtatttttttttcagtaatggagaaaaatttgtgctaaggcacactttcagatccagtctgcactagcttttcagtctttagcatttttctctagtctctcactgaagataaaagctgcaatgatgaccaggctaggaaaagcaagctaagaaaacaaaccatagtaatttataaggtttgaaatgtcttagaatttcaggtgatttgcattttggaaaaagactcaacctttgaattgttgagtttacattttctttaatgctgcactatttataatcaattaaccatttttatcttactactttgggaaaggctggatgttaaagatggtaatccaagcacctagttaggtctttctgaggtcatgcaccaaaaccaagatttggctatgttgcagttgcagcagaaagagagtctaactctaccacttgctgcccaagtgccagaagccattgatttcatgtttaaagaccttcctctgatggaaatgtgacaatacaaggcagctggtgtgagagttcagcagcccacagaaactaggctctccatgtattttctagtctcctgttttgtgtgaaatattttcttggtcttgacaaatttctggcctgtcactgccttgacaattcattctgagtttgacccagtttctggttaagtccttggtgccatagcaattaccattaggcttcatcacgctgtgttcctgagtgcctagcttttgtatttacccatggtcaccacccttggtcccccatttggctctgccctcctagtagtcattggagcttggtttagtttaactcctactcattcttcaggtgccaggtcataggtcattgccataaggaggacttccttgacacccaggataggttcagaccttcctgatgtatgccctcagattttcctgtattttaccttcaaggtacttatcacaatttataattttgtcatctattctgttcattttgtatcttcagcacctgggacagtacctggcgtatggtaatagttcaataatgtattgagcaaacatgaacagatgaagcttgtgatgtgggttcccacctcttttagggtacggttatgggtttttttaaaagattgtatttattcatccatgagagacacagagagagacaggcagagacacaggcagagggagaagcaggtttcctgaaggagcctaatgaaggactcaatcccggatcccagtatcacaacctgtgccacccaggtgtccctagggtacagttgtttatgaccttgagctagttacaaaacttatctgaattgcagtgtatgcatttaaagtagggctaatattgttctatctaccccccagtttgaggtgtacatggagcagatgcttagtagatgtatgtagaatgagtgattgcacatgtcatctctgtgataggagacacctatattttaacaagaatttcaccaacatatgagagaaatttagtacccaaacaagaggaatcgtatttatttatttatttatttatttatttatttatttatttatttatttttaggaatcttgtttattgagtggaaaataaaattcaggattacatgtatctttgcccaggggctcatatttctcttttgcttacagcttaatactagaatttttaaataggaaagtgggattttttttctatggatttggaccaaactagtaatgacggatttttccagtttctaagaggttatgtctgtcacagacattaagtttggtccactaagaataaagattctagactgcttgcgtgttaaaaacttgtaagaaagcagcagtggtgaatgtgaatatgaataccaaagagagctgtatagagctaacattctcatcaattggtacagctgactggtcttctgaaacagtggtagggtaagatcctgaccttggagtgatggcaaaagtgttttcagcctaacaattccttttactacaagcctcataggctggtctagcttaacctactttttttccctatttctaccatcagcacagtgaagataccttgcatataaaatacaaatgctatctgggttttccttttcttgctcatctcttcttcaccatgtccacccacttctggaatttctcccacccaacatttccttaggaatacagaatacagagaagggaaaagatgcaggaggggtccaaatataacaagagttatatattttatttgaacctcatctctttggagaaagggaaacagagatgagaggagtaagttagagatggttggacaatatcctcagaagtatggggagtgcaaagaagaaaatctttcactagaatatctgctgaaggtgaaataaggtaagcctaggtagggaattcagagataattcttagtatttagcgttgtgatctgggagtaagatcccagtgctgaacccagcaggtagaggagtcccaaaacaaggattgctagtatgtaactagtctaggtcttctgaccaagtgaagccattgggaagggaaggaggatttgccaagggaatcttactccttattcccagttcatttcctaagtgttattgcccttgggtgaatatgaattcagaccctgatgcctcctctccaatgactgtgtcctaggccgagcctgacttggggagcccggaggcatagactgatacagaggccagtactgctgccgaggaaaagtctgagcccttggtctgggcatggactcagactcaggctccatctccaatctaggccctagctctggttcaggctctagctctagctctgactcaggctccatctcatgatccaggtctagctctagatctagcccagtttcttgttctgactccagtgtgggctccagctccaggtctagctccaagtcctcctctgttattggtctctgcatcatggtgtaatctggatttatgtttttggagacttctagaagaccgctgctcattttatgttttgactcttcattctaaaatacacacaattagatgggttaaaatttccaattaaatttaacttttgaacagtcaaggactctcagaatacaataggacttaagatataagaaatcatatgttcctggtaaagttgaaactatttctggcttatatctgcttttcatctttgtaccctcctgttccttgtttactcactattcctcaggctctatcaatccataacttgtgatttctttggcttttctagctagcctggattttatggtcaatcattaaaactgcagtggtcttggcagcatcctgaaacaacctgtcttcttgatcttacttgtcttcccaacccccagtgtaattttggtaggacacagaaagccctttgtgacctagcctgttgccatcttctttagctttatccacatctgtagtccccaccctttgctccagccttaaagttaaccaaagatgtcagactttgcttacctttgctcatgctgctccctgtccctggcttgtccttctccatcttgtccatatacacttattcatattccaaattcagatcaaagatgaccaaccaggatcatagcttcctttgtgttccaactatacctcactcacacctctatcatagtgccaacaatatattacctcatttatttacacacttatttcccctattagtcttaagctccttgaggtagtgcctgcctttagatatccccagtaccagacattgagtatgtcacatagcagatgcaccacatagcagatgccccccatagcaagccccacagtaaagcttggtgaatcagctttacagcagcattccacagaattcacaactttcacctctcctgaaacaagtttttctcttccaccatacgacattcttttgctttccctccttcctttctggttgcttctttctggtctatttgttgtctcctctacttcttttggacttctaaatgttggcaagacccaggcctcaattctgggaacttctcttctgcacctatactccttccataggcaattttatttagtctcataattttcatcatcatctatgtgccagtgatttttttggctataatccttccccttatctgctcgcacatatacccattttcattctgacatctccacttggatgtttaacaggcatcttgaatttaatacatccaaagtagaactttttcctctcttcagtcccctagcttaaatgccagaaaagttttttgacatattcaatatccagtcttaatataagtcctaataagaatgttagtaaaccatgggatccctgggtggcgcagcggtttggcgcctgcctttggcccagggcgtgatcctggagacccaggatcgaatcccacatcaggctcccggtgcatggagcctgcttctccctctgcctgtgtctctgcctctctctctctctgtgactatcataaataaataaaaattaaaaaaaaaaaaaaaaaagaatgttagtaaaccagaaaagtactttttaaaaacagagtaaatataatgtctatcttaacccaactgttaaccattatccttaatagagatacacaagaagtttttctcatgaaattcgggagtaagacaagacagcgcacaataactgaaattgttctgggagatctagctaatgccataatatatgatactgaaataagaattttgacaactggaaaataaggtatttatattatttctagaaaatagttttctagttagaaaacacaagagaattaacaatgaaacctcttagatctaataaaaggactcacaaagttggccaaataatacacatcaataggtttcctatgggctagcaattgccaggtagaaaatataatgaaaaagaatgttcatcttaaaaagcaataaaagtataaaacaaagtatgaagtatttaggatttgtctatataaataaaaccacaaaaccttactatgaatgcaacatttaaacagactaaataaatgtaaagacagcccatgttcccatataggaagaacaaatattgtaaggatatcgattgtcaaattattttatatttttaatgcagctctaatgagaattccaatgggattcttttttgggggaggtggggtcctgacaaaagatttaaaagtttggaagaggatgatccctgggtggctcagcagtttagtgcctgccttcagcccaaggcctgatcctggagtcccaggattgagtcccatatcgggctccctgcatggagcctgcctctccctctgcctgtgtctctgcctctctctctctgtctctcatgaataaataaataaaatcttaaaaaaaaaataaatgagttagctcagaatggttagctgtacagatgaaaaataaagattactctttaacaccatatactgaaatacattctaactaaagagtataatatataaacacttaaaaacataaaaatctagaagaaaatataaatgattaatttacttcctgagaatgacattctaaacaaaaggcaaatggaaaataagaaaaggctaatataggaaagacaatgtaatatgtaaagcaaatctgccaagtatatcatcattataaataaaatagagaaaattccacttatagtaaaggcagactacataattcagacctcctactgagtacagccacaagagctgggtaaaatattttaagacttctgcttgaacacactataaagctaacaagatcatgaagatctaccaggccaagatttggaaaaggtgaaaatctatagaggtgagtctggcatttgggaccacttttgtgaaggtatttgatgatcttgaagtgacacatatatgcagaacagtgcttttgacagcttttagaccttaagggttgccaaaattgcattccagggcctgccaagggggagcctgtggcatgccttcccacagactgtggctggactgtgggtcatctggatggcctagaacacctcaagtcataaaatcaggtcagttatttttggattcctagtgcctctaggtacttgacaaaacaataaatttttttccagaagaaaaatatcatcctgggcttcaaattatttttataaacattttctaaatacaatgtctggcacacacccaaagattaccaggcatgttagactttgatagtgaaagatggacattgaatctctaagatagtagttctcaaagtgtgggttctacagcagtagtatcagcattactcagtacttgctagccatgcaaattctcaggccctacaccaaccctactgaatcagaaattcaggagatatggggcacagaggggcccagtagtctgttttaaaagcatattttggtgattctgatgcgtactaaagtttgagaacgacaggaaatcaccaagcataagcaggaggacctctggtcagaaatgttgttaagagaattattgctctaggtagggatgaacctgagaaactgaggattcatccaactgaaaggttttgtgtttctatgatcttacagagaggagtggagtatagagcaaaatagaaagaatatgtccattcaggaaaaagttctggataaaaagaggcacataacctgtgagaattctcagtaaaccagggaaatccattactttaaaaagaaaaagaaagtgggggtgcctggctgacacactctgtggaggatgtgactcttgatattaaggttgtgagtttaaatcccacattggcatagagtttacttaaaagaacaagaaagaaaaaggccatgttttacaagcttggatagcttttactttttaaagttcagaaagacttattactctggtaatacttctcttgtcatagaaaattcaaacattattaaaatgaattaagtcaaagtgtcaggggtttaatagaaacattttctagtcattagataatatttggtgtccatctgtattttaatttcctttgctttgtgataaaacaaggggatatctttaacctttatagacactgattttttttttaaagattttatttattcatgatagagagagagagaagcaggctccatgctatgctgggaacccaacacgggactcaatcctgggactccaggattgtgccctgggccaaaggcaggcgctaaaccaccgagtcacccagggatcccctagacactgatttaaaaacattgaaatagggcagcccaggtggctcagtggtttggtgccaccttcagcccagggcgtgatcctggagacccagaatcaagtcccacatcaggctccctgcacggatggagcctgcttctccctctgcctgtgtctctgcctctctctctgtctctgtgtctctcatgaataaataaataaaatcttaaaaaaaaaagacactgaagtaggcccaaagtctttatttagtgttaataaatggttgaaagttctggctttggtcaggttgagtaaatcttatattactcccgatggagataagagacagagtgttagattggcaagtctttacctctgctagttcatcagttctattattcatcccaagggtggtgtagggatggattctaaaggtatagctaggggagatatttaaaatattcagtaattgggatggcactggcgccaaccaagcttgctgtaaaaggatccttgagacctctgctgggttgggtaacactctcttcagttgggaaagggtcctgaatggggtccagataccatgacagtatggggaacatgggactcagttctactgctatttaccctctgctaagggagcactccaacatcccaaagtctggcacagacatactcaaaaaccttttctggacattctcatctctagttaatcagatatctccccctgctcaccccccaccatgatgcttcacatcatccaaccttgtctgtttctgagaaggtttcctgtatcactgtctcagattcgtccatgcttaactcggatgactctggaaacttccttgacaaggcaaacagcacagcgtcgtggagggtgaggaacagctgggccttggtgatgccagcgtcaaagaaatcattcctctcaaatgccctgaccacagaagctacaaaccaaacccagaacatacacagggtcagacaactggggagagcacacagggtgcaaacagcactctcatagggtaaaggatactcacaatgacaccctgaaatgagtaccaaaatgttggcattttggaaagcattgcacatctgtgaggagagagtaaaccagtattagtgatcttcacactcactaggaaagatccttctaattatctaagttttaatacccctttggtcatttacttgtctggagtatatgtacctctgtattccaatttagctctataaacttttgatgagtggatttccatatgccaggaaatatctcaagtgctgggaatacaaaaaagaatcagatgttctcatggagggtggggagtgatatggagtgttgcccatggtctcaggtgggaaacagttcatgtaaagagataatgctcctgaagatagcactcagagagagacaggtacagatgtgatgggaacacactgggtagccctcaagaacagccatatcatggtattattgcttagtgtatgcatatgacctccttctctctggagttcactgaacagaggaggaaaaacaaaacaaaacagaacatggcccagagaaggtcaaatgacatagtagaggatggaatccaggaatcctgagactcatttgagtctctgctctgcaaaatttcagaactgctctgcaaaattgcatttgactttagtgaaacatcaggtatttattagtatcaggttactaaatatcagatactgatttcaagtttacttcagccaatatatgtgctctagagcaataactcttaaagttcgtattaaccttaatactcttgtattgattggactccaaccctgagcactgttaaaatatcaaaagacacacaaaaacagactctacttctttctctaccaagaagaaacaagaaaaccattcttgatcatacagtaaatcataaagtcatttcataaagagacactgtggacatactctaaatgacaaacaacatgattgacattctatgaattagggagaagcttaaattgagtgattgtctctcataagaatgactgctggtgggcatctggggggctcagtcagttaagtatccgactcttgatttcagctcaggtcatgatctcagtttcgatcttgtgccctgcattgggctccaagctcagcagggagtctgcttgagattctttctctccctctgcctctgcttctccctcttgctctctctctttcaaataaataaatacatcttttttttttttaaagaatgacttctgggatttttcttggcaaatttaaattttcaatgatgaagtaaacaaaaaataatgatttcctcctataaggcagtaaagaatgattatagaaggaacgaagaaacctgtatctttaaggtgagaaagtataccatgaatttccaaaggctgacaagtaaagtgtctacattgccttcatgttggggctggagctgaaagtcatcaatgtaggccaggtgtagatcggttatgccaaggactagaacatacggtgcctccgcaaaaaaggcagggaagagggaagagagaggagaggacaggatggcactagtgtacttcagagcagagagaagagtggtataaagccgaacgctttgagttcccatgctggacaggccacttattagctgtgagcctagaactcttcagatgaaatatggcttgcctctcaggatattgggagaattaaatgagagagtgtatatgaatgtgtccaacacggtctggcatgtagcaggcatttgataatgtaagtttaatgaaatctaaagtggtaactagtgtacaagagtgggagaagagaacacagcccagcagtgcaaactgatggaaaagcccccaaattaagacataatcaagtataatggaatctcaaaatgggatagagaaaaaagatgtcgtaggttgaagagcctttaacattaacctctttcaaacctcttaatttttagatgaggaaatgaagacccagtacaatttacaaaaccatcttgggtcagatggatggccaacagtagcaaagccaggacagtgcacacatccacagactgccaagcagagttctttctgctatgagaagtttcctgttgcctcagaccaaacaggagctggactcacttaaaagagaatcatatttctttaggagtaaggtttgataagataggatcagaggataaaagaaggaaaatcaagcaaaagagtagatctcaaaaaaaaaaaaaaaaaaaaaaaaaagatggatgcatccagatctggggagtgagtgttcaggttatttaaacctgagccagggatccctgggtggcgcagcggtttagtgcctgcctttggcccagggcgcgatcctggagacccaggatcgaatcctacgtccggctcccggtacatggagcctgcttctccctctgcctgtgtctctgcctctctctctctctctctctgtgactatcataaataaaaaaaataaaaaataaaataaaataaacctgagccatcatcaacaggaacaagagtgagacagagagctgtaaagggaataagctggctgaaaagtggatattgtagttacaaggcattaacaataaagccaatatggttagttgtgcctctaaactgtctgtccacactgtgtaagaatgagaggaattaaaactgagaaaccagagagtaggagagaagccaggccttagggacacagctatgaaaggaacagttgtccctgccctttttatccaaagatgcaggcagtgaggagggatctggggagatcctacagggcctggactaggaagccccaggcttgcagtgtcatcttaccacatgtcctcacctctcagtgcattttgcaatgtctacctcagagcagctgcatagtggaggtttcttggcatgtttttttctgtagtattcagacctgttccttgaaaagatctgcagcgaactcctaggatatactgggagttgctgggtgtgtggcacagattgctgcctccatggtattaaaatgtcccgctttcgagtttctgagaaataatctgccatgcttagagaactaaccccagttcaataaatcagggtggtttgtttccttttcactctggttgaccttaaactgtctttagtagccaaatttctggtggccccagagtcacacagcagctgattagtggctgacaggactcaatcaggatcggggcaggcgggggcacaggtaggagggcatcagagcccttgtgaaagcctcctcggtacttacttgtcttaacgacaccgaagcccgtgaatccacaaaatgtaccatggagaaatccaggataatggtgtggatgctgggtagagagctgtctgagtggggaaggaatgatctcctcctctcctggttttcagcagtgccaggcagtggcatcgagttgtttctagaggggttattagaaagccaagctttgtccatgtcctcgtagttttgaccgtgatttctgtgaggcattgaagatatggtgtatggtccttggtcatcggaaatggactggctcatgttcatgctctcaaaacgtgagcagcggatcaggttaatggaggaagagtcatggtcccgtctactttcaaatctgtccgtgtagacaatctgggacaaaaaagtaaggggaggaccatgaggaggctcagaggagggctacaggtacttgcaactatgccatttctgtctacggattcatctccctcccttgcaggaaagctcccatggactagtgcttggatgttgcttggataactcactgtccctttgaggtcatgactgaagccacattcactagcatcttcattccaacttccctccatgtaccagtgatgttttcattgtcctgtgagccagacttaaaatcacctttgacttattctttcccctcatccctgggttctaatttgtctccagcacctcctaatatggtgtttgaagtgtttcttccaccagtccctttctcaacccctccatccttcatcagacttctttaagaagacagaaattactggagcaaggcagtttttaccttttgcttctttcatcctaatagacctagggtgcctgccatagcataaggacagcacccagtgccaggaatacaatggcatgcaagatgtgaatgctcagggatgcctgggtggctcagcagttaagcgcatctgccttcggctcagggcatgatcctggagtcccagaatctccctagtttgatttaaaattccatgaattggtgcccctgactggctcagttgatggagcatgtgactcttgatctcagggttatgagttcaagccccatgttgggtgtagagataacttaaaaataaaatctttaaaataaaataaaattctatgaattgcttcaaaataattctgtgattttgaggggctatacacgggtaggcatagagatgaaacaaaattgaccatgagttataaaaaaaaaattgatcatgagttgataaatcttgaagtagatggtgggtatatagagactcaatatacttgtctctacttttgcttatcttcaaaatttccacgaaaaaaacatttttgaaaaagaacaacctggaagaaccttgaggacattatgctaagcgaagtaagccagttaaaaaagataaatagtataggattctacttaatgagggatctggaataggcaaattcatagagacagaagggagaatggtagtagccagggtcagggatgaaaaggaaatggggagctgttgtttagtggggacagagctccagttttgcaagatgaagaaaatctgcagagtgatggttgcacaaaaatgtgaatatatttaactactgaactgtacacttaaaaacagttgagatgttaaattttatgttatatgttttttaccacaataaaaaagagagaaaaaaagaaaaggaaaaagaactacctgaggacagagatcattaaaattcgttttcctttttcagttctgggtgcagagtagaagctcagtggggcagcctgggtggctcagtggtttagtgccaccttcaacccagggcctgatcctggaggccccgggatcaagtcccatgtcagggtcccagcatggagtctgcttctccctctgtctgtctcactctctttctctctctctctctctctctctctctctctgtctctcatgaataaataaataaaatctctaaaaaaaatactaggtgatcctattctactctaaagtgtttttgctgatgtcctgtaaacaccttctatgatgctcagtgcagtgtggatacaaaacaaaagttagagtgttaattctgtcctcttggcagggaagttggtgttcttagggagttcagtagaatgtatgctccattaggatatatgggagtgagagtgggtgcttggtgtttgcaagtgcctgcatgagaagggggacaggaggattttgtgttgggggaataaatgtgtgtgtgtgtgtatgtgtgtgtaaatagaagtgctcctccagggtataggtatagactgagtgaaagtctccaatgctagaaatgagctgtgtggaaaagaaataactattttttttaaactttattttattttattttatttatgatagtcatacagagagagagagagagaggcagagacataggcagagggagaagcaggctccatgcaccgggagcctgacgtgggattcgatcctgggtctccaggatcgcgccctgggccaaaggcaggcgccaaactgctgtgccacccagggatcccgaaaagaaataactattagatgaagggaattaatttagatcaaatccaattagaaaataatgaacactttgtaattcatcctaaaatacccttcaaatggtataaaatttacatctatgcttatctaccctccactcccatcatcatttctttggtcacaggcagacattaggagaccctggcacatccttaagaaccccagccaccttgactctgctgtcctggttggaattagaagcaatctttttttggcgggggtggggtggggtggggtggtggtggggggtgtgaggagcagagagagagggagagaatcccaagcaggctccacacccagcttagagcttgacacagggctcgatcccacaatgctgagatcatgacctgagctggaatcaagagtgggatgcttaactaactgaaccaaaagtactgaactgaaccaaccaagtactcctagaaaataatctttaagtcacttattttcagaaatctaaagccaggcatgtaaaagtcagggaaataggtataactaggctattactgtcgatctcaatagggaaagtgtactctttgtgctaggatgagtcattggccatggagtagggactcaaacatctcctcctacctacttagaagggggtcaagatctaaatctcgggtagaaatttttgactttcaattactcagagcccacttaaagagtcaaagtccctaagggagttttgattttctttcttcacttcttctttttaaatgactagtgtacttccttataaaatgtggagaaagttatgcagaatgaaaaagacatctctaaccctgggtggtggctctagctcgtcacagttgcagaaacactgacaaattctttcttcctgtgagccttcttcactttgattaaataggcggaacatttcttcttctttaagaggcacccttaccatttcgacctgagaaatataagagaggtctcacacagatggtgagtgggaagagagaggggcacctgggcggggggcagggcagcatggaggggagcaggtggagagaggcagggaaggaagccattacctctttcaacagcttgtgctttaggtgatcaacattgacaaatgtgatggagttgcagcactggaagattttcagcccaggaaggtttgtaacctgcaagacaaaatgtaaagggaagggcaatttctcagctcttttatggagtgagaaaaaaaaaaatctctagaatcccaggagaatctgtattccttcttataaaaggccagaattagcaagttctttgctctcattttcaccccctgcttttcctgctttcttcttccccctctatttgttcttttctttttcttagcctccctccccctaaaggatatgatccttaactggctactgtactctacggatcaacctacttaagtcacccacctctgccttcctgcctcattttccctggttttgcagatgtgtatctatagtgcagccaaacaatagcaaagggattttatagaaaaactaagcagcgagcctgggcctgctcatcctctgagcaaaggaatggacttatttggaatcttacctcccgatagtcattgaagcttctataaatgttagtgttagggatctgacccaggaggagaatcttagttctgaaaggaaaggtatttgcttttaggtcatagttgccttatctcaccgtggccaacctcctattacctgagacaaagtacctgtgtgaccgaacagtgatgatgaagaaggcaaaagctattgaaacaagtagtccaacatccagtcccaggaaaatggcagatgtgaatgtcaccaaccaaatgatcttatggaaaaagaggaagaaaggcagggggagaccatgacaacaagcagaattgagaaaatcaccagttctatctctcagctcaccttccccctccccgtccctctcaatgcctagaatttacaaattctatgcccatatggactgacaccatcataaataattgggttccaagtctgtctagcaattcttgtaggcatccttggtcatttctctcttcaattctctcttgaaacctcaagtgcaaaataaggatgacaatatctactttataggctctgttaagattaaaaatactcatcctaaagcgacccagaacactcacccaatgaagggtagttgctattttgaggcctagcatgcttatggtgaacctttagcaacctttccaggcccttaccccattaccttctccctcagtctcagcaggtgacctgactcatcttcacagagcagataggctgaaactcgcttaaatattcacttaccccttcacctgctacttgttagtatccgcattaactttccccccttcaatctgatcctgttggaaatgctacccctcctactgggactagaagtggcactggtgtactgtaccacatcttctcttagctccttagggacctggatccgaaaactatcccctttcatgtctctttgcctctactgggtccatctcctctcattatattatgttcctcatctttttgctctttcccctctatgtccccagttatatactctggagggaaagggtgctccactggttattctgcctggcaagatactgccttcttttagtacgatttgtgcctcctatcctggaatatgttcacactaactggaataaaagtcactcaactatgtcatgtatgacaaaccctttttagtagatttgcatctaactctagccacctaactcctttttatttaattttttcattcctctgggatgaggtctcagtatctccatgcaccaacaaccttgactacctttttcttttcttttcttttttttttaaaagagtactagttatcaaagaattgctagtgatctttaccctgatctcttttgtttgttctcattccttctttccaactttcctttctgtcttcccctatctcagcaagggcatctatacttacacaatcatattggttctgcctccacagactgggtaggttgtaaatgatttcaaggtacggtaggatgttgctcagaataataccagccagcacagcctatgggataaaggtaaaccctacttcattttcccttcggggataaaactcccaaatcttcacaaaggaatcacacacacacacacacacacacacacacacacacacgtcagccatgccactcagaaatgtaaaaatcatcaggacctcaaagcaaaatctaacctacttgaagaaacactttcttgttttcatgaagtccctgcactagcttaacatttcttagccttttcctagccatctctcttctgtatgctctgactgggaattagaactgatcctattaccagggatggttgggtccaagcttactctggttttctgaggttactcagtgaccagtggactcagtaggttagcagagaagggaagggcaaagatgaagtcagcagaaatcacttctttcccatcttcatcttcttctcagtcaagaatctctaagtgttctgcaatttgcagggagatgtggtgggaaggaaaaaaaactcaatctcatagagattttgcaagatctttggcttgaacagggaatatgaagaggaaacaaatcttttcataaaacaatatgtaataaaaattttacctttctgaacattaaggtaaaatatgcccatgtataaagaaagaagtaaacttatatatagggggatccctgggtggctcagcggtttagcgcctgcctttggcccagggcgccatccgtggactccaggattgagtcccatgtcgggctcccggcatggagcctgcttctcccttctcctgtgtctctacctctctctctctctctctctctctatgtctatcataaataaatctttaaaaaaatttttaacttatatatcatttctatcatccaagagataactattgttaacattttggttcctgctatatatatattttttttatttttattttttattttatttatgataggcacacagtgagagagagagaggcagagacacaggcagagggagaagcaggctccatgcaccgggagcccgatgtgggattcgatcccgggtctccaggatcgcgccctgggccaaaggcaggcgccaaaccgctgcgccacccagggatccccttgcctatatatttttttcatacaaaattgaaacaatagtgaaggtactattgtgtatcatgtttcgttttgttttgtttttaaatgtgttcgtgccctttctaaccagttgagatcctagccaggatgctccactgatttctccaataagaattttatcacaagctatccataatctctcaaggaaggaaaggatcattcatagtttaatattcatagagtcccattattatagcaattcagatattccattgatcagatggtgttcacatcttctcacccagaaacatcctaactagatgctataaaaataatgtgacataatatggtgagccaaaagcaagggttgttctgtccccaacatatttataataaaggagtgtaaaaaatatatatatatatatatatatataaaataaaggagtgcccttagtgaattctgacagatttttgtttgcaattttaaaaaattctgattcttctaaagaaaaaatatcactgttcgaagtaaactagtgagtggccctcctaaaatagacactaagaattatagcaccaaaggtgctaaataagctaaattctggagatgacttctgctgggaatcagaggacagcttgtgtgatacatacaagcttaatcccaccttctatgcatagattctggggcagagttccaagagctctgaatcacaagagctgaaggcagcaggagccttgaggtggtcctgctcttctgaaacctgatattcaccaggtgggagaggtgttcaaaaggatggggataacattggcaaacactccagcttcagggattgccacctcagtgtgtaaccaagctgttccaccagtcatgagacctcctcccacctcccttcgtactatctaaaaatggctaacaggaacattaaagaaatttaaaaggaaattatagccactgagctttgatctgtattgtaacaaagaacaaattgattacagccgataatcaacatacctggcatctctaaatgcaaggcgatcagcctctcacaaagggaaggaatggcacataagtctatagaggtgtcccagctgaacagagttaaaactcaacttttagagcctgctttctaatgtaaactgatcacagagaggcagtaataggggattgagttcatatgaatgcagaacaaggccttctggaaacatcttaggaaaacagatggcatgaatacagaatgagtttccaagcctgagtcggtgaggggcgttctggcatctgaagtctattttggtcatctttaactgaatccctacttataaaacttactttatagcttatgcaataaaaagaagattaatgagaatgagaatagtaactataatacctaatattttttgagcactgatgattagtgcaacactattctctctatactataaacgttaccttatttaactcccaatcctgtgaagtagatgctattattttatttatttattttttagatgctattattttaaaggaaaggaatgggaggacagggtgaccactggggacaaggtgaatgccccaccaggatgcaatctggagatcggatctttcttcactcagttatttattaattctacttacatttggcagttcattgaaaaagcgtcccaccttcaccatgaggagcagcatcacacctgcgcctaccagagatgcaaactgaggagacagagccagttggagagagaccatcaggaacgtattggtccctgtctgcaactgaggcctctgcttggtgagaagcatgttatttttgtcttaaaaggagttgcatgtaaccatccagcctaagtgcatttttgttgaactgacattttcaggtattgtcaaagtgctaaacatacactaggtactcaagaaatgctggttgaatgaatgcatgaaggttttccgaaaagtgcaaaattgtcttgggtatttgaatctttattgccctcgctttgcgctgtgaatctggagtctcctaaggtcaggcttgcattccttcccaacttttaactcctcctggaacactctagaaaaacctcagtagactcaacactgtcagcctccaaatccaaactgtcccacttcccctatcagtaaatacctcacccctcactttcttgttggagcttggatagcttccttaaagcgtcagtagcgtttcaccttaaaaatgcaatgataatcatttctgatgttcctacttcagtttttctctgcttcattgccataaaaaaaaatctacgaatgtgagtcggagctgcagaatgcaattctgggtcctattctagctgggtggatgactgggctcaggggtgcttggtaaagagtggttctgattggcaactacagatggcaagctgcgtgacatagttccctgtaaagtctcaaggctctctgggtatagtcttgaatttactatgtcctctatggataaatttccatcatttaagccccttagaacatatactgatacaacacagtataatgtcccattgcgttgagggataaatgtgggggagaataaaacaaaccacatattggaacgatggcatatataagcaagaactatgggagtccctcaaactaaagcattaatgatttagcaacgattctctgatttttctcttcatttcttaggcatgaaaaaaagaaacaaaaaacttcctactggattccctcttgcagctcactgctgtctgcatacaaatgaatcactgagagtgatagcaaggaaagcaatttcctacttccttccttctcatcctggctgctttgtaaatgacaccgtgtgatggtagtgttgaaaggatttgggaaaacggaccactacaatggaaactcaggaagttctaaggacaaacattttataccctgtagaactgaaacaggtaattgagaccataagctcctccagccaatgtacacatcagcctgtggctggatctagtgtgtctccctttggatggtctttgttggcactatagaaaaactactttaattagcataggaaaatacatcaggacttttcccttctaccacttcttttttgttgttatttgttttgtttttgtctggtttagttttttgtttttttttggtgtccctcgctaggcttgacctacctaacacctcttttctccaagttcttctgattgaaggaaacaaagatatgcaaatactaaaaaaagaaaaaaaaaagctgcataaaacctagatttaaatgaatacaaatcagacactgaatcccataaaatttgctcccgagagagggttgggaggcctgccaattaactatgtcttccttggctgtgcacgcaaaggagtgggctttgggatcagagggccatcctggtggcattgggcctttaggaggatgcttgatggctctcagaatctcatactcagtgtctgaacaagatctaaagacagcaagcatgtagaactttacatctcatgtatattttgctattctgctctcattttccatcattttcccaggttttctttttttctttttttttttttttctttttcccaggttttcttgaccaaaactgaccctgccttctccttgggaattcaaggtactgtgaattcccacaagccacagccacgattgacacgcagaccctcagacaccaattactccatacagagtaggttctatgaagtcaaaaagcagattgccaagcactggccaggaccctagagacctggggtagaagctatgatttttgaacctcttaagtgacaggcactgtgataggcattattatcacctaatttaattctcataactgaaaagatatctttatccccattgtatagatgaggactagagcctcaaaaaccaaagtaacttgcccaaggccacacatctaggaaccactgagtcaggtttcaatctacctgactgactggctggttccaagatttaggctttctccaactgccccatttgcttcctctaaaaagataggcacacttctttcttttataatctctttcttttataataatctttaaagcagtttaagaacctggggacatggcaagaaggccagtcctcggaaaaaagggaacaaaagaaacaatcatgcagaacagggaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggttctagacaagcaaacagatacatatacacagtttgtataaatgccagattaaaaaagtaaaggagtctttggtggcaagtcaggtctgagaggtacagagccagctcctagcttctctttcctatagtcctgaggaacttcagagaactgagagtgttctcaggcagagtgattcaaaagtctccaaagagaagggatagagagagtaccccactgctgtgggatgaagaaggccaagtgagtctcagaggcctttggttgtccagatcagaaactcagagtggaggctggtgagctctagtgcctgcctccagggccaggggccagcagcattctctgctccgatcagcgatttatcagggtttcagggaagggttgaccagcatccctaggagaacaccccgcccctccgtgaagtgtcatcgccccccagggagagtcattggttaggggaatctgctaccccaggagaacaatgtaggagcagaaaatagaatgagagccacaggctgtctttgaagcgggcactttgacaggctaaacacaactcaggctgacctaaagcccttcttccttcctgccatctatacatatcctaaccttctttcaatgatccacagaagtccacttcctccatccttctcctttttgtagtatttatggcacttgaaattgtttttttttttttattttttatttatttatgatagtcatacagagagagagagagagaggcagagacacaggcagagggagaagcaggctccatgcaccgggagcccgacgtgggattcgatcccgggtctccaggatcgcgccctgggccaaaggcaggcgccaaaccgctgcgccacccagggatcccggcacttgaaattgtaagacttattctgcacttaatgttacttgccctgtgattagtttttttccaactgtgttcaccatttcttcctaaatttatgttacacttacctactgaataaacaaagcatgttgttaaaagttagtggggactagtgtctgggatggccatttccccttctttttttaaatttttgaaaacaggggcatccctgggtggctcagcagtttagtgcctgccttcagcccagggcgtgatcctgcagtcctgggattgagtcccacatcgggctccctgtgtggagcctgcttctccctctgcctgtgtctctgccatctctctctctctctctctctctgtctctaatgaataaataaaatcttaaacaaaaaaaataaataaaatctttaaaaataaataaataaatttttgaaaaaagatttaattattttatttgagagagagagaaaacattagcaggggggaggggcagaaggagaaggagaagcacgctccttgctgagcagggaccctgatggagggctccatcctaggaccctgagatcatgactgacccaaaagcagatgcctaaccaactgagccacccaggtgccctgtccatttctacttcttatcatgaaatcctcttgttttgacttcaacatttgtgtacatgtacagagaacatctttctttttaacatagcccatcttctttctttctgtcaaatggtggtggaaaagaggactgctacaccttacaggccagcgtgtctggctgaagctctatgacaaaacggtccacgtgaagtgacatgacagggttttactctagacccacgcttttatcccttctgacttttattggctttcaccttacattttacctccatttacccaaagacggagacaatttctcttctgccattaaagtgtagtgactattcgtctgacacttcaatttctaccacgtatctgtggcctaggctcgttgttgacttccatcaatgtttctttgccctctgaatcctgacccatcctctgggctcactccagttttgattctgacagatctctgacatttcatcatgctgcgtagctgagctggggcacctcccatgtggtagagctggaatttatatccagtcagttcagaacctgtggacactggacttagaaaaatctcatgcttgcaattagacagacagttggccttcagagccttctctgtcatcatcctccaattctctctcccctctgacccacacatttagtttattaattcagcatatctgaagagaatctgacctagataatttgcttacattcacaggaagaatggtcataaattccctaggttcatctagacaaaaggacttactctccatcatgaaagcctcttgccatgccccttgaggcagctaggaaatttcctagttctgcagcaaggatggagacagttgtattatgactttcccagacaagaactgggtatatatccttccacagaaaacaatgttaagaggtgatggttagtttacctgaaatattatttgcaggatgttacacagaaatgtttttttataggctaatacatagacacttttcatgtagaataatatttctatagaaaatgactttcaagtcctacgttgacaaatggcttttaagacaaaagtctaagcaaaaatttaggcaagtgtgaaatccaagttcttccaagagatcttccctaacaaacataacattaaagcagcaacatggggtgcctgggtggctcagtcagtgaagtgtctgcctttggctcaggtcatgatctcaggatcctggaattgagccctcgcctccacccccacccttggttgggctccttgctcagcagggaattgacttctccctctccctttgcccctcccctctgctcatgctctctctcattctctctctcaaataaataaatcttaaaaaaaaaaaataaagcagcaactggatcaaattaataaaatactcttctgtgaagggtattatatatttattcatagagacagagagagcgagagaggcagagacacaggcagagggagaaacaggctccatgcagggagcccgacacaggactcgatcccgaatctccaggatcacgccctggactgaaggtgacgctaaactgctgagccaccagggctgcccttgtgtagggtattatagatagaaggttatgaatagatatgtttttatattagagagaaaattctattctaacatacctgttgtcttcctccagacttatcttggataatagtcctgacaatagcaccagtaaacacacaagatctgaaaaatgagctgacgacattgcaaaggccgatggctattaaatcctgtaaagaagtggtgaacacatttggcacactggttgttcaagagtgcaggtttgagttggaactcaaggtatactgtctatttctttatgtatgatgataaaattgtttccatcacttcagaccacactgaaatattcttagaaagaacaaaaggagagtaaatctgattcctcgattaacttgaatcttcattttagctagccatcataagaaaagtactttttcaaagtaaggaatgaactttttgatgaggcaacagaggattagctgaggacaaagcacattgacaagtccctgaaacagggaaagggatttcctctatggaaccaacagcctcaatgttcgtactttgctaagggcaaaaggcaaccttagcctgacccccaggatcctgtaagcctactttaacatataaaaattcctttagaaatttcctttatctctaaaccctcaggatacatgttggcaaccatcccccaagcacatggcccactcatacacatctgaagggtctcatgactcagaatttattagacagtaataagtgaccttttcccaacaacagctggccccctcaaggtcctggaaatcttgcttccaaaatcccttagacacttaccctatccctaaccacctcccaactcccacgtatataattagccactcgtcacaggcctggggcagcagctcttcctgtccaccagtcctttcccctgctttttaatatatatattttaagattttatttatttattcatgagagacacagagagagagacagagacagagacccaggcagagggagaagcaggctccatgcagggagctcgacctgggactctatcccaggtctccaggatcacaccctgggctgaaggtggcgctaaactactgagccacccgggatgccccctgtctccctgctttaataaaaccatcattttgcaccaaagatctctcaacaattctttcttggtcgtcggctctggacctcacctgtattccaaaacttcatcactttttgtcgtattattccctttcacatgattacagaacttagaacagcagagggaaacagtactattttttctccctcccttctatactatctcaaaatcaaagtgggacacctctggcttccgtactctctttggagtactaggaaaagggccttacttagaatagtggggagattaaacaaacaaagtaggactgtttctgggagagcaatgtaattatgttagtagcctgatttttactttctctaacatttcttattgcgcctcagtatgtggttgactcctgaggacttggaaagaaagataaaattaagaggagaagagttctgctagcttaacgacacgataccatatgttatcgtcttgcttccctacatcatagctgttttgggggaataacactcatgttaatttaagtgacttcaaagttaagcatgccacactcctcaaaaatcctttggcaattataattcagattatggtcccactgactctctgattacaaagaatgcagtcttcatgttaggaggctcagatcagggaacaaacccttaagggtcagaggaaataataggaaggcctgtcatctcacctggttggaattcacatggtagttatggtaactggcaatcttcttgcccaaaaatatgagcagagaggagctcactagagctaaggagaaggcttctaaaataagttcaggaagaatgttcaaatctggcgtcacaggaaacaggaagctggaataaaatggtggaatcattcctagatagcagaacagctggttggcccctcccccactccagccttatcatgtggggtgggcggccctatcctttttcaaaaataacaataagagataagaagggcaactgaggcagcagcctgccaaaactgcaagcaaacccaaccaggttacaaaagctattgtgagaatatttctgctattttccaggtcaatttttgccatgtagcaatagcaacaaacaggacaggcaagccatagagattgatagaaaatggctcatttacgctgtcagagactgtaccagtggataaacaatgggcagatagcatgtctgagatggtttagagctaaaaagctcaatgaactccattcttgtcacactcaaatccttcagggtataattttagtcgctgtcctttgtacaaattacttccaattctacccataccttccctcctgtagcttctcaccccccaatttctttgtactgtggtaaatatgcataacatggaatctatcatcttaattatttttaagtgtgccattcagtgatggtaagtacattcataaatgtgcaaccatctctatcatccacgcccatcaatctttcactctttaaaactgaaactctattaatccaattaaccaataactctctgtctcccctttccctgaccttggcaacaaccattctcctttctgtctccatgatttggtactctaggcatataagtggaatcatacactgtttttttgtgactgtcttagtccacttagcataatgtccttgaggacatccattcatggacacttatggtttcttccacatattagctattgtgaataatgctgctatgagcattatgagcatgggtgcataaatatctactcaagaccctgctttcaaattaagagggcatatatccagaaatagaattgtaattctatttttaattttttgaggaaacaccatactgctttccatagtggctgtaccatttcacatttatactaatagcgtacaaagaaatctattgcctcatcaacactgattattttctgtcttttgtaaatatgtatatatatatatacatacgtatatatatgtgtatatatatatgcatatgtagccatcaaaatgggtatgaggtggtatctcattatagttttgatttgcatttctcatatgattcatgatattgaacatcttatcatgtgcttataggccatttgtatatctttgggaaaatgtctattcatgtcctatccccatgttttgagacaggttgtttgcttttttgttgttgggttttagtatatgtgctgccgaagtgagcacattgttgttgggttttagaagttctctatatactttggatattaatctgttatcagacatatgatttacaaatattttctcgtattctgtggcttgtgtttttactctatcagtagtgtctttgatgcatacaagtttttaatttttatgaaatccaattcatattttgaatttttgtctgtttttcttttgtctatttttttcttttatttcctgtgcttttgatgtcatatctaagaaatcattgccaaatccaatgttatttagcttttgctctatgttttcttctaaaagttttatagttttaggttttacatttgggtttttgatagatatatatttttaaagattttatttatttattcatgagagacacagagaaagaggcagagacacaggcagagggagaagcaggctccatgcagggagcccgacatgggacagggtcacacacccttggctaacggtggcgctaaactgctgagccacccgggctgcccggtctttgatatattttgaattgatttttgcatacaggatcaggtaggaatcccacttaatttttttgtgtgtggatatccagttttcccagcatcatttgaaggattgtcatttccccattgaatggtcttggcagacttgccatttgagtatatatacaagggttcatttctgggctctccattccattccattgatctatatgtctgtctttatgttggtaccacactgttttgatcaccatagctttgtagtaagttttgaaattaggaaatgtgcatcctccagcttgttcttctttttcaggatttcgttggctattcaaggttgcttgaaagtctgtgtgaattttaggatgggtttaatttatttctgtgaagaacatcactgggattctgataaggattgaattgagtcagtattctgcttttggtattattgataccttaacaatattaagtcttccatatgtgaatatggggtatatttccatttatttatgtcctctttaattcctttcatcagtgttttatagttgtcattgtacaaaatttttatctacttggttaattcctaagtattttcattatttgatgctattgtaaatggaactgttttcatatttttttttctcagattgttcactatctgtgtatggaatagctactgactttagtgttttgactttgtatcctcctactttatggaatttgtaattctttttttttttttttagattttttttaaaatttttatttattcatgatagtcacacagagagagagagagagagagagagagagagagagagaggcagagacacaggcagagggagaagcaggctccatgcactgggagcccgatgtgggattcgatcccgggtctccaggatcgcgccctgggccaaaggcaggcgctaaaccgctgcgccacccagggatccctggaatttgtaattctaattatagttctaatagttttttttgtggggaatcttaggagtttctacatataaaatcatattgtctgcaaacagataattttacttccgcctttctattttggatgtcttatttctttttcatgattaattgctctggctagaattgctgctcctatattgaattgttgtggcaataatgggcatccttgccttagtcctgatcttggaggaaaagctttcagtcttttaccattgaatatgatgtttgctgtggatttttcatatggcttttgttatgttgtatcagtttccttctattcctagtttgttgcatgcttttattttgaaagagtgttggaattttgctaaatggacataattatgtcttttaattctttcattctgttaatgttgtgtattatattgatctagttttgtgtgttgaaccatcttgcattctagaaataaatttcacttgttcatggtgtataatccttttaatatgctgctaagtttggtttgctagctattttttgaggattttagtaatcactgttaatcaatgttcataagttttcttttcttgtagtgtctttgtctggctttggtatctgggtaatgctggccttatagaatgagttgggaggcgtttcctactcttcaatattttggaaaattttgaaaaggattggtattagttctttagatgcctgtagaattcacctaattcacctatgaagccatcatgtttaaggcttttctttgtgaggatattttttattactatttaagaaagatttatttgagagaaaatgagaggggagagatagagagagagagagagagagagaacaagcagggggaagggcagagagagagagaagcagactccctgatgagcagggagcccaaatgtgggactctatcccaggaccctaggaccatgacctgagccaaaggcagacacttaaccaattaagccaccaaggcacctgatatttttgattactgattcaatctccttactagttataggtctatttggattttgtttcttcatgattttgtcttggtagactttgtatttctagaaattttccatttcatctatgttatcatatttgttggcccatagttgttcatagtactctgttatagtactctttatttctgtaggattggtagtgatatcctcattttaatttctaatatgtctccctttttgtcttagtacatctagctaaatatttgtcagttttgttgatctttttaatgaaccaacttttggtttcactgatttcctctattgtttttctattctctatttcatatatctttgctctaatctttatttcctccctctgctagctgtgagtttagtttgttctcctgtttctacttccttaagttgtaaagttaggttgtagatttgaggtcttccttgttgttattttttaattttttaaaaaaagattttatttattcatgagagacacacacacatacacagaggcagagacacaggcagacggagaagcaggctccatgcagggagcccaatgtgggactcgatcccgggtctccaggatcaggccctgggctgaaggcggcgctaaactgctgagccacttgggctgcctgttgttgttgttgtttttttaatataagtgtttttggctataaatttcccctttggcactgctttttctgtgtaccatatgttgtggtatattgtgtttttgtttcattctaatttttcctgtaacttctttgatccatttgttgtttaagagtgtgttaatttccagaaacttgtgaatttttattttacttttattattgatctgacttcatctcattgtggtgagagaagatactttgcatgatatctatattttataatcttttgagacttaattcgtcacctaacatgtggtctatcctagaaaatgtgcccttgagaagaatgtgtatgttattgttgttgagtagagtgttctgtatatgtgtgttagatctagttggtcttatcataatggttaagtcctctgtctcctttcttatcttctgcctggttgttctatccattacaaaagtgtgatattaaagtcatcagccattctggtagaactttctatttctatctttgattctgtccttttttgcttcatttatttttatggtttgtcattagatgtgtaaatgctcataattgttttaacttcttggtgtattggaccttttataacatacaatgtccttctttgtctcttgtaaactttttaaatttaaaattgattttgtctaatattggtatattggaataaccagtcctgctttcttttggttactatttgcatggaatatcttttcccattctttcacttttaacctacttgtgtctttgtttttttttttaacttttttattttatttaaattcaattaattaacatgtagtatatatagtgcatatagagatagagttcagtgattcatccattgcatataacacccagtgctccttacatcacataccctccttaatgcccatcacccagttactccatctccccacccatctcccctctagccaccctcagtttgtttcctttttttatttgttttttattggtgttcaatttaccaacatacagaataacccccagtgcccgtcacccattcactcccaccacccgccctcctccccttctaccacccctagttcgtttcccagagttagcagtctttacgttctgtctccctttctgatatttcccacacatttcttctcccttcccttatattccctttcactattatttatattccccaaatgaatgagaacatataatgcttgtccttctccgactgacttacttcactcagcctacttgtgtctttggatctaaagtgtgtctcttacagacaacatatagttggatcatgtgttttatccaatttgccaatctctgtattttgattggatagcttaatctatttacatttaacgtaattaccaatcagaggaacttacttttattattttgctctttgtgttctataagccttatagttttatattaccttcatttcccattacaatctccttttgtgtttagttgatttttttaatagtgaaatgtttaaattcctttctaatttccttttgtatatattctatagttattttctttgtggttaccatgggtattgcatttaatatcctagagttataacactagtttgaatttatactagcttaacttcaataagatacaaaatctctgctcctttacagctctatccccactccttttggttgttgatatcacaaaattatatccttaatacactgtgtacctcaaaacaaaatctagtaatttttttaaaaaaagattttatttatttatttgagagagagagagagagagcaagagagagactaaaagcaagaggagaagagggagagggaaagacatactcccaaccaaacagagagctcaatcccaggaccctaggatcatgacctgagctgaaggcagacacttaatcaactgaaccactcaggtgcccccaaactagtaatttaaaaaaatgcattggtctcttaaattatgtaaaaaataaaatatggaattaaaaaccattgttaacaatactagctttttaaacttaccagtattgggcagcccgggtggctcagtggtttagcactgccttcagcccaggccatgatcctggagactcgggattgagtcccatgttgtgctccctgcatggatcctgcttctccctctacctgtgtttctgcctctctctctctctctctgtgtctatcatgaataaataaataaaaatctttaaaaagaataaatttaccagtatttacctttattgaggtatttatttcttcatacagctttaagctactctctcatgtccttttatttcatgctgcaaaactcccttgagcatgtcttgcagggcatatccagtggtaataagctccctcaagttttgtttatctgggaatgctttaatttctccttcacttttgaaggaaaattttgctggatataggatgcttggttgacagtgttttttcttttagcactttgttttttttgtttgttttttaaatattttgttttatttatttatttattcatgagagacacagagagaaagagaggcagagacacaggcagagtgagaagcaggctccacgcagggagcccgacatgggactcgatccccggtctccaagatcaggccctgggctgaaggcggcgctaaactgctgagccacctgggctgccctgtttttaagattttatttatttattcatgagaaacagaaacagaggcagagacataggcatagggagaagcaggctccccagggggagcctgatatggggcttgatcctgggaccccaggatcatgctctgagctggaggaagacgcttaactgctgagtcacccaggagcccctcttttagcactttgaatatgttggtctattgcattctggcctcaaagtttctgatgagaaatctgtttgttactttatcaataagcccttgtgtatgatgagtcacctctgttttggctttcaagattctctttgtttttgaaatttggttatgtatctaggtatgggtctctttgagtttctctcacaaggaatttgttggacttagacatttacatacatgtctttcatcagatttgggaacttttcagccattttttctcacatttgttcccatccttttctttttctcttcttctgagactcacatgaaatttatgttgctctgtttgatggcgtcccataggtccttaagactctgttcacgtttctctaatcttttttcctcccgttcctcagactcagtaatttccatgatcttatcttcaagttcactgtttctttcttctgagtgctcaaatctggttttgaattcctctagtaaatttttctttcagttattgtacttcttagctccataacttctttttagtttctttttcagttttctatctctgtttcagtatttccattttggtcatacatcgttttcttgattttttccacattttcctttaggtctttaagtattttaaatacaagtgttttaaagtcttggtctagtaggttggccatcaggtcttttttcagggcaattgttgctgctgctgtttcttttttcttttgaatgagccatacttcctgttcctttatatgccttcagatttttgttgaatgttgtgtatttgaatctaataatgtggtaactctggaaatcagattcttctcattcccagggtttgctttttttttggtaattgttttattgttgttgttttttaaggtttattttattttatttttttaagattttatttatttattcatagacacacacagagagagaggcagagacacaggcagagggagaagcaggttccatgcagggagcccgatgtgggactcgatcccgggtctccagaatcataccccaggctgcaggcggtgccaaaccactgcgccaccagggctgccctattgttgttgttattgtaggttgtttttgtgccaaggataagcctgatgtataaacttaagtttttctcagggcttttctgagcctatgcctttctctgcatgtgtgtggttactttctaattttcctatatatgcaattattttttaatgtcctgatctttagtgtatgacttccaaagtggggggggggggagagaaacaaagaagaaaaaaaagaggtgctagacctgtaaatcccttggaattcacttttgccagagggggagggacttgcaactatgggagtgaggtgcaacgacaatggctgtttacttttttgtctgcatccctgtgatcagaagcagcaatcagcaatgagagcaaagatccccaaaatttggaggacagggtcttctttgcccatgtttgctcccgcgagcagtgtgcaagttgctccaggaaatatctgcacagttgcctgccataaggctgggtttggggatggtagctgcattgtgctacaagttgaaatttactgaaattaattacaattatcatctatgccttcccctggaagttaccggcctgattcaataggctacagagttacaaaatagttatatcagacacattctgcaggtgcaatttttgtctaggtagggagagagattcctcatgcttcctattccaccatctcctcaaatcctctctaacctcctgttgttatgaggtcaccagaatgttgagacttgtccatctttctggtagtcatggccatctaattctattaagtcaatacatacaatttctactaagatcacaccatataaaacactgccaatctcataaccatgactagaacttcttcccaggtatatctcccaccatattgttaactaagaaactctcattaagacaatatactttcttttttgtcagtattattatcagattggtgctcagagaattaaagattatcctgattcttgtaggaatggatgtttgtttgtgtatgggtttaggaatttcactctgttgtccagagtacagaagtcagcttcttgtatggtcagttttaggctgacttcttaggagtcagagactatgtttttggttcccttcatatggacgcatcattgaataccactcataaatatttggcaatttatttttaaaatgggaaatttccaaatacttacaaaagaagaaaggatggtatagagttcttaggtacccatcattcactttcaacacttaatttataatcaatcttatttcatttgtactcctacccactgtctatttcaagattattttgaagtgaatacaaggcattatgtatttttaattgtaagcatttagtgtacccatccaaaagatatacaccaaaagattattaccagtttatcaatattatcaaatatacaattaatgttcaaaatttcccaaatgtctcataaacatatgttttacagtttgttcaaattagaatccaaataaggcctatatgttacaattggttgctaggtcttttaaatctctttcaagttgtaggttcttgttccatattcttatttttctaccctgcaacaaaagctgttgttattgtttttaaagattgtatttatttattcatgagaaacacagagagagaggcagagaaacgggcagagggagaaacaggctccattcagggagccccacgcgggacttgatctggggtctccaggatcgccctgggtggaagtcagcactaaatcactgagccacccgggctgcccaggataggttttttgggcaaaaatagttcacaggtggtggtgtatacttctgtcaggaggtacacaatgtctaattgtctttttaaaaaactataatgactctcattttagagagtgcctgggtggctcagttggttaagcatctgccttctgctcaggtcatgatctcagggttgggattgagccctatgttgggctctgcactttgtgcagtctacttagggttctttccctctgtctctacccctacttgtgcttgtgctctctctctagaataaataaacaaatctaaaataaaagattgttctatttctgtgaaaaatactattgggattttgatagaattgcattgaatctgtagattgccctgagtagtatgaacactttaacaatattaatattaattcttccaatccatgagaatggaatatttttccatttgtgtcttttttaaatttttcatcaatgtcttatagttttcagggtacatatcttttacctccttggttaaatttatgcaatttttttcgtgcaattgtaaatgggattgttttcttaatttctttttctaatagtttgttattatgtctttttgtgatgttaacagatgatacactaatatcccttaatggtgatgtcctaattctagaattccttctcccttaaacggctataatacttttataaagtgaaatgtcttgttattaactatttggataccctaaagagcagtttttataggaaaggcatgataggggatccctgggtggcgcagtggtttagcgcctgcctttggcccagggcgcgatcctggagacccgggatcgaaccccacgtcgggctcccggtgcgtggggcctgcttcaccctctgcctgtgtctctgcctctctctctctctcactgtgtgtctatcatagataaataataaaaaaaaaaatttaaaaaaaggaaaggcatgataaatactttgttctttttatttaacaatgttcaaaataacacgttggttctatagcatcttagaggggtgaaaaaatgaatttgctcttttagaaggtttacattcacagatttaaacatattttatgtgtttggccaaaaaaagtctcaaagtgatatatagattcaatgcaatccctatcaaaatatcaatgaccctttttgcagaaattgaaaagctgatcctaaaatttaaatggaattgcaaaggacccctaatagccaaaaccaatcctgaaaaagatgaataaagttggagggcacagggttctccatttcaaaacttagtacaaagctatagtaattaagactggtatatagggccgcccggggggcttggtggtttagcgccgccttccgcccagggcctgatcctggagacccgggatcgagtctcgcgtcgggctccctgcctggagcctgcttctccctctgcctgtgtctctgtttctgtttctgtgtttctcataaataaataaaatcttaaaaaaaaaaaagactggtatacagatcaatacaatagaattgagagtccagaaataaattcaaacatttatggtcaattgatttcagacaagagtgccaagaccattcaattggtatcgaacagtctcatcaccaaacagtatggagacaactgggtattcacatgcaaaaagatgaaatcagagccttatcttacaacatatacagcaatgaactcaaaatgaattgaaggcctaaaatgtaagacctgaaactataacattcttaaaagaaaacataggggtaaatctttatgacattgaattaggcaatagtttcttaaatgtaataccaaaagctcaaataataaaggaaaaaataaattggatttcattgaaataaaaaatctttgtgctttcaaggatctgttgagaaagtaaaaagataacttataaggcagcccgggtggctcagcggtttagcaccgcctttggcccagggcatgatcctggagacccaggatcgagtcccacgtttggctccctgtgtggagcctgtttcttcttctgcctgtgtctctgcctctctctctgtgtctctcatggataaataaataaaatcttttttttttttaaagataacttatagcataggagaaaattatatctgagaaggtctagtatccagaattcctacaagtcaacaacaaaaggacaaataacccaactaaaagtagtcttgggacttaaatatttatttctctaaaaagatatacaaatgaccaggaagcactctcattttagaagtgcctgggtcaagatgctcaacatccttcgccctcaaatgcaaatcaaagccagagtgatatatcacttcatactcactaagagggtaataacaacaataataacaaaaaataacaaatgttggtgagtgtatgaagaagttggaactttgtgtgttactggtgggaatgcaaaatggtgcagctgctgtagaaaatttctggcagctccttaataagttcaacatagaattaccatatgactcagcaaatctactcctaagtataaacaccaaaggaatgataacaggtactcaaaagaaaaccttgcacatgaatgttcatagtagcactatgaccaaaagttggaaataactgaaatgtctttcaactgatgaatggattaacaaaaggtggtatatccatataatggaatattattcagccataaacaggaatgatccatggtataatatggatgaatcttgaaaacattatgctaagtgaaagaaactggagtcaaaagaccacacattttatgattctattgcagaatatgcacatctctagagttagaaagtagaacatgtgactcctgatcttggggctatgagttcaagtctcatgtgtggtgtaaagtttacttaaactaaaacattagggcgcctgggtggctcagttagtcaagcatctgctttcatcttgggtcgtgatcccagggtcctgggatcgagtcctgcattggggtccctgctctgtggggagcctgcttctccctctctctctgcctgctattccttctgcttgcgctctgattttgtgtctgtcaaaaaaataaataaaatctttaaaaaaaaaaagtacgttaagtggtagccaagggctgtggaaggggacaaatgggataacgcttcttttttgagggtgataaaatattttaaaattaaatagcaatgatggctgtacaactttgagaatatactaaaagtgagtgaaatgtacactttttttaaaaaaaaatattttatttatttattcatgagagacacagagacagaggcagagacacaggcagagagagaagcaggctccatgcagggagcccaatgtgggactccatcctaggactcgatcttgggacttcagggtcatgcactgggcggaaggcaggagcttaactgctaagctacccaggcgtccctgaagtgtacactttaaaatggtgaattttatggtataggaattatatattaataaagctgttagtaaaacaagatagtaagagaatattataaataacattttgccaatatacttgacaacttagattaaatgggaaaattctttgaatcaccaaactaacagagtactctcaagaagatagataacgtgacttatagagagtgtttatagagtgagggctattaaaaattgaatttgtagttaagaaccttcccctaatgggatgcctgggtggctcagtggttaagcatctgcctttggctcagggcatgatcttcgagtctccagatcgtgccccacgtcgggctccctgcatggagcctgcttctccctttgcctgtgtctctgcctctctctctctcctctctgtgtattctcatgaataaataaataaaatctttaaaaaaaataactaacttccaaaattttgtgaaaatccaaattcggtaaaatgaacaatgtattaaatatcacttggaaggatttattttttttttaaagattttatttatttattcatgagacacacacacacacacacacagaaagagaggcagagacacaggcagagggagaagcaggctccatgcagggaaccccatgtgggactggattcctggagacccgggaataccctgggctgaaggcggcgctaaaccgctgagccacccaggtgccctggaagaattttttaaaaataaatgttgtgatgtgtttatttttgatcccttatctaattaaatgttattagtttatgcattttcaattttattttctttagaataggaactatcccttttagcaccacaaagtactatctcctcctgtcttcctatttctcatcattattatgcagaaatctaaattcctatttttgaatatcttttctttcaccatctaactatgtctgttttagttctctatttatagtatacttaaacttacaagcaatctttgtgttttccaggtagtgagctgcatagaaatataactgaatacttaaaggcagatattaagccttttgttaaatttcccttttatgtattttcaagaagttagagaagaatgtggctatcgcaaagaggttacaatcaatggaatttactgcccaaatctacattagtaaaccttaagtatttaatatggtaacataaaccactgtttttcctttctgctgttctttaacatttaattctttgttagcagttttggttacaaggagacatggatacagaaagaactaacttaaattgttctatttttctaatctttagcaaccttgaataaacacataacaaaacaggtagttcaaaccaatacctaaaattagatttttgaaatgtttacctatctaaaccctgaatcttatgataaaacataagcaaaagttgactgtatggtttttcattcatcaataacagaatcatattgagtaaatataatatagtgattataattatagattttggaattaaatagaaataggttcaaaaggagctctgcccctaaccaactgtgtgatcatgggcaagtaatttaaatttggtaaacctcagtttcttcagccttaagaaggagtgaggtgcaaatgaaataaaataattatcaccgatctcattgttgttattttttcctgagagcaaagagtcagtcttatttaccactgcattccctggttcctaggtggtctgcttacatttttttttttaattgaacagaattttaaatgatttagtcatcattagatttcatggaaaacttgtaggacatgagactaatctgatctgctatcatcaaagtagcctatgttgtattatctgggaggtggccagtatcactgactctgcagtatgaacagtataaggaaatgaatgatgctcttcaaaagccttcctgtgagtcaagaaactgcaatatattgcctttcttatctaaagtgattcatctgatcaaggttataggaactcaaatttcctaacagaagcaagagtgacccaaagtcactggttaggaattataatgtaaattgtaaattaattgatagaatttaagagctccacatgccagactgtttgaagatagctttctactcagagtgatgaaataatgtttcttgaggacactgattcagtctaactgggtgaagacagaggaacactcatttcctgagcactgagctctaggagagaggccaggaaaacagaggcatctcttgttccacccttgggagttagtcagataggtatggaagttgagaagacccatgatgtaccatgaaaaaactgtgtgaatctctccggtacccagtttatttgtgtgagaggactgactcaactatgggaagagattaagaggctgaccaatgaagaaacaaagggttgtcctagcctctcttcttttgggaacctctatattctaaaatgaatttaagcccacttcccaaatttgtctgtggccagactgctggtacagaatagcagtcaggctatgtggtcagaggctaagtgagggtaacagaatgggaagagtaatcctgaaaagtggttactgacctataaggaatcatatcaatgagcatcttgctggtttccgttgccatggttatcttgtttgcaaaagcagcgaagccaagaatctgtaggggttaaaaaaaaaaggtatatgatcatctaaaaattatagattgcttccaggagcagaggcgcttatagccttagcaagacagggattgaaatatgtggcagtccctatgcatgaaagttggagagagaggcagggcctattcagtggagcaagaaagcagaaatcccctctgactcttgattccctaagctctttttatttgtttaattttttttaagatttagtttgagagagggaacatgatggggagggacagagggagagggagagagagcatctcaagcagactccccctccccgccccaagtgcagagcccagctgaggactcaatctcagggagacttttacctgagcaaaaccaaaagttggaagcttgatggactgagccacccaggtgtccccactgagctctttttagcattgtagccagaatgaaaagcaacttcattctcagcctctgacataacaatgggaacaaatggatatcctccccaacttgaaacatctggaccaaatataaagatgttttcaggttatggctacataaaagcctcagttgtaaaagtttttagatctaggtatactgtactaatataaataagcctttggggattgttgagatatactgagaatcctattactgactaaccctcaatagtaaatatggagcagcattcgatagcacaaagaaaaagtcctcagcaaagcaatgacttgcttttttatctaccttttatttactcctaaaataacaagtctcctttccatttcaactagtgggaaaatagacaacctagccaattgttacaccttatagagacctgacaccaagcaaattaagctagagacaaaagaactggatgcccaggtattaaaataattattatgtagctgctttaccccattctccctactaacatataaatcttttcccagtctccgctgagagttcagatactgagcaggatagcaattggtttacctaggatgctgtgatctgatgaagacagctgggaaccttacaggccagaaaaatctggatcatagcttgagtcagagaaaagtttggttctttttatagttaaaggacaagaagtatggaaactagccaaggaaccctttttatttccaatatgaaggtaatgcttgctcacaaaggaacatagtgaaaatatgaaaaattaaaaagcagaaggaaatcaccaaaagacaattattttgatgcttgtttggtgtttgatatacaacttaaataaacacatacacaaatacacattcatatacatatatataaattatgaatatataatatgtataatttcttagagctataggattctttttttttttttaatttttatttatttatgatagtcacagagagagagagagagaggggcagagacacaggcagagggagaagcaggctccatgcaccgggagcctgacgtgggattcgatcccgggtctctaggatcgcgccctgggccaaaggcaggcgccaaacccctgcaccacccagggatccctcttttttgtttttaaaaatatttaggggatccctgggtggctcagtggtttagcccctgccttcggcccggggtgtgatcctggggtcccgggatcgagtcctacatcggactccccgtatggaacctgcttctccttctgcctctctctttctctctctgtctctcatgaataaataaataagtaaatcttaaaaaaataaaaataaaaatacttaatttatttattcatgagagacacagagagaaaggcagcataggcagagggagaagcaggttccccacggggagtccaatgtaggactcgatcccacgaccctgggatcaggacctgtgccaacagcagactctcaaccactgagccacccaggtgccccagagctataggattcttgaattatttgcctgtatattctatctggatcccagatattgccttgaaacttccccttactatttgacactagagtgttaaggacagattggtgggtgtgtgtagtttcctgcagcatgtgtacacagtactgtcttggtgagtgctgtgagaagctttttacaccctagggcatagcagctctcatcctccctctcccatttccctcactgccaggggaaacatgcaagtcttttcccagttctaaacatctctaatccttgttacatggcggacagtgatcccaatcacttgacttgacatgtatttaagtaatgtattgcaggctttgataacctttgagtataaattaggggacaaaaaagtttaattcctaaactgcaataattcaaagtctccactgacttttgttgctggatctgggtttcctcctccactttgctccacggtacaccctatttatagcactccccaaaggaatgtcttttttttttttttttaaagattttatttatttattcatgagaggcagagagagagacagagagacagagagatacaggcagagggagaagcaggctccatgcaggaatcctgacatgggacttgatcctgggtctccagaatcaggccctgggctgaagggggcgcttaactgctgagccaccagggctgccccccaaaggaatgtcttaactgtagctcacaaaccaatctgtgaaccatagtcaaccacagcatcctctatacttttacttctcacctttcctaataaccctggttaatgttcattgcctttgagtttgcttaaaggaatatccctatgattcctgttgctgtctcttaagagagggctgatttgccacaacgtggctggattttgagggcaatatgctaagtgaaaaaagccagagaaagacaaatactgtatggtattactggcatgtggaatctaaaagcaaaaacaaatacaaaacagtcaaacttagggcaacagagagtagaaaagtggttgccaggagctggaagttgaaggaaacagggaaggttgatcaaaatgtacaaacattcacatttaagatgaataagttctgaggatctaatgctactcatggtgactatagctgataccattgcattgtataattgaaatttgctaagagtaaaacttaaatgttctctcatactcgtacatacacaaaagataaatatgtgaggtgatggaagtgttaattacctcgatgagtgaattctttttcgatgtatttgcatatgaaatcatcatgatgtataccttttatgtcaattacacctcaataaagctgaaattagagagagagagagagagagagagagagagagaatatctgtgtcaccgatgccatctgctggtgactccaaagcttcagcttcccaagatgtcagagctgagctgggttccatgaaaaggagaggttagccctgactccactccccaaactccatctgtacctggtcccctgggttctagggcaccattacttatgtacagtgatttgggaagtctttgataaaattagtctttcagtttctgccctttatgaattaatagcttttcaactactccaaggaaaaaagaatatccatctccataagaagtagacaacagttataagacagagcttggtctcaacttccaaagcaattcgtatactcttttaatcgtgcaaagtatagacctatattatttagtatagaataggttatactgtggcaacatacaaataatgagaccttagtgttattttttttgcccacacagagtctattgtgggtcagtgtctctttgaggcaacttctttgcaaatagtgcctcagggatccaggctaattccacgtggggacccagttatttcaccatacagtcctatgattaccacagcagggagagaaagaacgtggagactcacatgctttctcctatgctttggccccaaagtcacatggttctgcctaactacagggaagctgggaaatacagggcaacacatggacatttggtgaagttgaagcatctctgcaacaacagaacactttttttttttttttgcctccaaccctaacagaacacttcttaaggggaaattaattctcatggacatccaagcattcagtgatcctatataaaaaatgctgactttaggacaatctgggtggctcagcggtttagcaccgcctttggcccagggcctgatcctggagacctgggatcagtcccatgtcaggctccctgcatggagcctgcttctccctctgcctgtgtctctgcctctctcgctctctttctgtgtctctcatgaataagtaaataaaatatttttaaaaaaataaaaataaaaacctgagctttatttatgagaatgtctttgtcactgtaaaaatgttaattttaactccaaaagataagttttattggtagattttttttttttaaagaaagaagaaatgttgttagatagtggtgagcccagctctgccacttacaaatgacatagattaggcaatccatttaacatctcatctccttcaatttctctactgcagcatagtgagaatgaaaggaggctgaataacagtatgattacaacactattaaaatagaaacagggacaccagactggcttgtttggtagagcatgcgactcgatcttgtgagttcaagctccacattaggggtagagattacttaaaaaataaaatcttaaaaaaaaaaaggtaggatcaacgttctatacagaagaagatggaaattcaccaacactgagcataggcctgccaaatatatttgaaggaagaaaacagtaatagctgaaaatccaaaattatcaattgtaattgatattacaggtgcagaaatttcttttcttccattttttccttatgtttttcaaagttgttagaatgagaggcacctgggtggctcagctggttaagcatatgcctttagctcaggtcatgatcccagagtcctgggatcaagccccacagcggctccctgctcactgggaagtttgcttctccctctctctctgcgcctgcccattctctctttctttctctctctctctctctctctcaaaaaaaaaaaaaaaaaaagctagaatgagcctggattactttcataagggggagcgggacttatttctgaaatagtatgaaagaggaaatagagaaaaactttaagaataagcatgttttacaaacataagctattatttaaaaattaaatgtattccaaaaaaaattaaatgtattccactttgtcacaatttaacatacatttaaaaattattatttttatagtctcctctaatccttttccttcctaggttgcttgctttcttgtttttatttttatttttaaaaagtaggcattttaaattatctaaagcatgaatttggggcattaaaacacctaccaggggatccctgggtggcgcaacggtttagcgcctgcctttggcccagggcacgatcctggagacccgggatcgaatcccatatcgggctcctggtgcatggagcctgcttctccctctgcctatgtctccgcctctctctctctttctctgtgactatcataaataaataaaaattaaaaaaaaaaataaaacacctaccagtaaaacttccatgggaaactcaattgggtaccgattgaaagaaattctgatacatttgttgattctcagagcaacaacagcagttagaaatagcaggatgctggtagaattagcttttgggagagttgcacagtagttaactatgttctgaaagaaaacaaaattacagaggcttagaaaggggtttgataattgcctatggctagaaaatgacactctctctacattagttcaaaaagaaatccctaagcagtgtctctgggcacaaatgtctttatgagcattactagcacagtgaaggcaaaggggaggatatatatccatatatatctaagttgataaagagatatcaaaagataataatgcccagtaggagagaatacacatgtttcagtgcaatggaaagaacccaggagttctgggcggccccggtggtgcagcggcttagcgccgcctgcatcctgaggtgtgatcctggagacccgggatcgaatcccatatcgggctcctggtgcatggagcctgcttctccctctgcctatgtctccgcctctctctctctttctctgtgactatcataaataaataaaaattaaaaaaaaaaataaaacacctaccagtaaaacttccatgggaaactcaattgggtaccgattgaaagaaattctgatacatttgttgattctcagagcaacaacagcagttagaaatagcaggatgctggtagaattagcttttgggagagttgcacagtagttaactatgttctgaaagaaaacaaaattacagaggcttagaaaggggtttgataattgcctatggctagaaaatgacactctctctacattagttcaaaaagaaatccctaagcagtgtctctgggcacaaatgtctttatgagcattactagcacagtgaaggcaaaggggaggatatatatccatatatatctaagttgataaagagatatcaaaagataataatgcccagtaggagagaatacacatgtttcagtgcaatggaaagaacccaggagttctgggcggccccggtggtgcagcggcttagcgccgcctgcatcctgaggtgtgatcctggagacctgggatggagtcccatattgggctccctgcatagagcctgcttctccctctgcctgtgtctctgcctctccctctctctgtatctctcatgaataaaaaaaaaaaaaaaaaaaaaaaaaaaagaacccaggagttctgtttaccagcctgctcctttactaattttcttaaacattgatgttctttagcatggcttctatgccattcttgcattaagggactatgtggcattttatattctttaatgttttaggatacaagtctgctatgaggcatgtaataggaagaattatgatagattcctgtattttaaaagcctaaatttatgtttgtttaaaaagcctgggccaaatagttaatgcaactgaggacatgatcctactggcatctgcaattaagatcgtaaatctagaacagatgcaattatttctaagactctcttttttttttttttttttctaagactctcttgacccagccgcctaggcagcagtctctccaggagggtccacttccttttgtaggtgaggggaggggcacttgtatctctgggtgagggtagaaattacttacgtagaagaaggagatgggaccagagtggaaaccgatcataatgccaaagatgcaagtcagctgggacagaataacgtgtagcgccacggcagccaggtaagcgctgattgcagcctccggaaggtacgtagcaaggaagccaaaacccaacaagcccatcgatagctgcaggaggttcaggcataaagaaaatcagagtgaaacagaacgtcgtcaaacccgggacgcctgggtagctcagcggtttagcgccgcctgcagcccagggcgtgacccgggagtcctgggaccgggttccacgtcgggctccctgcacggagcctgcttctccctctgcctgtgtctgcctctttctgtctcttgtgaataaataaaattaaaagaaaagaaaagaaaagaaaagaatgtcatcaaacccacagaggcgtcgattaggcgctatccagcaaaaagttgttaggcccctttgataactcttctttttctcagcaactgaaattgacgatctaaatccttggcgttgattcagaagctcccgataggcactagaccacgcttctcgcttcaggagcacttgagcgtaagttcttgctctaggatctactgatggtattactcctttttaaagatcttatttatttatgagagacacagaaacataggcagagggaaaaacaggctccccacggggagccccatgtggcactggatcccagcctggaatttccatctgagccgaaggcagacgctcaaccactgagccacccaggcgtccctctctactgaccttattaatgtgaggttaacagtgacccagtgtaatcaggacaaacttttgcctttctgagggcccttttgttagaagctttgacaacccttttcagatgttaatatccctgcgaggaacgagaagttcacaaaggaaaagataaattaaaaaaaaccctgaggagggatccctgggtggctcagcggtttggcacctgtctttggtccagggcgcgatcctgcagtcccgggatcgagtcccgccaggtgctcggcatggagcctgcttcttcctctgcccctctctatgtctctcgtgaataaataaaatctttaaaaaaaagaaagttaaaaacccggattccagctcaaacttctcagcttttttttttttttttttttaaatattttatttatttatttaggatagtcacagagagagagagagagaggcagagacacaggcagagggagaagcaggctccatgcaccgggagcctgacgtgggattcgatcccgggtctccaggatcgcgccctgggccaaaggcaggcgccaaaccgctgcgccacccagggatccccaaacttctcagcttttgactaatatctttactaagaatgattaacctaaatttatttcttcagggctatatataataatatgtatatattatataacatataagacataaattatgtttccatatattcagcatatataataaatataatttgtatattatatatacatatgtgcatgtaaaatactataaatgtacacataattacacataaaatactatattacattaaatatataatttatatatttgtataaatatatagttatgtttacatatatttatatgttacataaatcaatgtatttatatatttatgtataaatgtataaattcatgaatatatataattagttatttgtgtacttaatataatttttccaattatatatttatatataattacatagaacaattctatatttatatataattacatatattataaattatacattaaatataatggtacaaaatagtattttgtatgtacacatgcatatataatataaaaattatagacatatattatatatatttttatttttgaaaatattttatttatttattcatgagagacacagagagagagaggtagagacacaggcagaaggagaagcaggctccctcctgagcaggaagtccaatgctgggcttgatcccaggactgtgagattatgaccctgaactgaaggcagatgcttaacttacttgagccacccaggcaccccccatatataacttctgattcctcaaaaacttaattcctattagcctaatgttggctggaagccttaccaatacaaaccagatgattgaaatatatttggtatatatattacatactatgttattataatgaagtaggatagagaaaggaaaatgttatcaagacaatagtaaggaagagaaaatacatttacaatactgaattgtatttttaaaaatctgcatataaatgttcagatttttaagggggttgttcaggggcccataataattgttttaaatatttcttctacatacattttgaaccacatcacaatgttatcatttcatttcaaccatcaaacataatttagaaggcacaagaagacaagaaaaatctatcatatttatctatatttttactatttccattgttctttcttcctgatgttccaagatcctttcttttattacttcctttctgtttagagaacttccattcaccattctattagggtaaggtctgctggtagcgaattgttttacttttccctcatctcagaaggtcttgattttccttttattcttttttttttccttttattcttgaaggatattttcactgggtatattattttggattgacagttctttgctgttagcaaacaaaatattgtgcaacttatgctggactctataatttttgataagaaatctgctgtcatttgagttgctcacccctctcacaccatagaaaaagtgtttcactgttttcaagatctttttgtctttagttttcagatgattggctataatttgtcttagggtggatttctatggatttatcttgtttgaaattttctcagcttcttgaatccataggattatatcttttgccaaatttggggagttttcagctattacttcaagtaattcagccccatcttttttctcctctctttctgggactcttatgatacaaatattagatattttgttatcatcctacttgtccctggggctttatttttttccagtctgtttcctctctattgttaagattaagcaatttctattgttctttgagttcattcattcttccctgtctcctctattctgctattgagctcatcctttgaatttttaatttaattttatttttattgtactttttggttctaaaatttccatttgcttcttcatattttctgtttacttgctgagactttctattttctcacttgtttcaaacatgttcattattgcttgctgaagtatgtttaggatggctgctttaaaatctttgccagataatcctaacatctctgtcatctcaatgttgtcatctttttattgtcttttctcattcaagttgagatttttctggctcttactatgacaagtaattttcagttcaattacaaacattttgggcactatgctatgagacattggatcttatttaacccttctgttttagctagcttattttgacaaagtgatggcaggagaggggccaggtgccatctcattgctacctatagttgtagaagcccagttcttccctaagcttccaccaacagttgaggcagtaaggatttttcattattgctgagcaggggtgggagttctggctctccagtagtcctctgctgctattaacttacttcttcccttttggcctccattgacccaacagagggggctgtcctcttcactagaccatgtctgacatcacccaattgaggagtaggaagggggatctcattactgcacagtagaaatgaaagtcttgactccctgtttggccttctctgacaacattccagttttggggtgggtgggcatctcattacaggtgggtacgggtgaaagtctggctccttgattggccttggttggcatgagggggtttgataccacagttttgttttgttttcccttgatgtttgtctggagcatagtagttattatgtaaaagttttcagcctcactagccttttttggtgctgtggctataaagaacagacttctgttagggttgtacatgtgtgtgtacatgtgcacaggcattagagttgtgggtttctggcttcttcagcatcaagtttgaaatagaagaggcaaaaagaaaaccctggaaactcaccagtgtgttgttccttggggcctgagattctgagctagtttgctttcttctctccacttttcagcattttcttatgtttgttttataaataacattctaaggtttttaattgtatttagcaggaggaacagggaaaagaatctattttatcttcctggaaatggaatgtctcctcctttattagacaaacaaacaaacaaacaaacaaacaaataaaaccccaaggctcaaaggaggcaagagaacatgcccaggaccttgtagataattcataggttgctaacttacattgcctgttattttgtctttttctaaaagactggatttttaaaaaaaaaataaaaataaaaaaaaaaaataaaagactggattttttaaccacaggaattacatcttctttttttaatttttggtctctgtcaaagtaccaaattcatattttctgtaccataattataacatattgatgcttactatgtgacagactctgggttgaatgctttacatgtattttctcacttagtcatgagaaccctgcaaaacaaacattattattcccattttacacacaaggaaactgaggcccgtaaaggtaaagtgatttaagtaggtcatatagctggtatcagggctggagcctgctcactaggataacctgactttgcaggcttccaataaatctatacctaataaaagatggtcccaggagagatcagcaaaaattagctaaagagtagattaattgtggaaaaagagaaagctagcatatgtgactttagttcaacgatgaagcttcagatggtagactctcagagaaaatcaaagacacaccaaaaataagttttgatattttaacaagtcattgatattattgtcctttagctatgctcctgaaattctagaaaaagggttccaggtctgactctaatgcttacttaactcaaaatatagtatgtgaacctatgagtgctattcttgttgaaagaatataaagagttttaaaaaaaaacaacacgtgaaatcatgaatagaactctagatcagggatccctgggtggcgcagcagtttaacgcctgcctttggcccagggtgcgatcctggagacccgggatcaaatcccacgtcgggctcccagtacatggagcctgcttctccctctgcctgtgctctgcctctctctctctctctctctctctctgactaccataaataaataaaataataataataataaaaatttaaaaaaaagaactctagaccatagtccctagggcccttctttagttttagagaagagactgatgagaatgttccatatctaatcccaaatcaatggtgaatgatttctgaggaggaaaaagttttatcactgaggagagcctatccacacatcctgtaagttttccaaaaataaatcattgaagtttcagatatattaccatgggtaacaggagtaacaaaaggaaagggtccctttgtagctcctttatttatttacttcttcttcaggggttcagagactcagatcctacctgaataatcccagtcagaaaagttgtggatgccaccacactcaaggatctgttataatccacaaggaaggagggtgcagaaaagtcttccttgatgaaagttcccagaaccaggtggccactgttgaatgggtacaatctcaggacattgatcatcagagcactcacaaggaagaaggaacctatgaaagatgttgaggcggaaagtgaggttttaaaaccagggaacccgacatatttgacaaaagcaaggcatggtctgatgttgttttgtctttgatctgaataacttttcttttttgaaagtggtccttggagaagttaagaatgagtgaagaaaagaactctgggttccacatgtcatgaccaattcccagaatttagatctttgtggtccaggtatgggtgtatggagtggggctcaaagagaaattggctggaagtgcataacaggctcagccacttacctgctcttagagatggtgaatgagatgatgggggaggggataagaaaacaaagctaatcaataataataataagacaacacttatcatttatgaaggattaactaggtgcaaaatgacactgagctaaacctgtttcaaacatgatttcattcagtcctcctatccacatagtcacatatgggagcaaaggcaaaccctacttttaaattacctaacagaaacaaaactctagtaaccttattatcagtatttggaaatgattatgatgtgccccggaacttggaaatatgcaaatataattgttctctcagtgtctgaatgtaatatcaacatataatgggttttagtagagacatgtgatattgtccttaaaaaaggcaggatatcactctgcctctagaataatgagagggtaaccagattgaatgcacaaacatatctggagaaagcatgtgtcagtcaaaatgatcagtgttgtttgggtggtcagttgttcagtagggaagcccagaaaaaggtactttactaagtagatgttggcaatgccaagattactgagtatttttgtggtttgatttctatgccagtttacctatgtgaagaaaatgtgctgcttatatgaccttcaactagtttgatccctgtaacagttatttctgattataaattagtaggtggacttttgactcaggtaaggaaagtgcttatcctatggatttgagtgctttgttaccatgacaacattttctcattgtagattaataagctggcatgatgattataaagtaggcccatggtcttgggttactgcaggtccagctgaaagatggatccactctaggaatattggcaaaattgcctctggatcttctggattgagggcagatttcaaccagtggtaatttcaccaagaaaagtaccaatgctgtttaattcttttggaaaccaggtggctggccgagttgtctggcagtgaccttaataatggcacagtctctcaaatctgaaccctcaccctatggatggaatgtccattttctgcttcctttttttctaccttaagtatagcttcagtttgggttcttagcaataaggaaatgattgaggcagagactccatccacctcctggggttccagtgctggactcaccaatggacatttgatgacatgatccaaaaatgacataaattaatgaagaacagaaagctgcataacagacattgagaggaggaatcagttgcctggtcagcaaactaaatgtcaggactgaaaaacaagataatttaagtaagaagaggtaggctggctttttaaaaaatttaaattcaattaattaatatattattagtttcagaggtagagctcagtgattcatcagtctttttttttaagatttttatttatttattcatgagagatgcagagagggagaaagagagagagagagagagagagaggcagagacacaggcagagggagaagcaggctccatgcagggagcctgacgtgggactcaatcccgggtctccaggatcacacactgggctgaagacagcactaaaccgctgagccaccggagctgccctcatcagtcttataacacccagcgctcattacatcacatgccgtccttagtgcccatcacccagttaccccatcccccaccccccagtaggctaacttttaaaagtcactttcaaaaatactgtaaagaatatttaaaataatgatccctgtgtgtaactgactgagcatggtaatagcagctcttgacacatagccctccattagtcccttttattacctcctttagtatgtagcttctcctactttaccacatgcttttacacctcagttataaatcacaggcttaaacacttttcacttcaagttcttcctgctaatcatggaaaacagacatcacaataaaacttctgattccaacagcccagaggtagtcccatttcacccctagtctagtagcagaaggccctgggaatcctccagtactggaaataaagctggagaacaaggcaagaaccgtactttgctggcttgatttccacattggtatgtgttgtctctcttccatatgccaatcatttcagcctctttcttcaacaactccttcaatacttactttcttttccaagaataccatgagaatttgtaaattttgaagcaaatagattaacatgcatggtatcatcctttgatgtctcaaacctgcagctcctgccctgacagcctatcctttttttttttttttttttttgagagaaagagagtgcatgtgtgcacatgcacaggggtgatggggggatgggagaaggagaggaaagagagaatcttgagcaggctctacagccagcatggagccctataaatggctcaatctcatgattctgaggtcatgacctgcaccaaaatcaagagcccaatgatccactgactgagccacccaggcactcctgaggacctatcttcaacttacatcataacgtgtgctcatctgaattcagttataagttcagtgagccaagttagtgtcttagataaacaaggctttgtgtgtgtgtgtgtgtgtgtttgaggttcaaacacatacaaaactagagtataatgacctcccatgtatttataacctgctttaacagtagtcaactcatgaccaatcttatctcatctattcaatgctcactcctctcccaattcatattatttttttttcaattcatattatttttaagcaaattaaaaaaatgaaattatttcatctgtagatatttaaaaaaagaccctctttttttttaagtaatctgtgtgcccaatgtggggctcaaactcacaaccctgagatcaaagtctcatgctctattgactaagccaaccaggtgccccagaaggagaccctcttttttttttttttttttaagtgatcatctgttttaattttatttttatttatttatgatagtcacagagagagagagagaggcagagacataggcagagggagaagcaggctccatgcaccgggagcctgacgtgggattcgatcctgggtctccaggatcccgccctgggccaaaggcaggtgccaaaccgctgcgccacccagggatcccggagaccctctttttaatttaactacaataccatcattatatttaagaaattaataatggttttttatcaaatattcagtcaatgctcaaatttccctgcttatctcatagatggttgttgtggccttagagggcctctaagatgatctgcaatggctaattggtattcatgcctctgtgtgatccctacccctttagtaggggatggacctagtaactcgtatctaaaaagtgagagtacaacaaaaatgataggatgtcacttttgagagtaggttgtacgatgcttctgtcctggttgctctctctctatctctcaccagctgcaagacctggcttcaagagtgtgtgacctatgcaattaaacagggcttagaaggttccacacttgccttaatgctctactctgaccatcttgaaattctgaatagtttttaaagtaggaagtctgcatgtagctgttcccagctaccatattaggaggacactcaagcactgttggagaggcccacaaggtgagaaacccaggcctggcagcaaatgcatgagtgagcctaaaggctgatctccagcctcagtagagccttgagatgactgacagcttgactacaaccacatgagaaaccttcagccaaagatatggtgggttttggagtgatctttaaaaaatattatttgctattatatgttgtactattttttacaatctttgtgttcatatcaggacctaaatgaagctttcatatcagttgatgggtctcttaaatctttataatttatagtttctccttctgcatttcttttcaaagcaaagctctaatgattgcaaaagcaaaaaaccaagaaaacacacacacagagaaattgcttaaattagcttaagcaaaacaggaaatttactaaaagagtataaaaggcagttaggcctcatcagagactggaaccgtaactaaaaaaccatcaggatccaaggcagcaatctccctattttcttggtctttaggcttgcacaggctcctgtttttgtttccagttcgaggctactgggaacaacattgccaggaatatttttgtacatgcctcttggtgcatcattgtacaagttccattttagtgtgtgtgagttagcatgtaactcaaatttcacttttcacttcaataatcttgatcagtctcattgagttgtttccttacggatttgtaggagtatatatattgcagatttaagtcctttgctgagtgtgtgtattacaagtatctctccctttctgtggtttgcttttcaatctttgtgtgtctttgaatgaacaagacttttactttattaatttattagtcttttcctcttaggcaggctagtacttcttatgtcttgtttgagaaatcatttttttacctcaagatcatgaaaatattgccctacataattctaaaaaaattttatggttttacctttcacatttaggtatttaatctaccaggaatagatttttgtgtatggcattaggtagaggtctaaaaattgttttttcttgttgttattgtttttaataggttctacacccagcatggagccttgagatcaagatctgagctgagatcaagaattggacactcaacttactgagccacccaggtgcccttaaaattttttttaagtaagtatccagttgtttcatatcattcattaaaaagtttgtttctatagtgacacatctgatataaactgtgcaacatatatctgtgtatctcttttctgtttcattggtctaattgtatatctctgtaataccatactgtcttgctactttgtagtaattagtttagcaacagttttgataagttagtcaaaaaatgcccatttttattgtgaaatataacatacatatagaaagtgcattaaaatagatcttgatggggtgcctagctggctcaattggttgactgactgactcttggtttcggctcaggtcatgatttcaggatgtgggattaagccctggtttgggctttgtgctcaataagattctccccctctgcccctccctcaacttatgccctctctcatgcacacactctctctctcaaataaataaatagatatattttatttataaaaataaaataaatagttaaaaaactagatgttgggggtctgggtggctcagttggttaagcgtctgccttcagctcaggtcatgattcttggggtcttgggactgagcccacattgagctctctgctcagcagggagtctgcttctctctctccctctgcttctccccatgcttgtgtgctctctctctgtcaaataaacaaataaaatctttaaaaaaatagatgctgagctaaaacaaacatctttgttaccaccacccaggtctttgattataattccacctatttccacaaaggtattcattattttgactttttatgataataatttctttgctttgctttatagttttaccagtaatgtacatatttctaaataatacagtttagttcagtttgaattttcagtttggattttatattgatggagttacactgtatgaaaattttatttctgcttcttttgctcaatatcatgtatataacagtcctccatatggtggtaagttgcttgagattgctcatgttccttccatgtattccaatatatgcatatatgaatgtttacttattctgtctacttttgttggccattatcttaaatattacaactttatattaaattttgataattggagaagtaagccttcttgtgctgtgcttcaaaagaatatggcattcttggctttttgcatttacacatacattttagaatctgtttataatgttccattaaaaaaatcctgttgaaaaaaaaatcctgttgagatttacattaaaattatctatagagtttattttgagagactgagatctttaaatattgaggcttctaactcatgaacttgctagttttcaattaatttaattaataatactcagtaaagttgtataatttttctaaagaaaccttacctaccttttcttagtttcattacaacttatttcatatttattatgctttggtatttattatgcttttattatgcttttattttattttattttattttttaaattttttatttatttatgatagtcacacacacacagagagagagagaggcagagacacaagcagagggagaagcaggctccatgcaccaggagcccgacgtgggattcgatcccgggtctccgggatcgcgccctgggccaaggcaggcgccaaaccgctgggccacccagggatcccggtaaatggtatcttttaaaaaatttcactttctgtttcctgcaggtacataagaatatacttgatttttatatattgatcttgtatccagcaaacttgataaaatcttattaattttattaatttattggtagattattttcttcattaaaaaatgatcacctataaataatgaaattttgtttcttcctttttaattcttataccttatatttctttttctcaccttgttatactgcttatgaattccagtataatgttgaatagccccaatttactcttttttaaaaatatattttgtttatttattttttaagtaagctctccactcaacatggggttgaactcatgaccctgagatcaggtttcatgttccaccaactgagccagtcaggtgccccaacccttatttacttgtgatatgtaacatacattttgaaatgtaaggtttctttttttaaggatttatttgtttatttttgagagacagtaagcagggggaggggccgaaggagagggagagagaatcttcaagcagactccctgctgagtacagatcctgatgcagggctctatctcaggatcccgagaccatgacctgatttgaaatcaagagctggctgcccaaatgattgagccacccaagtgctctgaaatgtagggtttcaaataacttccccatacagagaagtaagagaattacttggtaagagcctgagaactaagtggtctaatctcagttaaaattaggctttggaaaaataaagggaaaactaatttccaaactttccactactttaaaaaatttttaatttgaactaattttagatctatagaaaagttacaaaaataatagcttcttgtatatcctttacttagcttctcctaatgttaacatttcacatagagtataatgatcagaatcagaaaattaaccttataaaataactaaagactttatttgaatctcattagttttcccattaattttctttttctgttcctggactctatccagaattccacattccatttagttatttctcctgaaccctgcaaactataatagttcctcagcctttacttggttttttgtttgtttgtttgtttgtttgttttagaatatttgtttttcttgactttgacactttgaaggagtattaacagatcagttattttgtcaaatgcccctcatttggggttagtcttaggtgcctgcacaattatactaaagttaaatgtctttggcgagaatgctacagatatgatgttgtgtccttcgtatcacaggattcagaagtctctgtatatcttactgctggtaatgacatagcattgatcacttggttcaggttgtttttcccaagttctttactatagagtagtgaagtagttagcaaatattttgaggaagaaactctgaaactatgaaaatctccttacatagtttgcagacttccacctactaattttaacatctgttagtggattttatctatggcaattattactctggtgtttccctaatggtgattttctattttcttttatgtttataaattgaaattctactgtcaggaagatctagcacttttttttaaaaattttatttatttatgatagtcacacagagagagagagaggcagagacacaggcagagggagaagcaggctccatgcaccgggagcctgacgtgggattcgatcccgggtctccaggatcgcaccctggtgccaaaggcaggcgccaaaccgctgcgctacccagggatcccctagcactttttaaataagttcttcacctgtagtatttttgtttcatttgaaggatagtattaagttgtcaggtactacctattcaaatacaaataaaacttttgaattatttaatatttatttttttaatttttatttatttatgatagtcacggagagagagaggcagagacacaggcagagggagaagcaggctccatgcaccgggagcctgatgtgggattcgatcccgagtctccaggatcgcgccctgggccaaaggcaggcgccaaaccgctgcgcgacccagggatcccttgaattatttatactacaaattatttcattattaaaatacttaaaataatatagaatacttaaaataatatagaatcccttagtcagttaacaactgttgctcagattcattcattcatgtagttatgtgatcattattattcaccaaagaacttgactacccactatgtgctagatagtatgctggatgctgggtaaacttttacaccctaatgccattcttcttttggtatgaaattatactgatgatttgataatttagtaatgagatgtcctcaactttgaccataaatgaaggacttttgataagtgggagtcagtagaggactcacagttaaagcatcagtaccaagagttcaggtccctcattgtagccctctagagactttctgatacttttctggaagtaaatgtactcatacaaacagaacattttgatttatcgctaccatatagaaattttaaaaggcactcctttattttgggaatgcaaagctggttcaatatttaaaaattaattaatgtaatctaccatattaacaatctaaatagaaaaatacatggtcatgtcaatattatagaaaaatcattggacaaaatacaatatccattcatgataaaaattctcagcaagctagaatagatggaaagttcctccacctaataaagagcatctacaaaaatcctacagctaacatcatacttaactgtgaaaaattgaatcctttccctcctaagaacaggaacaaggtaaaaatgtctattctcacgactcttattcagcatagtaatggaagtcttagccagcacaataaacaagataaagtcataaaagtcattcagattagaaagaagcacaactgtccctattagcaggtgacatgattatcaatgtagtatataccaaggaatctacagaagattcttagaactaataaatgagttgcaggatgcaaggtgaacacacagatcaattgtatttctatatgcaaacaatgaataattggaaacccaaactgtttttaattaccacaatcagtatctcctccaaaatgaaatgcttagatataattctaacaaaacatttgcaggacctgtatgctaatgaaggaaatacaaatgctaatgaaggaaatcaaagaaggccaaagtaaatgaagatatataccatgatcatgggttggaaactcaacataaagatatcaattatcccctaagtgctctatggagttaatgtaacagctatccatatctcagtaggatttttttgtaggcataaacaagctgatgataaaatttatatagaaaaatagctaaaacaattttgaaaaagaacaaaattggagggatcacactacccaattttaagactcactataaaaatacaataatcaagacatgatatttgtaaagagatagacaactagatcaatggaacagaatagagtccagaaatgaacccacaaaaatatggctatttgatctttgagaaaagcataaaaacattcagtgagtgatagccttctttaaaaatgatgttaaaaaaaatgatgttaaatatgtaacaaaaaacaaactttgacctaaacttcatactgtatgtaaggattaactcaaaatagatcatagatctacatgtaaaacataaacctataggacttttaggagaaaacataaaagaaaatctttgtgacatgggattagaaaggttcttatatacaataggaaaagcacaattcataaaaggaaaaaaaatggataaattggacttcatcaaaattaaaactgtttgttctgtcaaatacactattaagagagtgaaaagataagctatagactcagagaaaatatttgcaaaccacctatctgacaaaggacttgtatccagaatatatcaagaagtctcaaaaattaacaataggaaaacaaaaatttttttccaattaaaaaattgggcaaagttgttgaacaagcatctcactaaaaaggatgtgagatgagtataggggtgcgtgggtggcatagtcagttgagtggttgactcttggttttggctcaggttatgatctcagcatagtgagactgagccccatgtggggctccatgctcagtgtggagtctgcttgagattctctctgcctgtctgtcctctccccctccagctcatgctctttctctctctctctcaagtaacgaataagtaaatatctttaaaaaaagaggttatgaggatagcaaatatgaacatgaaaagatgttcaatctcattagccattagggaaatacaaattaaagccacaatgagacatcactacataactcttagaatggctacaaaagataataaaatctagccttcatcaaaatgaagacttttgctctgtatatactctgttaaaaggatgaaaagataggctacagattgggagaaaatatttataaaacactaagataaaggaccaatatctagaatacatgaataactcttgaaactcaatagtgaaaatgtaaataatccaattagaacatgaacaaaagacaagaagagctatttcattaaaatattcaagtggggaattggcataggagatcttaaacatcataaggcattaggaaaatgcaaactgaaactgcaatgagatctcagacatccttattagaatggctaaaaaggaaaaaaagtagtgacaacatcaagtgttagtgaggatgcagagcaattggatcactcatagattgctggtgggaatataaaatgatacaaccattctagaacacaggttggcagtttcttaaaaatctaaagatataactattctataatctcactgttgtgctcctggacatttatcccagagaaatgaatactatgtttgttaacctacacacaaatgttcatagcagctatatttgtttttttgttttgttttgttttaagattttatttattttttcatgagagacacagacacagacacacagacacacacacacacacacacaggcagagacacaggcagagggagaagcaggctccatgcagggagcccgatatgggactcgatcctgggactccaggatcatgccctaggccgaaggcaggcactaaactgctgagccacccagggatcccagcagctatatttgtaatagccaaagcctgaaaacaatccagacatactttaagggtgtttatgtttaaataaactatggtgtatccatagcatggaatactactcagcaataaaaaggaaaaactattgatacagacaaaaacctagatgaatcttcagagaattaagatgagtgaaaaaaaaaaaaaggcaatctcaaagagttccaaactatatgactctattttatataactttcttgaaatgacaacattctagacatgaagaacagatgagtggttgccagggttaaggaggaaataagagcaagaggcaagtggggataatataaaaaggcgacatgacggatcccttgtagtggtggaaatgttctatatcttgactatatcaatgttaataccctggttgtgggattgaactgtagtcttgtaagatgttgccatttgggaaagtagagaaaggatacaaggaatctctctgcagtttctttcaaatgcatgtgaatctatatattgtttagagatttgttttatagagagagtgagagtgagcaagagaaagagaatacaagggatccctgggtggcgcagctgtttggcgcctgcctttggcccgggacgcgatcctggagacccgggattgagtcccacgtcgggctccctgcatggagcctgcttctccctctgcttgtgtctctgcctctctgtctctctctgtgtgactatcatgaataaataaataaaatcttaaaaaaaaaagaatacagcatctttaaaaagaaaaaaaaagaaagagagtacaagtggggagaagaggaggcagaaggagagggagagaggtaatctcaagcagactctttgctgagcttggagcccaatgcaggctctatctcatgaccttgagatcatgccctgcactgaaaataagagtcagacacttaactgacagtgccacccggcacctcttgtgaatctataattatttcaaaataggaagtttagtttaaaaatacaggcaacatcaagcgaagggtgtggaggaactaaaatcctcatacattgttggtaggaatgaacaatggtaggcacagccactctggaaaacagtttggtagtttcttataaagttaaacacatacctaccgtatgaccagcaataccactcctgggtatttaccttagagaaatgaaaactatgttttcataaaaacctgtactggaatgttcatagaaactttatttgggacaaaaactagacatgaaatgtctaccaacatgtgaatcagaaactctggtttctcatccacagccatgcagtggataatctattcagcaataaagctattgaagcatattacaatttccactaatttcaaagacatcatgctgaattgaggaagccagcctttgacagttacatattatatgagtccattcagatgatagtctcaaaaaggcagaactgtggtaatagagaacagatcagtggttgccaggggaggatgggactaaaaggaatggcacaagagtgttttggggctgacagaactgttctgtttcttcattttgtggtggtaacataaatccatacatgtgtacaaatttgtagaattgaacaccaaaaggaaaaaaaaaagtcaatttttactgtaggacaactgagctcttaaaaagggatcccttttctccaactaacagccttgtgccagagttggatgttagctaccacttgaccctttgtttggcctcttttgtactttatacaacctatatgatcacaggtttcatacctgcctgactggccccagaaggatagacaaacagtgcttaaatactagtagggaattgcgaactactgtaagtaaaggattaataaaatcttttctccttctctgtggataaatttggtgttggattaactttctagctcttcctttgggaatctggtaacagtgaaatgtcagctgtgttaccagccaacattggttatggtaaaaatgcctgattattctgtacgtggaccaagaagattgtgaatgaaggctaaatatccagtgggaatcattggctttgagcttttctgagcacgataactcttgtaattgggcatgccatttgtgggactctgaaaacaacagttatgagaattacaagagacgttggttcctattcaggaaatgaggcttctaaagcccaattagctcctgtacctctgtctgtttgattttgttgtctcctatctgaactgccacttggaagaccaaagagtggcccctggactgctgtgtgtgtaacttactgaagagatgctagcatgctgtgtttcctattctttacctgtctaagtataaccaatgccaagtgaggactattgtagttgtgtgaatattaaatgactaattaagcaaaaaaagaccaatgcttgaatgggcaatccaagtatcttaaaagtattctatgtaaactaactgagtctttttttaaaaatttactttatttatttgagagggagggagagagagagagagagagagagagcaggggaggggcagagggagagaaagagagagagaatctcaagcagactctccactgagagcaaagccccaacatgggattgatcccaggaccctgagatcatgacctgagctgaaatctagaattggatgcttaaccaactgagccatcagggtgctctgaagctaactgaatcttttggaaccaccctagaagagttagtaatatggcagataagggaataaatggtagtaatgtgattggaatgcacctattttttctattcctctaacacaggtaattgtttactctggataaacagacaatgtctgatagattgtgggtaaaaaaaggcttccttaccttggggaacttgcacacagccaacacttataccagcaagtaagtctccaataagccaatccttgaaccgatacaaacacacccactccaggaaaggaaagatcgttagtatgcatctcaggaatttgtgccatgagcagctgtgagaaagaagaacagagatttgattagattttccaaagaaaaaaaaccccacataccaagaaaaggcacggtgcataattcttcccatacaacagagtttcttgttagcactattgatattttgacatagtggatgagataattctttgttgtggggctgtcctatgcattgtgagatgtttagcagcatccctggccttcacccaccagatgtcaatagcactccctcccctagttgtgacaacccaaaaatgtctccaaacattgtcaaatattctgtgggggacaaagtcacctctggctgagaaccaaatctcatgtatatatgacaagaactaagctttattgtctagcatacaaaataggatgtttggaaagaattaaacctaccaattttccagtagaaaaacggactgttactgctttctcttgagaaggacagtgttttgagatgtgacattgttgggagacaggggcaattaacacatccacattatccccatatacttttttttttttttttactgaacattaactttatgtggctttgatctgtagtatgtggaaatttatagaaaatgtagatattggaatcctatgctttaggagttagccatataaagaaaaagcaacaaaataaagctttattattttttaacccagtgaacatcaatcagaatcatttttgttatctgggggacatttggcaacgtctggagacatttttgggtgtcacaattgagggagagggtgctactggtatctagtgggtggaggccagggatgttgctatacattctatagtgcataggccagcccccacaagaaacaattttctagtccaaaatgttaatgatgctgagatttagaaaacctacattaaccttcaaatcatctaaaacagcagaatcattgttaatcaatcagtcaattggttaatcaatcaactagtaaaactaatttggttttaagttgctttttgctatttacatttagtatgggctgaaagcaaaaaatatgaaggcttttcatctatgagctgtaattgaatagctgggatttgactatagcaacaaatagaactttagcgtatccaaagctaaaaagtgtgctcataaagaatttcacgtatgtttgactctcacaactatgagcactatgatccctaaggtaattaaggccaaataagcatgtcatttttccaaggtcataatagtgttgacagagctggggctacaaaccaggtcttctgatgcctacttcagtgttctatttactctattaccaccatagttcatattgacagctattaaattctgtttgggagccaggaaaaagaccattgctattttatgagagtccctgaatgttaggcaggtatacacagtgtgagtacacagtctgtccaattatgaccctcaaaggagagagtagagcaagttactgggacaatttggtgtttcatctggtcagtctctctttctctccatgtgccactgggcagaagtcaccctaggcagagtcatcaaagatctttagcatggaaaaaatacagtggacatggaatgatgaggccctagaagtaaaagaatattaaggcaagaactagaggaataggaattgaatccagtgggggaacggtataagcattttgacatgaatctggattttatccaaagcatcataacagcaaggaatctaagagtctatgtggaaatacagggggcattctgataagaaagggagtatttgtagttgctaatgaaaaggaagaaaatgaggaaagagatgagattttctgtcaaagaagaggtggtgggggcacctgggtggctcagtcagttgagtgtctgactcttggtttcagctcaggtcatgatccatgggtcatgagatggagccctctgtcaggctcagagcagagtctacctgaagattctctccctcggcccctccccccaacatgctttctttctctcaaataaataaataaatctaaagaaaaaaaaaagaagagatggagttcaaagattttttaactaaaacactcatgtatatagtgttttttatttgctcggtgccttacaaatactccttaaatcctcacactagatactagtatcatccccatttttacagatgagtaaactgaggcaaggtagggttggatagcttacttcaagtcacgcagttgggaagcagcagaactgggattcaagaccaagtaatctggcttctgagtcttgttcttagccacagagttgtgctacctttcatgttaaaaatccagaagtggataaaactgtatgttttacaaatgaggagtaagggatgcctgggtggctcagctgtagagtgtctgccttcagctcagggtgtgatcctggagttctaggatggagtcccacattgggctccctgcatggagcctgcttctccctctgcctgggtctctgcctctctgtgtgtctcatgaatgaataaataaaatcttaaaaaaaaaaagaactgctagaaaagcccaataggagcagaattgatcagatttaagagtccaagcatagggcaggtggaggggagttaggctaaaatttctttggtagtacctttttatgatgaattaaaagtcaggaaaagactcttcttgtgtagagacaaagccaatgtgcccccaaatcccctctttgacatatgacttctgagccatctggagtagagaaaatgagagtagtgatgtaggactggggagggtctccaagacaaaaggcaggatatggacaaaggagaatgtgtcagagaaagaaggtctacaatagggtggtatggaggccttcttgtcttgtcatccaaaacatgccaaccacagtgataaattaagggatgagagagattgataaatctcaagtgtgagtgaggacaacttgaataattaggggtttgtataatgaggtatgtcaaaagggtccttaatgaggtctatggacccccatggggtctgtagatagaatttgtaggtatgtgaacttaggaaaaattatacctttattttcactacccctaagtgaaatttagcatttccaccagtgatgaatattacaacaaaccactgaaagtatcagcagaacctgactttgtcaccaatagaaatcacaatatgttcatattatattaagattgtttaaaaaaaaaaaagattgttgcagagatcttaagatatcatttatattcagttaccttgaaattatggtagctactagattcacattattaaataacataattgtaatatttaaaaaaatattttgagaactatatttcaacctaactggtttcttttataatcctctgtattttatgcattaaaaaatattctggccaagaccacttaatgaggaaagaactgtctcttcaacaaattgtgctgggaaaatgggatctccatatggaaagaatcaagtcagacccttactttataccatatacaaaatcaactcaaaatcaatcaagaatctaaatttaagagctaaatctagaaaactcttaaaagaaaacaggaaaatcttcataatcttagatttcatgatagtttcttttttctttttttttaaagattttatttatttattcatgagagacacgcagagagagagagagagagagaggcagaaacagaggcagtgggagaagcaggctccatgtaggagcctgacgtgggacttgatcccaggtctccaggatcacaccctgggctgaaggcagtgctaaactgctgagccacctgggctgcccttcatgatagtttcttaaagatgacatcaaaaccacaggcaacaaaacaaaataacagataaatcagatctcatgaacattaaaagcttttgtgtaccaaatgacactatcagcacacagaaaagatggtccacagaagtggagaaaatatttgcaaattatatattggataagggtttaatatccaggatatatggagaactactacaactccacaataaaaaaaaaacctaattttaaaaggggcaaaggaagtaaatagacatttcctccaagaaggcataaaactgaccaaagcacatgaagagatgctcaacgtatttagttattagggaaatgcaacaacaacaacaaaaaaacaaaaaacaaacaaacaaacaaaccaaaccccacaatgagataaccacctcatgcctaataggatggctataatttttaaaaaatggaaaataacacaagttgaagacgatatggagcaaaaacacttgtacattgctagtatgaatgtacaatgctgtagcttgtatgaaagagtttgctagttcctcagaaaattatagtgacgcctgggtggctgagcagttgagcatctgctttagtgtcaggttgtgatcccaggtctggtgattgagtcccgcattgggctccctatgaggatcctgcttctccctctgcctgtgtctctgtctctcatgaataaataaataaataaaatcttaaaaaagtttaaacatagaatcaccatatgatccaacaattccacttccaggtatataacccaaaggtgttgaaaacaagttcttaggtactccttttccagaattttaaaaaagattttatttatttatttatgacacacacacacacacacacacagaaagagagagagagagagagaggcagagacccaggcagagtgagaagcaggcttcatgcagggagcccaatgtgggactcaatcccgggactccaggatcacaccctgggctgaaggcaggtgccaaaccgctgagccacccagggatccctcctctttgccagtattaatagcagcattattcataatagccaaaaagtggaaacaacccatggatgaatcaacagatgaatggataaacaaaatatgatatatacatacaatggggtatcacagccataagatgaaatgaggagctgatccatgctacagcatagatgaactttgaaaacattatgctaagtgaaacaaaccagatatgaaagacaagggatgcctgggtggctcagtagttgaatgtctgccttctgctcaggtcgtgatcctggggtcctgggattgagtcccacattgggctctctagagggagcctgcttctccctctgcctgtctctgcctctctctctttctctctctctgtgtgtctctcatgaataaataaataaaatctcttaaaaaaagatatgaaagacaaaaattgtgtgattatacttaaacaaaatatctacaataggcatagagacagaacctagaggagaggttaccaggggctaggggtgggggaaaatggggaattattgcttaatgggtacaaagtttctgtttgaggtgatgaaaaaagttttgaaagcagtggtgatggttgcacaacatcatgaaatgttctgagtgctgtagatttgtacatttcaaacggttaaaatggccaatcttcgtttatatctattttaccacaatttttttaagtaaaaaaagaatttctgaaaagatgttcataagctttatcagactgctcaaaggttcatagcacaaaaacaggtgaagagcccctgaactgtgggacctacccagtcactgtggctgtcacaggctgtggctgttggaagactggcaacaatagttaatcatttgtattattcattgttattcccagatgctgttggggacatctgaggtctttatgcccaagaaatttataatcaacaggatgctacaggacaaaccataaacaaacaaacaactgacaaaaaattacacaggaaactaagggtcctgatgacaggaattcaaaagaggaagacagaagtaggtactgaaggagtaaagcagggttttgctgctgccagcatgaaagtagctgaatgaccccacacacccaccggcactggacatgatgtctgaaggtggtaatgtcgatgtccaagttcccagaggaaatactcttccttctgtgttcctgttgaaaggtctcctcattgtacacatctcgcttgacatcatatgtgaaagaattttgcctatatttatagccaaaactctgggcactcctctctggttgcatcattcctggttgagtgggaagagatcaaacaaaaaacaatttattttatatattttttaaacaaaaaacaaattaaaaaactctagattcttggtacatttttatggaaattaaatttacatatataatgatatcttacatttacataacacattacttttttttgaataagattttatttatttattcatgagagacacaaaaagagagagagaggcagagacacaggcagagggagaagcaggctccacacagggagcccgatgtgggactccatcctgagtctccaggatcaggccctgggctgaaggcaggtgctaaaccactgagccacccaggcatctcaacacattactgttttaaaaaactttctcttgtacaattttatactcaaaaccattgtataaaaaatgcaaagtgtgtattattctcgtttttccaaatggagaaacccaaaagtttaaatagccttccttggctgtttaataattagggtcgggactagaacccaagtgtcttgctaggaaatctagttttctttatattcagttatgttgctatgttgtaggggaaatgatttaagaggtaaaagtcagtataaccttcaattttcactgaaaacagtaaagattaagtggttaatatagtatcttcttccttttatcccttccttttcttcatagcacctgtcaggacctgattcaatatttctgtctgttgtctgttttccaagaggcagggctttgttcgtggctgtatccccaggtgccagaatactgtctgacacatagcaagccctcaatgaatatttcttttttttttttaatttttatttatttatgatagtcacagagagagagagagagagagagaggcagagacataggcagagggagaagcaggctccatgcactgggagcctgatgtgggattcgatcccgggtctccaggatcgcgccctgggccaaaggcaggcgccaaaccgctgcgccacccagggatccctcagtgaatatttcttgaatgattgtcaagtacccagctagtggcaccagggcgcagcagagaaaactttgcacaggctatcaggagcccggagttccagccctggctgtttttctaactagtttatatgattagaggcaagtgtctcagaaactgggtttcagtttccttcagtttcatgcataaaataacgtgaatgaacacatggcctctaagggtcacattaagttttaaaagtctatattgtcctgctcttttaagaaaatgagaagttactgaagatggctatagatccatttctgggagaaagtataatcattttttttaaagattttatttatttattcatgagagtcacagaaagagagaggcagagacacaggcagagggagcaggctccatgcagggagcccgatgtgggacttgatcccgggactccaggatcttgccttgggcggaaggcaggtgctaaaccactaagccacccaggtgttccagtataatcattcttgatcacctatgggtatttttttaaaatactttatttctttatatatttatttatttaagagagagagagagagagagagagagagaggacagggagaaggaatcccaagcatactacttgctgagtgtgagcctggttcagcgcttgatcccatgaccctgaggtcatgacctgagccaaaatcaagaatcagacccttaactgacggagccatccaggtgcccctcatctatatttctgaacaataaaaaaagcataagctctaaactcccacataaatgcagaaaagtatatctatatattatatagctataagatacctaggtaaacactcaaaatttgtagattacccaagtagttcttttataggtgaggctgaaaacaagtttaatgtatcagcaactctgttttccttcagaatgatcatgtatcatcatcatcatcatcatcatcatcatcaccaataattatagagcacttactatataccaaacattgcacttggtttttttcatgagttatttcatataatttccaggacaatcctagtgctgctattacccccattttataggtgataaaaccaaggtttttgaaaagttaactgggccatagtcataggttgtatttttaccctcaaagcactgagtagtagtcgtgtgttgtatagtacctatgaactgaagatcacaaatttaataaagcgagaatgtgattgggggatgtagaagaggatgaaagaggtattttacaatgtatcacttaggagaattagtaatttctgtgtttctcagaaaaacagaactgtacattaaaacaagtaatatttttccttttcttctcccacccacaggaatattcatccagtcttccttactttccccatgtaatcctacaataagcttccgttgctagaatatatctttttttttaaaaaaatattttatttatttgtttttgaaagacacagagagaggcagaaggagaagtaggtttcatgcaggaagcccattgtgggacttgatcccagaactcctggatcatgccctgagcaaaaggcagacactctactgctgagccacacaggtgtcccaagaatatatctttccctggcaactgagagagcctaatcaacctgccaattatactgagattattaagaaaaacaaaaacaaaaaaaccccagccatcctgggttggatccagggtttggaattcagcattttgtttctgaaagtggcaccaaggcagggttggcacgaagcaggcagcatatacacctcggggcacagagggagcagtgtggatagttcctaggctccagcaatggctggcatgggtcatgtggggctagcctggccaggtctgatcattttcaagttgagcaacaattgcagatttttatctgaagtcctctcactttgaaatgttgccaattactttacccattttttttttttttaaacacagaacatatctaacaaaacccctctgcagtccaattcagcccgtggaccatcagtgtgtgatctctgtaccaagagccttgctgtcaaagacaaaatacccccatcttctcccatcacaaattatagtttatcccccaagactttctctaattttctttccaggctaaggtatttatattttctggtgtcatgccctttggaggcattatatcccactatttcacttacaggaagtaagatttcattttattaccttcaatctacatcatttatattttttttctggatatgtctcctgaggcaagggaaataaaagcaaaagtaaattattgggactgcatctaaataaaacatttctggacagtgagcgaaacaatcaacaaaattaaaaggcaacctacagaatgggagaagatatttgcaaataacatatctaataaaaggttagtatccaaaatatataaagaacagatacaactcaataccccaaagataaatcattaaaaaatgagaagacatggatatttctccaaagaaaacattcagttggccaacagacacatgaaaagatgctccacattactcatcatcagagaaatgcaaacccaaaccacaatgagttatcaactcacacctgtcagaatggctacaattacaaacacaagaaacaagtgttggtaaggatgtggagaaaaaggagccttcttgcactattgatagaaatgcaaactggtacagctgctgtgaaaaacagtatggagattcctcagaaaattaaaaataaaacagtgctataatccagtaattgtgttactgggtacttagtgccagaataacatgcacccctttaatccccatccactacttcacctatctccctacctcccccagtagtcattcgtttgttctctgtagttaagagtctttttcttggttgtctctctcttttttcctttgtttgttttttaattttttaagggttttatttatttactcatgagagacacagagagagaggcagagacataggcagagggagaattcaaagggatacatgcacccctatgtttactgcagcactgtttacaatagccaaactatggaagcagcccaattgtccatcaatagatgaatgggtaaagatgtggtatatatatatataatggaatataactcagccataaaaaagaatggactcttatcatttgcaacaacatggatggagctagagggtatcatgctaagtgaaagaagttagtcagagagagacgatatatctcactcatacgtggaatttttttaaaagatattatttatttattcgagaaacagatatagagaggcagagacacaggcagagggagaagcaggctccatgcagggagcccgacgtgggacttgatcccgggtccccaggaccatgccctgggctgaaggcagcgctaaactgctgagccacccaggctgccctcatacgtggaatttaagaaagaaaatatacgagcagggacgcctgggtggctcattggttgagcatctgcctttggctcaggatctcggggtcttggaatcaagtcccacatcaggttccccgcagggaacctgcttctccctctgcctgggggagagggctactggggggaggggaagtggggagataggtgaaatagggggtggggattaaagagtacacttctcatgatctaaaaaaaataaagtgcttgagcaggactagtaatatgcacagggaagtgctttgggaaatgaattatgtcagtggtatgctctaaaggtatactgtccagtatggtagccactggctacctgtggctatttaaatttaatttcattaaaataaaataaaataaaaaattcttcagttgagctagttacatatgaagtgctcaccagccacatgtggcagaggctaccatgctgaacagtgtaggtataaatcatttccactatcacagaaaagttctatcggacaggagagactgaagcaaaaagtctaattggaggccactactattactatagtttagggcaaaagtaatcaagttataactcgtaggaggaacctcagtgaggatggttagcagagctggggcagcaggaaagctgtcttacagggttcatcacatgactggctaaaggcagcgaggtaaaacacatgatttccttatgggttgtttttttttgttgtggtggtggtggtggttattgtctggagtatgtcatttctggagtttgtccagttccattatgtctttgtggatttcctagaatccctaatgcttcattttcatttactagcagggcacttgtgacaaagtatgataggaaactcctatttacaggaggcagatgcagtttggtgtggagaaggcagtgcattttagaaaaagttatcaaactacactgacgggataatgaccttttggctgagacacaattcgagggggtgtctgttactgactcctgaaggtatcagtgtgatgggcctctgtatatagcatgatcaacaacatgctaagctctacctaaaatcttgaaggtaagtgtccacttagaaaacaattccctgggggcccctgggtagctcagttggttaagactctgactcttgatttcagctccacctgttgggctcctgctgggcatgaagcctgcttgagattcctcctctgaccctatctgtccggtgtgagtgtactctctatctcttacaataaaacaacacaacgtaaaataaaacaattctctgatgcttcctgacattacaaaatatttcggtgggtctgaagtttttaagatttcattttcatattctacaaatgtgattttgggcatcaggcttcactactaacaaattattttaatctttgtagtccacacttggtgcccatgcaaatagcatcagcatcatctgggaacatgttagaaattcagattctcaggccccacctagcaagacctaatttatcagagactctgaggatgggccagcagttggtttaaaaagccctcctggtgattctggcagtaaaatatgaggaccactgtaaatgtagccaattatctttacttggtcagtctttctgtgctaaatttggtggcattgtttaaaacaggcacactatcccccacactatccatgcttatctagccatccctctattcatttacataatgtgttaaaagtatcttaaaaagccaagaataaaacacttaatcagaacgcaattttctgattattgacctgatagatatgaaatcctgaacctcagtttagttgcaataacatcttttccctcatatcatcatctttcctctatcctctgcaatcatggtaaggtaaaattcgcttccaaaatttcaaataagcatttgtaattccatcagaaacaacagccatttgcctgttaccacctcatgttcttatagggaacgtatttggaatccagcaaaggcacaagcgaggtgcattgctttcaaatatccttcagtctctctatctggtggctggggatgaataataagttgacagcccccaaggagctgaccatcagacacataaacaactacttttaatgcgacttggtgagactattatcagtggggtgtgttggagataaactcatttctggggtagggatgttggaaaggcttccaagggggccactcactgatacattgataggagtcaagaggaagagataggagccaaggcaggtgggagtgggaggctcaatccgagggaagaaaatgaacagagcagtgaggtctggaagtaggaggcgggcctgggcagtcgggcttcaggaggagacggcagggtggtaaggagaggctcgggctgcagccccagtacaatgcagaccaatgcgtctgaaaggattcggttgcaaaccgcaagcattgcctctagtcctttgactagtagagacgatgcccccgagaaatgagctttccccggactagggtcattcattcatttcacacacatcgagcgctctcgaagcgcctgggctggcgggcgaccgacgccccgctctaacctgcggccgcggctccaccggggcccggcgggggcgcgagtgccagcgccggggtcccagcgccggggtcccacgctgctccggccgggctggcggcgctgtggacgcggccgccggcggttcccgagccgttgcgcccgaacccgccggcgttccggcgggcgggggacgcgagcacccgcacctgcggtggggcccggggtgggggtggggaggcccttaacctgtgccacccaggcctccacttgctttggggtttgactactcttgactgggaggccttctttttatttatttatttatttttatttttaaatttttatttatttatgatagtcacagagagagagagagagaggcagagacacaggcagagggagaagcaggctccatgcactgggagcccgatgtgggattcgatcccgggtctccaggatcgcgccctaggccgaaggcaggcgccaaaccgctgcgccacccagggatccctggggggccttcttaatgccaggcctcgcgccctgcacttcacgcacagcgattcactgaaagcaccctacggctttgtcaggtcggaagacgcaggagcacctggaggctggaaggtcactcaagtctgcaaccctcgctctctgccccccaagcccggctcctcccaccgaaggacagtcttctgcccgggtcgctcgctgggctcccccagcgccccgccctttaacctttggaagtttactcagtccctgtcactatgtgactacgccctggattcctgcttggcccagctgcagttttacacttgctcgattactgggttaaaatctaacacattcactttacctattcgttccttttttgtagattgtcacccatcgccccctataaggcggggatttttctttttttttttttaatttttatttatttatttatttatttatttatttatttattggcagggatttttctaatggctgtattatcagtgcctaaacaatgtggtagatatagtaagcgctcagtcagttgtaaattccatgtaggcagcaactgtgtctattttttttaaaggttttatttattcatgagagagagagagagagagataggcagagacacaggcagagggagaagcatgctccatgcagggagccggacgtgggactcgatcccgagtctccaggaccacgccctgggctgaaggcggcgctaaaccgctgagccaccctggctgcccaactgtgtctatttttaaattgccttttgtcaatcagaagtggctggcacagagtaggcattcggtacatgtttgttgaaagagtgactgaatgtactgtttagttcatttttaccctttcagtcactcccacttcactatcccaatttggtggataatcatgaattccttaggttcattcctactgccgagtttcctcccttgtatccatccactcatcaccttgattgcccactcccacctgccatttctttccaatcacatttttgcttctcgcctcttccttcaaccttcattacttcttggagggctccctaacctgcaggtagccttggaacattttcaagcagcatgtcttcataggcgagagaatccagactaagccacatcggatcctccaagaaaagctttccaggaatgacccatgactctggtttttatttttgtttttccttgaggagaactgaggatcctgcactctctcctaagttgagatcatggtcattattcataatttgttcaataaatatttatggggtacctattatattctaggcactgtgctaggtgctgggacaagatatgcaaaatctgagcattctaaaggatgcacgacacgaaagagaataatcacgggaagggttgagaagtgtcctggcttggacccagttacttctaagagacattgtaacaaactttaacaaaggaataagttggttacagtggctgtaggtatggttatatagtatcttgctcactcacacttactatcttgttcagctttacaggtaaccctattaggcgcggatgtaaggcaggaattacttttgcagaagctggaactagagtctaagagaggtcaatagacttgcctaataggacaccctctgccttgctctccttaacctgaggcaagaatcaagcttcagagcaggattcagtttcaaaccctcagaagtactcttttcaaaaatccttctccaagggggatgcgggagactttcctgaatcagaactgcctggagcatattataaaaatgcgcgttcttggcgcctatcaccgacctatccacttagactccctgtgggtcctgggacttggcttttttttttttttttaacactccaagtgttcttctgcacataaacgtttaaagaccgttaggagagtttgggtggaaaacctcagacttaacgtagagctaatacttgctttcgggatagggtccgtcacagttccgaagattaagccgtatgtccccgaacatggaataacggctttctggctggaaccttccttttccaaatgtaagtatttcttggaagttggaggttctgctgagcagatgctcggctgctggtgactaccggcagttcaaagatcttttggctcttttcccgacaccctattagtcgccgtcgcctcccgccacggagccgggcgtttgccccgccgaccacggtggggcgcacgcggcatacgttgcctgcctgtccctccctttcccgggtccgccttcgcgcccttaagagcagtccccgagagttcctgcctctggtctccagctgttgcccttttctcgcgagaagtgctcctcccatcctctccggtagtccaccccctcccgtgggcaggttccatattgggtaaaatctcggctcgcggagagtcccgggagctggtctcgcgagagtacggctagcgactcctgttcgctggctctggaacggcgatcactggaacttgagcgggcgctgcagctggagccgcagttccgcggcgcagcccggggtcggcctggtcggggagagggtgcagggagagcgtggtgggcgcagccctgagccccgcagcctgcccctgcccttcaccgggctcgcccggcagctgcggctgacaggggccgcgcgcgcgggagtcggcggggtcgcgtctgccgcacctgcgccgactgccagctccgggtccccgcccggcccggcgggcaacgagggcccgggagcgggagcgggagcgggtgcgggtgcgggcgcaggcggggcccctcagggccacctcctagccccgcggccgccgctggaagatgtctcaggagaggcccacgttctaccggcaggagctgaataagacaatctgggaggtgcccgagcgttaccagaacctgtccccggtgggctccggcgcctacggctccgtgtggtgagtgtcaccgggcttgggtctgcggcgggcttggtggcctcagcaccccagagccaggcctgcccacacagctcagcgatgcaccaagcggtaggaattttctctgggggagggcatcgttgcccattcgacccctgtgctgcacgcccgggacccccttgcacccctcactctgcacccccagggaggcggtcggctgtgtgcaggatgcaggtccacggtgggcggtggtgctggagctcggccctgcctcgcaccctgcgcaagcccttctgggggggtggctgctcgggggaggggggctggcacagaggccggggcgtctctccgggggtggggggtgtctccctgccagcctcgagccgaaggagcctctccggaggtgcagccactctgggcgcgcgggagcctgccctccaagcagacaagcccgggggggctgcagggagaagcagaagggccaagctctacgggagactgcgagcgtcggaacaaaactgacgaccaagggctttctgccctggcttttttttttttttttttttgcagacctctttcgaaatctcatttcgagaggcattcttttcgaattcgcacttgcattagcagcgacccaaagaaccgaaaataccgactttatctcggccagcctagtgccagcttgagttgtgtgtttccgattctgttgaaagcgtatttccttttcgctgagtgggggtgggtggtagtgcctgcaagaacactgcagcttgagaaactggcggcttcactgattagtcacataccactgctcatttaagtattgtttggcaaaaaccagttttttcacttggagcaagtgagattcagatccgttggacgcgctcaagatcaaagaatcatgagcaatctggggaggtattgtaagtatttcttaattgcagtacatcttgtgaatattgtgtttttaaacttctttagagagttcgcagggaactgatctacatttgtagcctgaggtacacgatggttttcataaggatagggaatatatagcaaaggaagggagagacacttctcagctttaattcacactgtgttttaaattaaatcgatccaataaaattcttggatctaaaatatttcactagtttaggtattacacaccatattttagagttactgtaacttgagagctgctgatctgaaactaattcctgtattcatgtgaatcatttgaaaagggctccataagattttgggagggtgggggtgggggtgagggaaacgaattccagacttttggatgtgttaatctttataattcttgtgtttcttaaagtcacatcatgaatttcctgtttgctagaatcttctgggtaattgagattgtgcaattgtgtcaagcaacagatcatattgcattttctagttcaagctgcgtgagttcatcttgctgatggtcccgtgcttgacatcttttcctcatttttataatatggcagtttacgttttaagggaatttgcaacattttactgtatccatctatatgtgtgattgatttgcaaattttcagagatatatttggatcatggctcctttaatagcttattattttaccactctttttcattctgttatgtcataattgacattaattttcgtagtaccaagtttctgtttccaatgatgtttaaactttaatgaaatgatacagcagaatagctcaactatggggagtttagtggacctgaaaacaactgcttgcaaggtcttcctactgttggtatgaatagctctgtcctggaactgcagattcagatttagagtgaagtatcataaaaatgacctttacatttccttagtactatacttttttggcttacagaagccagaaatatctgacacttggaagtgattttgttaaacatattttaaaaaatatgtatagaattatatacacattgtataaaattcaaaaggcgtaaaaggatatttaacgaaaggtatcctttcctttcttgttctccaactgtgctattcctttcctctgagacagcccctgttaagtttcttatgtgtctttacaaggaggcagagcccattcatttgtttttagtagtatttctgttgagggatttaaagtgtgacatatggtatattggtggaagagaatgcatcttatgtgtgtcagttgactatggcaaatataattgattttggattgaaaatatcagaatttagatatacataagtaagtggcatctcattcagaattatttgaagttattctttcagttctttcagattcttagcagtgttttgggtgttgcagcaaactttttttttttttttttttttaatttctcttacagcattctggagcctgtgttatttttcactgccatcatcctttaagaacagatttgattttagggaataagaaaatcaagctgaattcaaataatttagagaatttgtactcaagtctggcgagaaagattaggcattcaggttggtcttgttttaggtcaaataggagttataactataaagtaatgacagaatttcttgtgtgacttgtagaactggatctgaagtctgttccgaaaaagaatctctgaaagcattttaaggaatgcaacctcacgcaaatatctgtcagtttcctaatttgattgctcctaagtgtgatatactttgatgtatattaaaagttttttatgttaagcctattttctcattttaattttcactaagtctacagtaaaaaggcaagcagcagcctgtatgctatgaatccaagatcaaggaatcagactagaaattgaaaattgataaggttttatttttttaatttttcaattttttaaaaaattgataaggttttataatatacctttcctttttaaaaggtaaagggaactaaataagtcttgcagttttaaggaactttgttgcattgtctgtgaggggaaatgaagcaaaattgtttaagaatactttgttgcaaagcattgattttctggttttgggacagaaggagggactctttgtggtgagtttaaggaaatataaacaggaacttaaatgcctttcctctgggtatggtttttccagacccttgctgttgattagaggaggtggggccctggtagccataaaataggtagccataaaataaaaaatactcttaagtcatagtcctttgttgattcaacaacactgaataccagctacggactagataatgggctaggtttcatgagatagagtgctgagcaagacagtgagataatccattccctcgtcaagctaagtctaatgtgaataaaaaaactacattttatggattgcttactgttctaggcattttactgtgtagtttatatttatcacgagtgtatttagcctatgcaagattttttagtgagaggatggcaaaacttactaagaaatcaaatccagcttcctaaatgctctgtggaataagactgtatatacatgaatataataaacaaagctaaggtttagtgttaatagccattcactgttttaaatcttttattcttttcttttaggatgagccagggcacagataaatgaaaatacatcattattgactatgcaaagatgactttcttgactcctaatcagtaagaggggcctgccctttacttttctggtgacgatagtaggcccttactgaactttcttcccatttgcttttcttgtaaccgaaagcaagatggttcactgcatgttgccagtaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagttatataggtgaagaactggactcatcatgaatgagaatggcttattcgtcagtggtactctggatttgttttaggttttcaacactttacaagtcatcttttctctacctataggctgctgagtttgtgtgatagtgccttcttttgtactgtttgttccttctcccactttttgtgaagaaagaggttgctgggtcacttgcaatagagctgtgactgtacagaaccaatcccactagtgtcattgcctagcttatctgtggggtaatgacgtaacttattaaagtcacacctcttcctcagaattgatagaccaaaaaacgaactcattgcgcagatcagattcttttcccaagtaattattaggaagtacaaatacttaattcctgaatttgtgaatcctggtggtttgaaattctttaatctgcatttagtagagttgggactatctatacatgtttgcattatgtaagtataggatattaatgaaaataactgcctctccaggcctttgaaaaatacattagatttttgctctttactgtgaaattcgatattgatttgttcctatccaggaggtatcagtactgtaatgtttaataaaaacttcattgtaaagtgggtttccctgacttcagaacctagggattttgtctcatggtcgctatgtacttagaagtcaatgcacagaagaaaaaaaaaaaaaaagaactctttaaacttgaaatgtttatgtaaataaagctgtcagtatttagaagtttgtctttgcacagggtgtgcataaattaagtgcatgtgtgttaaagatttataaaatgaaccacttttccagcatttcagcctgttaagagtttattccaggaaagaggaaaatcatggtctataaattctgcacttttgataaataggtcccatattctgacatcttggctcctagactgaaggtcaggggagaaagtacacaaaagagaggaatctaggatgaccgctaagttttggtttgggacaaatggctagattttattatatatatttatattttatatttaggttgtctcaactatataaaagagtgctcagagagagagagagagtgccggagtcacaaaaacagagagaacatcgggctccctgcatggagcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcaaggaaaggagagggaatcctgggatggctcccttgcggtttttagtagggaagtcagggtaggcctcaatgatgaagtgacagctgagcaaagaccagcaggaggtgatgtagaacactaattggacctgggtggggagggacgaacattccaggctgagggatcaggaagtacaaaggccctgaggcaaaggcctctttcgctggaatagctaggagaccagtctggctagcactgagtgatccaggggccaagtagtagtagaagagggtggaggggctgcagatgtgcagaggtcaatgaagggccttacttgcctttataagaactgtgccttttactctgcatgagaggggaagccaacggagggttctgaccagaggagagacatgatctaatttatgttttaacagatcactctgctctggggtctctattttttcattctattccctacccattagaggtgctaattgtagtttagggtagaatgggagagtcccatgaattggtgcacagccccaaacccatgcacacaattctccttccagaagactcaaagtaccagagctggtacttttgtagggccctagaaatcagggtattccagtctagctctttaaataacatgggcttactttagtttttcaggtttctgttgccaaaaggaagggagcaaagagattagctctagacttctgctgacaaaagattagcctgctgacaggttgaatgttttctaactttttttgggcttctaggtttttttctaatgattggatcatattttaaaagacatttttaccttccttcaacatttaagatctcatttattttctattttatttggctgtgtatctgctttacattcctttaccttcccccccttataataattttagtagaggtctgattattgttacctgttactaatgttttggctgtgaagcctcagggacttctctgttaacttgaataagtcttacagattgaacgattatacacatatgtgaccctataaatacccatagggtttattgtcctccctgcctttatagatacaggcttctctcctctttcatggaagctctccccccttttactgctctatcatctagttggggaaaataagtgttcctaaacacagattcccatggcaacataacaaaaaggtaatagaacaaatgtttattttgtctagctgctgtctgagtaacttcagaccctgaacacattggctcctgttactttgaatgatgttgttacagatttccttgttttcctcaaaacctctaggccttggtggtattgtcactgtgcctgtgacatgaaggaaggtatgtgaatatgtgtatcttactgtcagtctacccacaggtatgcattcgttccttttccaagcttatgctccggagtgggggtatcacgcaacacaaccatgctccccccccaaaaaaaagcaaaaaacataccacttatcccttttgttttcttatattcattaattcggtattgccatattaagcactgtactagatgttatgtttataaaaataaaaaaacaaaaaacaaaaaacaaaaaaagcagactgcttttgaaaaataccagtctagaagggacatgttacattgatttctcagagatcgctttggagggaggtcctctatagcttttcttttctgccttctttcacttaacttgccattttagttctacctttatgtttctaatgcttcctttgaaattttcttttagatttttttgtctcctttgactctgtcgacatactggtcgctttttatatctagggcaaccttatgcaaggatatgtgttggaaatctgtgtcagagaaacctttccatctgatgattcagatctagaaagtgatgacattaccatgtgcccacaacaggtcagaacttcttcttttgatctgcccagggctcagggaggctggtgtgttaggggaagcagggagctgtgagggcaagggtccctaatccagccctgtcttccacttggggtggtgtctctgctgtgatagtcttcacttacacattaagtgcccttaatcatgtgtgtcctgtgacacttagcttgaagtgtctggtttatgcaagtgttactgaattcttgttatttcctcatccttgtagtagatataactttattcccagaaataattgctttattctcaatatccccaagagatatttctttttttcccccctcttctgtcaaatccatctagggctttaggtagcttgtgctttcttgaatttagacttttgcataataagtttctatttacattttcttctccaggctaccaaatgctgggaaaatcttagttatcttcctcatttggtataataaaactcagctccgtaatgattttcatattaaattgaagtattgatgttagcatcttatattgataaatttctaataattttctcatttggatattataagtttgtcttgctttgttttctgttcctagtttagtgtgctaagtgccctatgctttgaatgatctgctttgaaattagcaatctgagtaagttaaatgatgtaaatgctaaagggggcaaaatgggaaaacagcaaattaagaaaaccgtattatgaatatctatcaagctgtgtttacattttcaaatataacctagggttactcaacctattgacattttgggtgggatgattttttttgttgttgttgttgtggggagcttgctgtcttgtgcattgtaggatatttagcagtatcctgtaccctacttgcaagatgccagtagaaaccccagttgtgacaaccaaaaatgtttctagatgttgccatatgcccctggggacaaaatcacccttgttgagaactacttatatagtcttatatatatttggattgattggccctgaggaaaaactagataggataacttgaaccttccaccgccaaaaagatagaaaatctatactttctgtggtggttgttgttgttgttgttgttcttcttcttcttcttttctttgttgattttatatattttcgagagagagacagcaggggcagagggagagagagaatctcaggcagactccatgctgagtacagcgcctgatgcagggctcgatcccaggaccctgagatcattacctgagctgaaaccatgagttagacatttaaccaaccgtgccacccatgtgccctgtctgtgtgcatattctttttcagttcatcatatgatatagtcttaacagtggcttcattcatacattgtgtttccaaatttgtccttccaaaccttatctcaagaatatctagccctttggatttcaagtctattgaaatgtaacatttcatacttttcctcaattgtttgaggatgatctcagatgtagcactaactactctagaaatagattgatcttataaacttgtatgattcagccttagagatgtagtggtgtgatatttaaagaaagctttcattagcactgatgaatgacagtggtcatgaaaattacaatcaggggatgagtgaatttttttttttttttttttgggatgagtgaattacctgaagatttctttaggtattaaggcaacgtgattttgaaagtttgaaatgtatgtgtatatctatttgcttatgtttgaaatatactgtagtgaagaaaatctgttggttatctgtcattgttaaatgccatcagtattaaaagaaatagacataaggggcacttgggtggcccatttggttaagcgtccagcttttgatttcagaaaagggtctttttttttttttttttttttcagctcagtcttaatctcagggtcatgagttcaagccctacattgggctccatggagccttctaatgaaagaaagagagaaagagagaaaaagaaaaaaagaaaaagaaaaaataagtgaactgtttatataaaaaggtattgatgtgtatagacatgtggaggcattgtgggctatagtagttaaaatggtatcatggaagaaaaaggattagaagtctattttgaaagaataattggagagaaggaaacatttttaggtaacaggagaaaacacaaccaagagaattagttgtgaggtggattggcctgacagcaagaatatctcaggtagcatgaacccagttgtggttctcattctggttgttcttcagaatcagttgtagtgtttttaaatacacccagaaaggaaggactaggtctggagtagggctaaggcattgcatttttctaggccatggaaagctgtttcttgaggttgtaaagtattgaggaaaagtattttattttatttattatttttttaaagattttatttatttattcatagagacagagagagagagagagaggcagagggagaagcaggcatcatacagaaagcccgacgtgggactcaatacagggtcatacagaaagcccgacgtgggactcaaatccagggtctccagcgattcgccgccctggggtcaaaggcaaaagggcgctaaaaccgatctggccggaggccacccaagggatcccccgcaacaaaagtgtttattttaaaactgatctgactggagtgtatagaatgatagtcaggaaacaaatgtgtgcttttaaaagtctttagtgatttgttagtgtgactgtctgtgtattctgactctccaactagatttctccactcctgagggttaagaactatctgttttggtatgtattaattaatcttgtgttatattccaaacactgggctagattctgaggatacgcagatcacttagagcttctactctccctcaaagtttgaatttggaaacaaataataaagggattttttttttctagttcaatatctgaagtcttggctacattatgttgctgattatagtcttagatcctatctaataattgctgaataatgtacattttaacttttggaaattatattttagttatccatagcatgataacaaatgatgaaggattttgtccttcatttatattttaatttctctattttactgtcatttcagaggtttactcaacctccaatttgagaataagagatctaaaaatatgtagtgagaatctcctatgtgataaaccccatgctagaagctgatcttgaaactattttataatagcatgttatttcaacttagaacatttaaaacgacctgccttttatagttcttaaagtgctatcacattattatcttatttgagattcaaaacagcattattgagataagcagagctggtgacatcctcattgtatttatttggaaacaggcttatagaagctttgccccagatcacctacagggaagtgccggaaccaaaactagaactcaaatcttttgactactactagtttatttttctctgtatcagactgcatatgtttatgcttagtggaattttttgagattaagtcatcaaaatactgcagagaccattcactgggaagcaaaagtagttttgttaaatggaattccagtgatttttctagagcagaaaaaagattcttttttttttttttttagaaaaaagattcttaaataatactcccaaatgtgagatatcttgaaaattctagcattttgttaagaaaaaaccattgctaagtgtaatgatttaaaaatatggccgtaagtttttttgatacttctcctttaaagaggtgtagctaatattcctcaccttcagtgaaggctgtacctaatgactcacttctctaacatacggaatctggtagtaatgatggagtgtgatttctgaggataggtcataaaagatatgtggctcctgtcttgttctttctctgaatgtttctctgaaatcacttgctctagagcaagtttttaaaactcagcaccattgacattttgggccagataattctttgttgtgaaggatgtgtagcagtaaccctggcccactacccactagatgcccctactgccaccattcccaacacacaccccgggtgtaacagccaaaaatgactcagacattgtcagatacccactgggtggaaaattgccctctgttgagaatcactgctttagggacagccaatagctacgttgagaagattccaaagcagccttacagagaagcccacattacgaagaattgagacctgccaaagccatgtgaggcagccaccctagaagtgggtcttccagcctcactcaagccttcaggtgactgtaggcgaaggccaatatctggactgcaccctcatgagatcccgtaagccagaccactcaactatcccccaattcctgactcacaaaaactgtgagatgataaaccttgtttaagccaccaaacttggaggtaatttattatatataatacactaaatgtactgtaaaatatatgtgtatgtcatataagatggagtcacagattgagcaaaccaaaaactgtgaagacacactcatgcctgttatacgcatctatcatcatgttcatagcatatatttgtagggtgtttttctggatatgaagcctataaacactgttactgtataagccttttaattgtagcagcaaggcaaagttgattgatggtaataataaatagttacaatagaatataagattagtttatttcatatttgcttgaaaagagttaaaaattagtaaatggtaactccaaaaacatttgttattgaaattttcaaacacaaaagtagagaagataaacccatggtgacaacattctaatgaagattgggaaaataattccatgtagtaaaataacccacatgtaatgtttttgtaatcaataggagataactattgctcttgacacagatgtatcaactgcatttgcaatcaaagaaatatgttaactgacaccactggcttttaaagcttcagtgaagaaatataaaatcattctattttcaaatagagcttacagcaattgaagattaattgcatttcacattttaattgtgaattagtttggatttttagattgcatgtctaaatgaatttctacattgtgtgaattttagttttcatcaggctaataaaaattaaagcaattgtgaaaaacatttttctccagtagcttagacgttttgcagcaggaattggatcaatcggaatggcaaatatctagcatatatgttggtgtgccttgaattccagccatatagctagagtccctaattaatcctgtcacaaatacattttcctatctgagattttcttgaaaatattcaatttacataaaagttattgaactattaagttgtgttaagacaaaatatgcagtcaattaaatgactctcttttccattctactaatctattgttagagctttttatatgcatttgtgttttgagcctttttgaaaggaatatttaaaaactgaaaagttgaggatcggttgtattgtacacacttgtaacagttatgttaatgacatctaatgttcttcccataagtatgaaacgaaagtccacataaaaatactatataggggcacctgggtggctcagttggttgggcatctgccttagactcgggtggtggtctcagagccctgagatcaagcctccgtttttgttttttttttgtttttttttgttttttttgagatcaagcctcctgactggctccctgctcaggagtagccagctttttcctctccccacccacccactcatgttcccactcactctcataaataaatacatatttaaaaaatactatatatagttgcagtagtcaaatcattttgtgattctttaaaagtgttatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgtttttagtcagttttaagtcccttgctgctctgaagactattttctttagtttctaaaatcaaaactcgagttctagtttttgcataagtttgccttattttcatgacattatttccaaaatggaggggtagaccataaaaataaatttaaaaactacagttatggttacacatttgtctggatttagaaggaagaaaaagtgggtttctgtagtagagggagatatgtgctgaaaaatgtttttagtatgatatttattgaaatttgtatcaggtattacaggtaaagagaaagttccaagttagtagtataaattacttatttagaaggtacattttaaaggctcttatcagttaacctgaactcagttagaaaaaagcctcaaattgtatgatctggagaagagatgtcctgtttttgcaaatcttttctttgccttaggtattttaattaatttgatgtattaatgagaatttgttaattcagtgtaactacaaattttaatatagttaaaattttccattaatttccaaaataaattatgtttattgttttaaccattattgagggttcattttttttctcattaacatcatttggggattagagaagtcgtctatgaccattgaaagaaattgtaaaaccgtctctgatccccacaaattactcagagacttgtcaggtgattgctcattcttcattctgttggggaaaacccacattcttttttgaggaaaaacctggtgcaatcatttgtcctcccatgctctgtggttgtgagcacttgtcctgggtaggcagcacctcacctttcttaagaggttgtctcttttcctctacctggcaactcacctgactgttacagtgtatcgatctgtctctatcttgctgcacagaaaatctgcaagccaggtgccagccatggagcagaaatacaaagcctctgtgtcttgatacttatcaaaagctcagttgatagaaatctgtctttggaggataatgtgaggaacatggaacttatctttttttctcaacacacttaagatttcctcttagattgtctgtcagagagcagcagcttgctatgctattatgtactctcctcctcacctttgctaataatgatctgtattttggttttatgaaacagtctccgctgatggatactctgaagaaaagaatcaactgaaacccacaattatgcttgtgtaagaatgttgattaggacatttttaccatgttatacagtgtctccttcataaacatacacaggaggaactcttgttttattacaggaataattatgcctctcttcagttctcctgagtgcctagtttgtttttattatatggttcttgtgacttatgtcttaactggttgtgttctcctgtcacgtgatggctttagtgctcagagccaaatttgaggcccacctctaatgggtatttagaaaggacctcatcataatcctttgtacattaacctcacccatatggaatttcttattttcccataatcactgttacttcaagttatatatagttccagactgctttaaatctattgtggaataaagtgggataaattttagaagttaagcagaattatattaggatatattaagaatctaataagccaatttttttggagggaaagaaggggcaagtttgtgtaacaaaacattcagttttatttagtgactcttgtctcctaggcactggattcatagcagtagatgagtgactgcaacatcctatattataatcactacttttaatgaattttatatttttcctttaatttttttctttgccatatcagtgattttataaaatgtgagttaattttataactttgggaaacttcatgtgagtttacaattggaagaaaaccttattaatgtatcctgaatttcagtttggagaacttaatcattgtggagataattccattttatgatgctgttcatgaaaacaaggttttatttgtagctataattttaaaaatgtgattaagaagcccaactggtaatactagtaagtgaatcattataataaagtcaaagtcaatagctgctcctagtgttgcccttatcctgggtagcttggcattctggaaaaagagtgaacattgaaatttagaccaatctgtgtttttgaatcccactgcataggagttatatgaccttgaatgagttgttaatgtttctgaccatttgtttcttatcttggaaagtcaatataactatctcaaaaagttattttaaagattacattaaacatttcccaaatgatatgtggcattatcaggtattcagtaaatttgaatttcttctcctctgaatatttaattggttttatcaggtgatttttaaaaaattattattaacttctgcttttggtaatcacaatgtccaatttaggacgaaatgcatagtttctcctctctccaaaaactgctttgattaatgatagtaacaggaggccaggtcagagcagttaaatgcttaaaaagatagtgttggggatggatcctatattccttgcttcagcagctttgctagagggatcattaactgataagcagaaaacagtttctctgaacaattcctgctagctcccttttgtaagcaaaatatgttgttgttttttaaaaagattttatttgacagacaatgagagagtataagcagggagagtggcagaggaagagggagaagcaggctccccgctgagcagggagtcccatgcagaactccatccctgggatcatgagctgagcgaaaggtagatgcttaaccaactgagccacccaggcgcccccaaaatatgttttaaaaagttaaagtgcatatcctttgatgtaaaaattatttgttctcaggaagttgtgcaattattggagaagcagtgtgaattaagatgtccattgtattagtatttattgtatttgtatgaataaatggaatggctataatgtccatcaataaagagaatagttgagtagattgatgcagatatttaatgaaattactgtaaatgcttaataaaatggaaaatgcttatggcttaaggatagaggatacaaattatgtactatgagtaaagctatgtaagtattatttgaagaaaatatgttaattgtagttttattaaagttagtacctattttttgtttaaacgtaacaatatagatgatttatgcttctattttactaataaccttattaaaagatacaagctcattttttgaaaaatcagaggatagaaaaatataaaataaaaatgttaaaattcttaatatattaagtattttctgtgtatgtttatatatacatgtatgaatatacatttttccacacagataggatcattatttctgaaacttgttctcgtattagtactatatggaggttcttgttaatggcttcaatatatatgggggaatgtaccataatctaaattctccccttggacattaaggtcatttctgattttgttcttatgaacagactgcaataaacatatatatatatatatatatatatatatatatatatacatatatatatatgtagattatatttgaacccaagttacatattttatatgtaaattttaaaacacaatttacatatttttgaacttagctttttaaaaagtagtcaattgtatatagttgcactatattattaggcattctttgctttcatgtgtattttcatcatctcagttagatggtaggctctaggacatcaggtgcaatgtttaatgtttcttttatattcacaaaggatgttataaaggagattatttcagtaaatactcagaaatggtattttggtctttgtaagatcatcacatcattgcctcctccagtgttctagattcacagagagtagtagaactttagggattgaaaaacttccccttggggcgcctgagtggctcagtagttgagcatctgcttttggctcaggccggggacgccggggtcctgggatcgagtcctgcaccaggccccacagggagcctgcttctccctctgcccatgtctctccctctctctctgtctctcttgtaaatgaataaataaaatcttaaaaaaaaaaaaagaaaagaaaaacttcccctaaataaagtaatagagtgaaagttatttcactatattactactctatatgcatatagagtgaaagttatttcttatgaaatacttttcattaatactatcctgagttcaatataaaattacaagaaaaacttttcccatatgaaatgcaattaattatagtgagaagccttttagaaaaccagagttcatacatttagaatatatttaaaatgggcagaactttttgtaaagttgtacttgattatccattaagagttctatttagagatctattgaggatacatttaatggcatccattaaaagtcaatgcttgaaaacacaccagttgaatctgaatctccgttttgtgattttctttctatatcatgggcacattacttctttgtgcttcagttttctcatctgtaaaatggaaatcataatgtctttttataaagttgtgataaagatgctcattcatgaaaagatctaaaaaacagtgccttataatagtaagcactcaatgattatagtttttgacattaatgttagtttcttcttggatgctgttgaatttgtttttaaaaagattttattttttactttattttatttttttaagattttatttattcataacagacacaaagagaggcaaagacacaggcagagggaggagaagcaggctccctgcaaggagcctgatgcaggattcgatcccgggaatccgggatcaggccctgagccaaaggcagacactcaattgctgagccacccaagccttcctaaaatattttattttttatttttatttattaattattttttagacttttatttatttatgagagacagagagagagaggcagagacataggcagagggagaagcaggctccatgcagggagcccgatgtgggactcgatccctggactccaggatcacgccctgagctgaaggcaggtgctcaaccactaagccacccaggcatccctaaaagattttatttttaaataacatctatacccaatatgaggcttcaacttacaaccccaggatcaggagctggatgctccactgaccagctgggcacccctgcatgcccttgaatttataaaaattgagagccaaataataaaattgttttttctttcatgtttcagataaccacatcacaaaatactcgtttagcattttttgagaatgtgcacgtgccaggcattatgctaagtcctgtggaatatagtagtgaataaaacagaaaacactaactgtcctcaaggtgcttatgatgagtgggaaagacagacattattaatgtctaataattaagctttactatgggctgagcccttttgctaaaactaccacaaaagttatcacatttatttctaacattctccttattagatacatactttatcctcattttatatataaggctgagagaatttaattaactttcttaagattatacagctactaagtggcagaactgaaattaaaatccagatagactgggggatccctgggtggcgcagtggtttggcgcctgcctttggcccagggcgcgatcctggagacccaggatcaaatcccacatcaggctcctggtgcatggagcctgcttctccctctgcctgtgtctctgcctctctctctctctctctgtgactatcataaattaaaaaaaaaaaaaaaaaaaaaaaaatccagatagacaaataccaaagccccagccttcatttaaccactttgctgggtggaaaataaacagaggaataaattgtgattattgagggtaggaactgattaatcctagcctacctttgctataagagtcagagataaaataactactttattactgcacagctggcatggagaatggcatggacaggcatctcagcgggacttcttatttcttccccactgaaatgaacttgcacattcagtcacgggcaggtcagctagaaacctgatggcattccttgctccaggagatcgcaaagggcttactggtggaggaaaggagaacatgcttagcctgcatgcaggtgggcagagcaaactgaagtggagagttgaggaggatgggtcacagggcaatggccattttctgtctcactagaaccatagaggggtttagagaagaatatacatttactgggtacttccaggagggaagaggttattattttatgggtttgtgggaacagcagtgggagggaagagaacacctcctcctccctttatgtaggataaggaaggaaacaaggatgttgtgacaattactgagacctgctgataatctctgagagggatggttatttaagccagtgcgttaaggatgaggattcagcttggcatggagtggagatgaaaaagaagagcagctgaggaatcagaaacagcctgctgaagagctaaaaggagccagcatgttcaaaacgtagtggctgcaggaaaggaagaaaggacacaagagcagggtgagcggtcattggtgatcagatcacctgagccttgtagactgtgataggaaatttgcatcttattttatatgctaaggaaatttccttgaaggatttgaggcagtgggttttgtcatctaacatttttattatttatttattattatttttaaagattttgtttattcatgagagacagagagagagagagagaggcagagacacaggcagagggagaagcaggctccatgcagggagcccgaagcgggactcgatcccgagtctccaagatcacgccctgggccgaaagcggcattaaaccgctgagccacccaggctgcccctaacatatttttaaaagattgaattggatgcttgtggagagtatatgagaagggaacaaaacaagaggcagggagaccagtctaagaaggcaggctgatgatgaggatggtttggactagtatggtagtagcaaaatgaagagaagttgaattagagatgtattttggagatggaaattatagacttgctgatagatttagatgggggccaggagactggaggaaagggaaaaatcaaggatgatacccaaatgcctggcttgagcaatcggatggaaagtctgtctcctgagatacaagagacagggagaggaatagttctaggtgttttgagcttgctaagttttaaggtgcttatgtggttttcatatggagatgttagggtgggcagtcaggctcagagaagagatatcagtgagagatacatatttacaagttttccatataagatgacatttaatttaaagtcttggttatagatgagatgatctggaaaatgtgggagagaagagggcccacccagtgtcatgccctgaggaactgttccagcagaggaaccacatacagtggggtcagagagggagcttccctagaggtcacagaaaagcagtagaatgtgtgatatggactccagaatggagggtgtttagagaaaggggaaatgttaaccatgtcagttggtaattcagaaaagtggccactggatttagtaacaggtcattaatgacctgagaagagcagtttcagtataatggattgaggaacgaattggagctgaggaaatgagtcacactttaagatacatatgaattacctggaggtctggtcaaaatgtaggttctactttaaggcctgagattctgcatttctcaggagcttccgataatgccagtgctgctggtccatggagtaacaggtagaagagaggtttttagacttcaccatgtgttagaattatgtggcaggcttgataaaatacagattactggacgcacttcagttttcaattcagtaggtctggggtggcacctgagaatttgcatttcttacaagttcccaggtaacaccaatgctgctggtctaggaaccatactttgaggaccattggagaattttaactgtagtggggagctttcaggggagatttgtttgtttgttgaggttgggaaataactaactctagcttatttatgttgatgagaatgatcgatccagaagatatggagaaactcagaaggtagagagaaagagaatgaaagagagaagtccttgagaggatgagggaggtggctccagagcatgtattgaggtcttgattttttttttttaaagattttattcatttattcatgagagacagagagagagagagagagagagagagggaaagagagagatgcagagacacaggcagaggcagaagcaggttccatgcagggagcctgatgcgggactcaatcccaggactccaggatcacaccctgctgaaggcagcgctaaaccgctgagccacccgggctgcccaaggtcttgatttttgtaagaaagggcatgtgtccttagttaaagcaagagaggaagcagaaaagatagaatcaagtgcagatgggtttgtacatttactggtagataaatggagcttccttttgctggtttctattttctcaatgaaggcaagggcagctttggaaagaagagggtgaattggaggtttgaggagaaagaccatgtcaaatgatgactttgagtaagaaaatgagcttcctagaaaaaagcggtagtcttaagagctgtatttgaggttaaggtcaggaattgagagtgaaaccagtctgtatggttgtacattagtttttcttcaacctgaattagttcttggattcagacaaggagaattaaatagttgtgatcacccaaagttagactttatctaggtgggtgtaggaggcagaggcaaagacagagacgcaagggagcatataatctgagccaggcaagaagggaaataaatgaagatgggagagggcatgaaggatggatagaattagccaatgatgatgaggtccacaaatcgttgtagtcatacatacttggaagtaaactagaagtaaactaaaaggcacagaaggtttgtgatggaaaatgggtgctggcattcaaaactgtgtaggtggggcagcttttgatggtgatagaggtccagggtgtgaccatggaggtggctgggtaaggtggagtttcctggagaggtcaggaaattgagaggccaggatgttggatgtgtcctccacctgggtgttgaacttgccaagaatgatgacagaaattgggagtggagagagactttgagataggaactaacttttcagtgaataatggaaaattccaggtcagtgggttacagcagcagagaggtagtgatagctgtgagcaggggcttttgtaaaacaaatgaagaattatagtctggaagtaggaatggttggcgaggaggacatttgccccacctgctagccacgaggtacctagaatagagagaatcccctgtaagggcagggctgtaagagaagtagtgtcttccaggtagagcctagattcaattaaagaggtggaggtgaggctcagaaagggggttggagatttataggaatttgtaacaaattggaatttgaagagcaaggacttagtctaaggatttgggagggaaaggaggggaacttctggaagtacagagtcacatgggaaaagagtttggtcatgatagatgatccagaagtcttggatgcccattcgagactgagataaacaggaggatgaggcatgatcagattagcccagtctctaaaaataattaaaatacacatcaagtttcttgctgcagttgtcctacaggatctagcctctgcccatacctctgacctcattcttttctactctccctgtgctcccagtgttccacctacacaggccatctttacaccccccagcatgccatattttttctacctgtttcttctttcctttgtttgtacttgctcttctgagaggcggcatggcaaaatggttaatagcatgagctgtggatccagattccctcctcctgacactttcaagtcttgtgattatgggcaagttatttaacttgtctgtgctttggtttcctcatttctgagtgggggaatgatagcatttacttcataggggtgttggggattaaaatttattttaattaaaaaaattaacagttaggcctggaacagcttctggtatgcaataaagactcaataaatgttaatacaattttttccttctgtttgaagctctttttccctatacctctacatggttgctatgttctcatcattcagttgtcagcttgaacctatttgctcagacatcctagctaaagaagcaaaaccccactggctttctctcatttgtcccattattctgttttatttcatgatagcgttcatcactatttgaaattattgtattattcagctcattccctctcccccatcccctgagggatttgttgacttgttccttattagatttttagcttctgaagagtggcagatactttgtaggcactcaagaagtttttgtgccacctcattgtcctgaaaccattccaagccctccattctgatcaacatttggtggcaaggtgataggcctgaggcagacagaatccaggtctttgtatattggtctgttggctcctgtaaatcaagtggccgcttgtttttgtgtttgctgggacacagctacatccatttttaaaatttattgtctggctgctttctggctataaccacagagttgagtggttgtgctgaagaccctatgcctcacaaagtctgaaatattttactctctggtcctttgtggaaaaaattttctgacccctgatttaggtacctagaaaagaaaatgagaaggaaacaccccccaaaacaacagatggttactttggatagcaggattataggtcattttagtttttaatctttatactttgtattttattgtataccaatttcacttggaaacaaaatagccttccttataaatactaattttgaggtatttagagcacattccttgatgaattctttatatgtgcttttttttccttagtgctgcttttgacacaaaaactgggttacgtgtggcagtcaagaagctctccagaccatttcagtccattattcatgccaaaaggacctacagagaactgcggttactgaaacatatgaaacatgaaaatgtaagttattcatacaaggaagaataaatgctgctcttgaatagactgggggaaaaatgtgttctgattactgaaatgagaatacatgagaatgcatcgaactttggaccattcttctggtaccagggtgtttgtggccactgtgttatgccaggtagccatccaaagccttgggagttcatgggtacatcttcctggagtttgagttttactaagacagttttagagggaaagcattagccaacaaaaataaaagcatttttaagagaaaatactacaaaaataattttgcattctttaccagatttacttaatattgtagtgtccaaatatgggactctaaggttgttttgtgttttaatgggttatttcagtggagaagtttgagacaacttgccttaggcccactgaatgccctatcaaaggtgactattaatttatgggtgatttgatataattttcctttttaatcttttgcagtatagcttttccagagtcaggtattttaataactgtgacaaagacattgtttaagttaaatataaccctttcttttctgtcaatttgaaaatttgagagcaatgccatcctgcaaaaaaaccctaatacaatatataaagggatgcaattggaataatagctgaaagtgaaaagacagttgacaaaggatacttactttcctaaatttcaaaatcaagttaaaaagaatttatttgattgctgtatgaaagaaactgtaaaatttgtagcattgtagaaacaatgaccatagagattttagagtcatttgaccgtattgattgttactgtatagaaaaaatattcaaaatgtgtaaatttattacttggctattcagatcttttctgttttaataattaaacttttaagaatatctttaaattatagataaatgatactttattaatatacagttgtttaacaaggtacaaattttttctaaattgggagcattgagacttgaatttatttatttatttatttacttatttatttatttattatttttaaagattttatttattcatgaaagacacacacacacacagaggcagagacataggcagagggagaagtaggctccatgcaggaacccaacgtgggacttgatcctgggtctccaggatcaggctctaggctgaaggcggcgccaaactgctgagcaatccgggctgccccttgagacttgaatttagaattggattacagaaatggtgttgtaatcacaggagtagcttatttattttcatggtttattttaattgcatactattgagcaaattctgtttttcacaggtaacctttatacctaggtataatttttatgtgcattcatgtgcaaagctgagtttttaaaaagttcagtagagctgcagccttcctaatcagtgacatgtttacaagaagttgagatatatggaaaaagctagcaggagaagctttattccaaggtctgcatacaatcaaggtggcctggtagcttaactgatgtgtttacatttggtttttaacacagttgagtgtgtatgctgtttttcattacacattaataaatatgacaaagacattatcatagctttttaaataagaaaactttgaaaatggaatgcaagcgaaacatttatggaaccccaaagcactttcaggaggccctgggttcccactgatgttgccagtgctcatttacaaacatctggtttagattaccagcgctatactttattgttctgcttttcttcatagaccatttaagccaatgtttagggcaaagattattttgggttatctgaatccatgccttggcttttctagtgatcataagaaacaaccttatttagtttattatgctctaattttctgtaatgagataacttcaaaatgtgtcttctgtggtattaggttggttatgtgtgggtcactctctatttgtagaaatgaagatgccacactgatgggatacaattgttctaatttaggaagggctacaagaatctttattttttaaagatttatttatacatgagagacacagagagagagagagagaggcagagacacaggcagagggagaagcaggctccatgcagggatcccgatgtgggactccatccaggaactctgggatcacgacctgggctgaagggagacattcaaccaccaagccacccaggtgtcccatacaataaccttaaaaaaaaaaaaaaaaaaaagggcgggctgatggggtgcctgggtggcacagtcagtagagtatccgactcttggttttggttcaggtcataatcttggggtcatgggattgagctctgtgcttagtggagtgcttggaactgtctctccctctcctcctgccccatcccattgcacttgttctctctctgttctctcactcaaatgaatggttaagtctttttttttttttttttttttaaagagggctgatagtattaggaaaacaggattttaacttacataagttgtttcataagcagcttgtttaatattaatagcagttggtcttttcatgttaacatgaaaaggttagattttagcagtatcaatgtagagggtcatctgtacttaaatattggtgatttggttttgaacaaaagaaggcatatggctgaatattttatagttctctgttctgttaggggctaacagactttgactcaatataggaaaattcctgaatgtcagcgtattccacaaacattttttaggagctctccatgtcaaagtagttttacctagggaagaaccaagacttccaaataaatttaattgaggattttaagaggagttcctctccttcatcttcctttttctcttcctctttttttaaaatgactcttttgcggggcggggggggtggggcgcctggctggcccagtcagtagagtatatgactcttgatctcagggttgtgagtttgagccccatgttgggtgtagagattacttaaaaataaaatctttaaaatgaatgaatgaatgagtgactcttttgggccactgtacaatttttaactagccatgaggcctccaaaaatagcagcttaaaactcttgacaatattaagtactggaaacaaatatgatttctgggtgccaaatgcacatgtcatgttttacacaaaaatgcctgactcagaatcaatggctcatcttaagttatttcattagtattaatgaatgacagacacacatttaccagatgagtaataggagctaaggtatgtccctctgtggctgtaagagttattctctgaacagagttagctggtgcgttcttgattggatttgtgaccttgatcttattaacacctgctctaaggaaagatgaaagggaagcatcttgccagctacatccttttgctttctcggtaggtactgcaaagattgcctggagttaagggcctggagatctgtactaaccaaactaagtcaatgttttgctgcacttgtctttggtgactgagctaaagtgggtttttttcttgaatatgtgccaaattagtaaaatcatatgacttttatgtctgtcggtttttggaccattataggatagtcatcagagacatctgctgattattttcattataaatgtcttttctaaataactgactcctgggttactttggggtgtctaaaagcatataatggaagcaaaagaaataaagaaataggtaacacataacttgaattagaaggaaaattccatttaagaaatgagaaatgagtagattacggaatattcctataagttcccagacctattttaatggtgggaaacttatttttacagtattttccttttgatgaatactccataaatacaattgatggagaagggatatttgtaaaaggccacaaaaaattaaagatgcttgatgtaacatgggtagttttaatctcatacaatgtgtccttttttaggaaattttttttttctttcctttttttcttcacttatgaaagtcacagagagagagagagaggcagagacacaggcagagggagaagcaggctccatgcaccgggagcccgatgtgggattcgatcccgggtctccaggatcgcgccctgggccaaaggcaggcgccaaaccgctgcgccacccagggatcccccttttttaggaaattaaaatttgataggctatttactaatgtgctggttctattattattttccaaattagtttattgtgctgcttgcagtcatgcttcttaatcatcttaataatttagcttagctttgtatctcaaattttgttactggaggtagctgcttcagagagtttgtttctgtgatttgtattctgtaattctttataaaactctaaggattgtgatcaccacttattttggtcatcaacagagggtcagtcctttggactgggcaccttcagttatattgtctactcaatattccccacaatgcgataaaaataagcatctccctttatttcatataaggacgtgaggctcaaagaagatgtgtttctttcatttacttaataattgaggtactgtatgccaggcatattccaagtgctggattattggaatgtaagttcatgggtccaggaaatcacaaactgactgtagagttcagacttaaagctgtttgattccaaaatgcttatgttttcacattgaagttggagctgttatttgaagatgttctggacttactttgttttactttattttgtcttcaaggtaactcttacatgaagagtcctgtgtaaattgatctctagtgatttactcttttatctgagaattttcacagcacaattgaaataacataaaacaatgtatattgctttaaactcctattgtatttggggagttgcagcatctcacataataagaaccaatggttagaaaatattggaacagtagaaaaaaattggtttctggatctcagttacctaaagtacaagtggggatggggatagtaataaaaagaacagaggtcttaagccagaattatatcaaactcagtgaaaataattatggtttagttggggaaggtaaaagaaaatgatttgacttaagtttaaagcactgtacagacctgttccaaagtcagggatacactgttggtaggaatgtaagttgacctcacctttatgtagaacaatttaacaatattaagatccttaaatatattggtgtcctttgatgctataattcttttttttttttaaagattgtatttatttatttgacagagagggcacaagcaaggagagaggaaggcagagggagaggaagcagcagggagcctgatgccagcagaacttgatctcaggatcctggggtcatgacctgagccaaaggcagatgcttaaccaactgagccacccaggtgccctgtagttctatttcttcaaatctattttctgaaaggaaatacaagatgtgcaaaatatgtattacatgtacatatatacacatatgcacacttgtatgcatacacacttgcagtgttccttaaatgtccaaagataggaaattggttaaattagggtatatataagtggtagagcatgaaaaatatttgaagatatagtcattctatagtaagtgacaaggcaggatacaaaactgtgtgcagagaataaccccaactttaacttatgtacatcagaaaaatcaaaggaaatatctcaaaatgttaatgatagttataataggtagtgcaattataagtaattttgattttcttgtatacagttgtctgggtaataatcttatgggtaactgtatttttcttttggaataagatgcaaagtcttgaaaagctattctctttgacttccaaggccttttttgggtcttgtttgccttttgggttcaggctatataattgaaattgcttaaaaaaaaaaaaaaaaaaagaaattgcttttaaaagtctgataggggatccctgagtggctcagcggtttagtgcctgcctgcagcctagggcgtgatcctggaatcctggggttgagttccgcgtcgggcttcctgcatggagtctgcttctccctctgcctctgctctgcctctctctctctctctgtgtctctcgtgaatggacaaataaaatctttattaaaaaataaataaaagtctgatagataaatggagtaacattctaattaagagtgttctttttcatgataatgttttgagcagtggtatattttactttcaggtggtttgtttaacttgctaggttagagcagcatgctgatgaggcccagtcatggattggtgttcatgaaggccatttagcttttgtttcatttctagatattcttttttttttttttttaagattttatttatttatttgaaaaagagaggaagagaaagtgaatgagagggagagtgaatctgaagctgactccatgctgagcacagagccagatgcggggcttgatcccaccacctcgagatcatgagctgagctgaaatccagagccaccaggcaccccatcatttccagatattttaagtctggttttaggagttactggcagtggttgaggaatggtagtgtatatatggattatccagtatatatccatgatcagaaaaactgctcaaagatcatggataaccgagtattaaatagtttttgctttctccttgtataagcataggctttatcttttcatttttaaatagtctgatctaaatacctgatgatgattaagaaaagtgtctgaatattaagaatattacatgaagggatgccttgtggttcagtagttgagcatctgcctttggctcaggtcatgatcccagggtcctgggatcaagttccacatcaggctcctcacaaggagcctgcttctccctcagtctctacctctctttctgtgactcttatgaataaataaataaaatctttaaaaagaaagaatattataagaataacaccaagaataaactaagagaacgttttgggaccaaaaaaatatcaatcttgaagactacatatggaaaaattttcatggagtaataatattatttaagaaagaaaaatgatactatagtagtagctgtagaagtgtgacttttttttgcttgttaatcattagactgttggtgcattatgtaagtcaagagccctgaatcttcctgcttcctgataaatggctatatgtgagcaaattctaaagagatgatgtctttaaaagtaaaatacgttattatggaattgatgttaacaagtaaaaatcaaaagcataatttggataaaagaataagttataagttaagtgtatgatgctgtgatgtcattgaactgagattgtagaatttgaaattatttcctattaaaacggctaagacctgatgggtactacagttctgtatttatttactgtttgatttttctattttctcacaggtgattggtctcttggatgtttttacacctgcaaggtctctggaggaattcaatgatgtgtgagtgaatcttttgtatttgccttcctcagctggataatgaagattagcagcccacttttattcctgcactattttgcagtatacagacttgaaaaaattctttattcctaccatccaactctcctagggaatggggatggatacagagatgtatattatgtgtggtgtaaatccacaagggaggggtggccccccaaacccctgcattgttcaaggctcaactatgtattagtattttcataatttcaggcacattgtgaagattcagcggtgagtccttgcaggagttccatggaaaggagcgtagggagtgttgattatgatttttgtcctcaagttacctgtccccatttttatttttattttttttatttttttattttttattttttatttttttttaatttttatttatttatgatagtcacagagagagagagagagagagaggcagagactcagacagagggagaagcaggctccatgcaccgggagcccgatgtgggattcgatcccgggtctccaggatcgcgccctgggccaaaggcaggcgccaaaccgctgcgccacccagggatcccgcctgtccccatttttaaagagacaccttcacacttcacatcattatattcacatcaagaaatatagccacgccctggttccatataaattcatctctctcttttgtcctagttatgtgtggaaatggtactagacctgcatgctcttccttgaagtaatagatttctgttttgaaacaaagggcaggtctcatgtattaagaaagctacttacatagtgctagttctcccagtgctaacctgagagtcttaggaaccagtagtggaggtttgggaaaatgaaacaggagagaaagcagctatgaggatgtttatttagtaggtaaccattgtgggtgactgtgctgaaaactaccaggatcttgtaggaaacagtgtgaatgcacctcagatagggagcatttatcccttgaccctgaccccactggcaagggtttgctccagcgggcattaatgccatctcatgtccaggttgcacatgtgtgagatgtgtgagtacaagatagattccagcagatgctctcatgcatgtaggagccgtcactgtagctttcccagtatctgaattagcagacctccctcccatcagatatactataccataacagagaaggaatagcttaaattcagagtagtacattgacattttggaattcctacctggaaagggttactgttgtgaaaatcaaaacagagttgcagatcatgactgcttctttctttctttttcttttatttttttaagattttatttatttattcatgagagacacagagagagaggcagagacacaggcagagggagaagcagccttccttcggggagccggttgtgggacttaatcctgggattccagaatcacgccctgagctaaaggcagatgctcaaccactgacccaggcgtcccatagctgcttctttcttaacctctaccccctccccaccattgtccccagtcctgaacttaactggcttctccctacccttatcctgtgtccagtttctcctacctttatttgtcccaggctgagtgcaagcatcatttgctcttttcacagagaacaagcagggggatatgtttgagcttgtgtgttttgtctaatgaaaaggtgaaagaaaaaagatgaaaagaaatgtagaatatgaaatgtaaaaagaagcaggaaaggtagcaaaaatttttccccatcttgtgaacttagttggaagataatatggctgagagtagaagatgaaagtgaagaatctggcccaagtatgagaatttctatccacattaaccttgatcctgctaatgaaagtttaagaaacaagtaaagggaaaaataggtaataaccaagaacatagagctctgcttggccctggaatatagaggcttccaaagattatcagatgctacccagccagggcacatggttgcaaattgttgagccctgctgcagggtatatttggaaaagaatattgcagaataatgtttttttttttcctttaaaattaatttttagggatgcctgggttgatattttggaattcctacctggaaagggttactgttgtgaaaaacaaaacagaattgcagatcatgactgcttcttttctttttcttttcttttcttttccttttcttttcttttcttttcttttcttctcttttctttctttctttttttaagattttatttatttattcatgagagacacagagagagaggcagagacacaggcagagggagaagcagcctccctgggttgagcatctgcctttggctcagggcgtgatcctggagtctcaggatcgagtccctcatcgggctccctgcatggaccctgcttctctctctgcctgtgtctctgcctctctctctcatgaatgtgtctgcctctctctctcattctgtgtctcttatgaataaataaaatctttaaaaaaaaagaaaattattcttttagagcatctttaactttacaacagaatttagagggaatgcagatttcctgtatacacccctgccccccacatgcatagactccccccttgtcaacatcactcctcagaatggttcgttctttctttctttctttctttctttctttctttctttctttctttctttttctttctttctttccttcctttctttctctttcttctttctttctttctttctttctttctttctttctttctttctttctttctttctttctttctttctttctttctttcttgttatgtcatgtggctcaccttagtgctgtaattctatggatttggacaaacatgtaatgacatgttaacatttaatattgtacagtgtattttcactgccctaagaatgatgggttttggtattttccctagatgtggaagaaaagctgaagctgaagtaatgtattcgtgaatacctctggaaaacatttaaatcaagtctgagctatactctaaaattttgggtctcatgaggatggatttatttaacaaaggagttggtgaattgccaacctgggaaaatgctgtattttagtttaatcaggcattctggaactggattatgaacctgtgttttttttttccatgtgaaaagatcttatttaaggctaatgtctatttgaaaggtgaagttttatccattgttgtgcctttgggtcctttatccgtttgaaggcccactgactacaagcatactcactgaactaaagtcgcatttatttcttcattcactcagcagatattgttgctacggagtaggaatctgttctttctacttaactgtacctgggttttggccatttgtttattaatttccaactttattttatttatttatttttttaaattttattttatttatgatagtcacacagagagagaggcagagacataggcagagggagaagcaggctccatgcaccgggagcccgatgtgggattcgatcctgggtctccaggatggcgccctgggccaaaggcaggcgccaaactgctgcgccacccagggatccctatttccaactttattgatatagttatagttacatagaacattgtgtaagttgggttctgattatttacaaaacaagaactgagttcatctcttgggagcaaatctcagtaccacttgttgaatgtttgctgaacaaagtgttagaaaaagcctccagataatgggaaacaccactctttccccttaatgaaatcaaaatcttactggggaaggaagtaaattcaaaacgcttttgtaaccgagttaccaattgggtgtaagaccttggacaagccactttgcctctctggactccagtggttctctaatcaagcctcataggcaaatgatgaaaattggggtggtagatttctgaaatgattttaatgctgaagaacctctgaagatagaatgatgaacctaagtttgcctttagaaaatgtttcattgtttgtttttctatgatgtttgtattactggaaaaaaaatagtacttgtccaggactgtggttatttcagtgttttccaaagtcatttcagactttgcataagagaccaaacatcttcacttacaattgcaaggtttgctaatttaaataacttttgggccagataaataacataaatgaggcttgtaaccctgtattctacaactgggagtggtaggatctgtggtaaaacagaatattcgtactttcttaaagcaatcaaattcacattaaaacaaaacaaccaaacaaacaaaaaccccagtattctggccaaatccaacacgctgaaggctagagtggttctacaggttagcaggtctagagctggctataattttgaacatgaatttttcgtgctaattaataaaatctctagttacttttcatattaacagtcagcttttaatcatgtgttatgtgtatttgtgcctttaggtttcagttagcacttttatcatacaattaaaatttttactgaatttttaacctcttggttaataagcattgtgcatacttcatttgtaagactcttacttttgagagaagaatgatagtgagttttggtcattaggaacaatgtgcagttactgactctaacagagatattctttggaaaatgtggaattaaaagatgagtatatcaagttgttcttgactgccatatgatgtggttgcacagatggcaaaattttatagagatatatctagaccttttaattgattggaaatcatttggacattcctattggtttcttgatggtattgacaggaagtggcatatacatatgcacactcatgctgtaaatatttagttaccaatagaagtccaaaaattttaaatggccagtattagaacctaacctctattgtaagctgcacctttgtggaacagtattgccttttcttagttatagtggttctctgatcaagcttaggtagtgaagagtttttgggcttggagctatttcctcaaatttcaggaaaactgaattgtcatggtaagcggaaagcagtccctatttacccctttttcccttttttttttttttttaacaatttcatattgcaggtttctcatacctgagttgcttctctctccttagttcttgaagaaggaaacgaaaatatggttttagattcttctatgatctagcagaagaccttactatatggttggtcagcagccattgttttagtggaaaccagtgggcagagtatcacctagtttagggttacaattgataaaaatgatcgtctaaccaataagcagcctttttttgtcagtataaaagttgctaagcataccgaataggtaaagggagtttctggatttacatttaacctgacttcattcaatatttgaatactcatcctatactgggcataggactagtctctgggggatgtaaacatgatccctaataatagaggtgagactcctaatgagagaaaagaatattttaaataaccaaacaaaagacagggtggtcagttctggaagatcctacatgatttgttcctgtgcactctctgatctcatctatgttctttccactcgttctctacattctagccactctggcggctttgttcttccttgagtacagacacctacattttcagtaggacctttgccccggtttcaaacattggcctgaatactccctgccatatccatttgactggctcctccatttctttcaggactctcctcaaaggtctctttaccacaagctctttccccctcaccaccatagctgcaatctgcctccactgtcagtgtctgctcctcactccactctgttcttagcatattttaacatcctatgtttgttactgtgtctttggctaaatctatttctgatcacgttttccttgatccagggctacgattattatttgaaagtctgctaacacttcttgttgagtaaatactgtgatcggttctatgtaagctgtcaaaacgaaaggcattccagttgcaatgtggtacctgtttttcatgagagaaagcataattgtttgcctaaaacaactaacgatcaagtcaaatttgtaatgttgaggcaacacatagggtattcagtgatatcagaatgtgaaagaaatttagtggaggaaagcctctgtagaaggtaataactatatttgaagaaacagataactatggatgggacatagttgaaatttatcccgaagaaatgaaggaaacgtgtaaagtgtacagaaaaagagattagcgttgaatggagaatattaaaggagtagataatcattgatttttcttctatatttggataaaaagtgtgtactaaattagcaaataagcattatctacttggaaataatgctttcttccatagctgtgaaagaaatacccagtcttgtttgggcttatagaaatacttttattctttgaaaataggctgagtgcccaagataggtaatagaagagaagtagtctaggagaaagatgaaggaggtgaggctccttgtagatgccttccctggcttacacttgaaaactgaataaattacaaatcctttaagaaaataccattgagtttttgtctgacatgtcagtaagatgcctcttttttgtcagatgaggtgatttcaagccatctttccctcattaactccttcctaagtctgggttggggccctctcctctatgttctctagcaccttgatgttccctttaatagttctaatcatgctctattatgattttctatttgtatatgccttcctttcatctttttcgtcatggcatccccagtgctcaacagttaatatttgttggtggagtgattgaagaaatgaccttgtgctgtcttgtttataactggttgatgacctaatttttctgtagtacactcagtgcattctctttcaactagcttttttgtttttatcctgtaatgtagaccatatggtagaagattgagtctagtttggttaatgcaggtaatttagagggcaccacctctcagtaatctttgtttcaaatgagaatagtttgttgtgaaataatctgtctacctgggtgctaaatggtgcctttacttcttacattagaactgtctggtctgctgaccagatgagatcgttggtatatttcttttttttttttttaagattttatttatttatcatgacagacacagcgagagagagagagaggcagaaacacaggcagagggagaagcaggccccatgcaggagcctgatgtgggactcgatcttgggtctccagcatcatgccctggaccaaaggcaggcaccaaactgctgagccacccagggatcccgcgttggtatatttcaataaaattctcttgctcggtcttactagtaattctatttgaattgtcctgggtcattcgattacattcagtagtaattgagtggttactatctaccagacaccattctagttcctttaaaggacaaagaattttgtccccttgagcattgtacagatagataacaataagcattgagcatttaaaaagttagatagcatattagcaggcaataatgctatggacgaaaaaagaaaaggtaaagtaaggaaggggaattaggagtgtgagagcagggggtgagatccatttttaaatgggtggccaaggataggcctcattgagaaggtgatttttggggcagccttttgaaggaatagaagaattagacccccaaatttttggggggggggggggggggggaagagcgttctaggcagaagtgcattccaagcagaagaaacgaggaatgcaaaagtcctgaggtggaagactgctgaattggaattgcagcagggggtctgtgtgcctggagcatggaggccagtatggagctaaatgagaacggagcagggagagaagtggatgatgatatcagagagataactggggacagggtactggattatgtaataaggctttattggccattgaagggatttttatctttattctaaatgaaaagggaagttttttgaggagagaagtgacacgatctgattttctttaaagaattttatttatttttaaagaattactctgttgctgtgttgcaaatagactgtagcaaagtcccaaggatcattggatgcatttcagcggcttgtggttacaaactattaatctctgcgattattttaaatactttgtttaaatatggaaatgtttttgtcttttgatcattgcttgatcaaataggtgtgacagtagtaaacatgtcaatctatagacatagaagagactttttttcctacattggtttttttctgtataatgctttaaaaagaaaggtggtagggaaagaatcttgacaattgggtgttgtccaagaagtgcttaataaatgaagctctaggatggagtgctgtctagagtactgaaaccatttattgtagaattgtgccttttttgcttgtacagtagattttacttatgaatcactttgagaaatgatttatgctccttacatttgattaaatttaaaggagactgtcttcataagaaaagtgaaaaacgagatttgtattaggccatgtaattgtcttttcagttttagagtaataaagtcctacatacttaattaatttttaattaattaattaattgagatggagggcaaaaggagaagggcagagaatatctaaagcagttttttttttctcatgagtgcagagcctgacatggggctccacctcaggattctgagatcaagacctgagctgaaaccaagagtccaacacttaaccgactgtgccactcaggggcccctacttaatatatttttaaagataagagaactagggcagggaaaagagggagtcatttgtttccattggctgcagcctctgtgttcacagctcacatttgcccagaatccagagacctcctcagctaaggaccccattatgctggatattttcatcctgatattctttgccatcattagcctggtcattctgtcctacatcatctatctggtctagtggcctgcagctgtggtgggaagccctcagaacaattcagcggggaggaaggatgaagctgaatggccaagcatcctgcttggctgacacaccagtggattttttcttctggacattatttgggctcctggtctccagtccaacaagaggcctcttatcagcagcatcagtcctgttgcctttcagacctcatccagaggcttctggatatggttaatcactgtcaagctggaggcgttttgcactcagctgggacatcaggaatttgtggacatggctggcaacgctgtgtgcgtgctagctgtagatagagggtgttgaggacacaaagctgaaatgtagactcgttaaagttaccatggtgaactgctcaaatattcattttgagagcttttctttaggtgtaaatgcaactacatattatgctaaaaatatgttctttcctttccctcttacatgcgggaggttcccttgtattggtccaagagcacgttgtctatcttcatctgtgaagtagttactttatcactgtctttacagactgcacaattggagtttgtgtagtatctcttttctcactctctagccaaaaggaaatcgtcatttgaatttttaagatttatcatattttttctactccataccacttgtgtcccagcttctcacttaaggagagaaaaggttattatagtcctcattctttgtgactggctaaattataagttattgaaatagggtagctataactcatcttgttatttgagaaaaatctctctcttacccccaaataaatgtttttttttttatatatatattatcaaatgttccttttctggaagaaaactctcaatatatttctttgtccaactagagttgaagaaactaggtattttagaatcatgactaggcttgggtcccaaatctgtggtatatgaaaagtccatcataattgttcaacatttgatttttctttctagcttaaaaataaacaaggaggaaaaaaaagattggggaactagatagcattccagctgttcccaagccaaacctccattaatttatttgaggtgttaggaacactgacaatagtagttgtatctttactaaaatgtaattaaatgtgcaaggacaaatgctgtagaaattatgtagttatccatgaatgctccttttggaattgacttatttaaaatgtgctcatctacattttcctttcactctcttgtttatttaaaagtttataccattttcataagcattcagtaactttgcatgatgcttgcttttgtccactgttggaagacttatttttggaaaccttcctttataccatgaattggaatttgacaattggttgttgtagattggtctttgaggttcatggaaacaatacacagtgatgaggttagtttctgcaagacacttctgccacaaataatgcttttcagtttacctaattgtagcctggcatcagtgcttgttagttattactacttagactaattaatcttatatatttacataatgttttgagtttcaccttctgtctggtaattttagtgataaaatggatgtggtctctgatggggacagtagtggaatatcctaattcaaagcataagctctttctctctcagattgggcagtcagtggccttctgtttgtgtaggatttcttaagtcactggtaaccatttaaacacaatagctatactggaaattactatggttgcattggtaataccgcttaacatctttgtgaactagcacagacatagtagttatgattttttggttttatttcatgacaaattaagatagattctatgtggaatcatctagaataatgttttctttctctactttttctctttaaaattattttttaaagtcataaaatgtaattatttgcaaaacaaactgacaaaatagaaattggattctctcttcctcaacctgagccttgcaatttgtcgtaattgatattatggatataacaaccattacactagatcttctgggagaaatcctgatttcgaaatactgacaacattctcatatttgttagaatatgtgtcagttggtattaaaaaattcagtgactgtgattaagatggaatattgttaggcttttgccagctttcttctttcattaaagattaactttgatagtaagtattgagaattattatggaaattatctggagatgctgcttccctggttattgtgacgcttatgaaacttttttaaaaagatcattctcttgacttaaatttgaagtcaactagaagaattggaggcaatatgtgctgtgattaagatcatgcatggtcctgagagcaaacagttttctgattcaacccctgactttaccactcttttaaccttgagcaggttacatatccttgttctgcctctgtttcctcatcaatgaaatgggaaaactaatgggacttacgtttcagacttgtcaggaagagtacatgagacacaggcataacaaagagtgcttggcacaaaataagcactgactgcatttggttatgttatattgagcttggaacatctcttaaaagagaattatctttatgaaacatttcaaaaatccaatttattctttaagttaggtttagagtctgtcctttccttaaggcagtataattgtgcaagctttaaaaacatgaaatgctaaaaatcttaattttacatgtaggccaagttctgttgatctttgtgaaattggaaattgatgttatcatcccaacagggaaattatgaaacagaaaaaaaattcaattcctccttaaggaaagaaactaataatagtgtgtgtgtgtatgtgtgtaagagtgtgtggagagaggtcatacacatatttatttatacaatacattaatagtagatttaaatttactggcctggtttctttccctccaaatttataaaaaataaaaatagaaatgaaataaaatcagcattctttatagctcaactggtatacattattattcagcatcaggaatgaatagtgattcttatacaatagataaaacctaacctgctttttttaattcagcctttttagtactgatctggtttttatgttcccataactgtgtgtaatacagtaatgagtgggtaaggcattgcatctagaatatctatggtgaacctgttggacttgaatgtaatcattcctaatctcaccacacctgtgaggagaggttctggaatgccccatcttacttacttatgttcctccttcctttatactaaatgcaggaatattgtcagtgaacaatatccttttaccagtgaaacctgacaaaggagattataatttgaaaatttaaagacactcctattttagattctacaacttggtttgtaataaggtgaaaatataatgatagattggaaaatccaagatactttattttggcagtgcatttttagttgcactgtgtatttctcacgcaacagaatttttttaaagaactgatatgaacatatacatcattcttatcttcatctttactttttttttctttagaaaatttaggaaaagatacatcaagtaggaacgagtatagaaatttttcgaaaaatagatgggaggtggtaaaattacaataggggtgttgcaaatgagcctctcatgagtagttattaggtgtttagttatcactgtggtacttactgggtggccttttctttttttcttttgtgtatcatcataactgtactctttaatccccatcacctatttcacctatcactccaccgacctcctacctggtttgtatagtttggcttgttctccatagttaagaatctgtttcttggtttgtctctctctttctgtttttttccccctttgttcaattttttcttttttaagttgtacatatgagtgcgatcatatgatatttgcctttatttcacttagcattatactctctagcttcatccatgttgttgcaaatggcaagattgcgttctttttatggctgagtaatatatcattgtatatacatatatactttatcttcatccattcatttatcaatggacacttaggctgcttccacagtttggctattgtaactagggctacagaaaaacataggggtactacatgtatccctttgaattagtctttttttattttggggtaaatacccaatagtgtggttactgggttgtagagtagttctattttcaattttttgaggaacctccataccattttccacagtggctgcaccattttgcattcccaccattagtgcaagaggttctgtttttctccacatcctcaccgacactggttgttttcattgtagccattctgactggtgtgaggcgatatacctcattgtagttttgatttgcatttccctaatgatgagtgatattaagcatcttttcatgtgtctgttggccatttgtgtgtcttctttggagaaatgtctgttcatctcttctgcccatttttttttttaagattttatttatttattcatgagagagacacacacacagagatagagacacaggtagaggaagaagcaggctccatgcagggagcctgatgtgggacttgatcccgggactccaggaccatgccctgggctgaaggcaggcactaaactgctgagccatccagggatcccctcttctgcccatttcttaattggattatttgttttttgggtattgagttgtatcagttctttttatattttggatactaactctttatcagatatgttgtttgcaaatatcttctatttagtaggttgccttttagggatggccttttcttaaaacttttagggcagcctgggtggctcagtggtttagcgcctgccttcagcccagggcgtgatcctggaggcccaggatcgagtcccacatcgggctccctgcatggagtctgcttctccctctgcctgtgtctgcatttctctctctctctgtctcaaatgagtaaataaataaaatcttaaaaaaaaaaaaaaaaaacttttagaagccttatgaagataagagctttcatagggaccctggattatcgtgtaactctcccattaatttctaggtatctggtgacccatcttatgggagcagatctgaacaacattgtgaaatgtcagaagcttacggatgaccatgttcagttccttatctaccaaattctccgaggtctcaaggtatattcttcctctttccaaagcttaagaaaaggaagaggaaaaaaaagaaaaaacctttcttatggaaaatttcgaacactcacagaatcacaaatacaatcatagtgtaatgaacccctacgtttacacagtgaccacaatttccaacataggaccaatctttcctttgtgttccccaagccctgaattattttaaagcaagtctagatgtaatgttgttccactcatagatatttcagtatgtatgtctaagagctcaagattcttcattcttacatctgaagagtagtaataatttcttgatataatctaatatctggttagtgtcatgttgaaactttaaaaacctcctcaaggagcctaatttatttgtgggaggggcagataagtaatgttttaaaattaaaacacctttgacatttagcagctttgagtccttattgaactccacaaaaccaatcagaaaacaagttgaaagctctgtttaactcatagctcaactctatgagtagagttgatggtatagaaatcatagttatgataaatgtacagattactgttaattacttgttctcacttttaatcccactatataatactaacagttcttactggttcataaaaatatacttcaactatgtcatatgaccatagaggttggagatgactttttcatttaattgacttttttctctttcacagtatatacattcagctgacataattcacagggtaatgtattgtgattttgatgaaattatttggggaggaggagggatactaaagtggagaggactggaattcagccaagatcctaatctacacttactttagctgttgaactgttgattgattgtaactttgctctaagtttaaactgattaaagaaagaagatacatagtttttagttatttaaagctaattaggatagatagtgactatagatggagatcactgataactggataaaatcttacctttatatttggatcttcatcattacctgtggggaaacaacataccatgcatcatgaaattgatcatgtcccctctgtacttacttcctaggacctaaaacctagcaatctagctgtgaatgaagactgtgagctgaaggtgagatgaagagacactggtaattgtttgtttcaacgtgtaattatatgtttgactaaccaggcagactaatgaacagatggatttgtaaaaccatgactttttatctgaaaattcatgttcttaggaatatcagattttgaaacttgaaccacagacttatgtaagttttaaaggatattgaaggtggcatcaggtgtcttgtttccatttttaaataaagttaaaatagatatttaatttattagttataataaaggaaaattatagcctgaatatcaaataagcaatcctgaagagataattactaaattagtttccttagagaaaataattcaaataggagataagtagtttatagagaataagcagctctagtattctttttctcatttttactcagtcttttaaacttaattacagtaaaatgtttcaagtgtactcttgacaaaatttttatatccatttaagcacaaacacagtaaaaataaagaacactttatcacttcagaaagttggcttgtggtccttcctagccagtccccacccctctacccctaatcctggcttcagacaaccactgatctgcttactgactctatagaatagatttattttttctggaattttgtattaatggaatcatacagtatttctgtatgtatgtgtctaacttatgcttaatataatattttaagctctgtgttatatcagtagttcgtttctttttattgctgtagtattcattttacgaatatgccacaatttgtttatccatctacatgttgatagacatttgcttcattctggtttggggctatgtatagctgctatgaatattcacatgcaagccttggtgtggatgtatgtttccattgctcttgggtaaatgcctaggaatagcattttttgttgtgctttttgtaatttcactcttaaagttcctgctgtgtttatcatgcattcttagcatggactagaaagtatgtttatgaaagtgctatattgttttgcctttttctaaggcactgagttttttcccctcctgctttataagtcttaggagcttgactattccagtgcctgatttttcttctctccttagatcttggactttggactggcccgacatacagatgatgaaatgacaggctatgtggctaccaggtggtacagggctcctgagataatgctgaactggatgcattacaaccagacaggtattgcttttattggtttttgagcaccttattagtcaccatgttgggtgtatttgggattcttaggagtggagatggtgggaatgggaggaaatatcttttttccccccctcagtgatccttttaaaattgacaggaaatatttcacttgcttagatagagaaagtagtgtttttatacctagctttcaaactttgtgatttagcagttgggtttttatttatttagatttccaacatattctgtgagtacttctatctgaagacagtgggttcataatttcaacctctcaacaatacttgggagaatctaccatttctaccagtaaggatctctgcccctttataaacagcttgtttctcttgccttagctatgttttgacatcccacctatggagccctttagtggggtacaggtcttaataagcttacttctataaagaagagtgtgattgttgcacctcaaatatatattataatttttcacctctagttatagcttctttcaggtcaagtatgttagtagtgacattgtatgccttttctgtttaattttaccagttgatatttggtcagtgggatgcataatggccgaactgttgactggaagaacgttgtttcctggtacagaccgtatcctttaaaaagttttggattcttgtttcttatctgtattccagtgtccatggaagtatattacttttatctgtctctaggaaaggctctcagttacttgcttatatggttcagatatgtgttacgagatctaccctctggctgagtatcttgccttgtcaagagagaggcttcaatttccttgtgtgaattggaaaaattcttcataagctagagaactctttacatctttcacgtcatccttttgcactgagtcccttattatattaatcttcccacagcagttctgcaacctgagcatattcccgagaagctccagatctcaatgactggtttagtctgcttgtacaacgcttaatgagcacaaggtacccatttataaaccaggggtatctttagcttatatgtttggtttgcatgtttaaaacattatatttggtccctataatgatgtacctgctgactgtctttatatttgttgtttaacaagtaataaaaacaagaagtgataaggtcatcctgatgtgtgccttttttttttccagcacaattttgtttttatcctagaatgtagccaaaccttaatttacttccagatttgttatctagtttacggcttatcacagcccttttattttaggtcctttcctatctgctgcatgcccatttcatggtttagaaataatatcagcaaaatgtggtttttgttggaagtcccattacttgcacttggggaaaacattcaggtgggaaagaatgttgacttatgtgtctagaattaggtttgaagatttttgtaaaattcatctgactagcctatagtgggtttggttgagctttagagatgctgcagttatgctgtgaatgtgttctatcatgcttagagacctaaaagctgtttcagcccttcacctaggcaaactctcattgagtttataattaatttactgctaacagtttggggtatacttccatggtgactgtgatgttcatgttgtctatccacatgttctaactatcttctgctagagaaaaagtactttcctactgaactgaaaaacttctgcccctgaggcaaagctgtttctttccctctgaatatttctgcattggtacagagttctgtctccctatatttactgctcttcattcccagattcttaaaaaactagtgtttttcctttgtcctttgtttcattcaccttatgtctgcgtcttagaaatgtggtatatacattacagttgaggctaagaaaatgagggaaaatttgttatttccccttttcctcagttacatgtctcagagtctcatcctctagcctgtcttcccaagcacactactgtgatgcatttctctattcccctcttcctttggtctcctctctatctttatctgtcttcggtcagcagcagacactcatgcctccagagataaccagagtggtgcagagagagacagacagacagcagggtatactcgtggagagcaaatactctggaatcagactacctgggtttataggtcctacctcttttactcccagctgtgtgactttgagtacgttttctaacttctgtctcctggtttctttaaacataaaatgctaatggtaaatacctcacaaagtgactgtgagaattcagtgagatagtatctggaaagtacttagcctgccaggaaatgttagacatcatcttcattagtgactttgggaaacagttattccctttaccttcccactcttttgtctacctatgaatcattatggttttatctcacagatggctgtctactccctgatggcttgactcttttagaatgctaactttcaggagcacctgggtggcttagtcggtgaagcatctgagtcttgatttcggctcaggtcatgatctcagggttgtgatattgagccctacattgggctctctgctgggcatggaacctgcttaagactctctttctttctctctctctctccccctctctctccctctccctccccttctccctctctttccctctccctctccctccccttctccctctctttccctctccctcccttccttcctccctctctcttttcctctccctctctcccccctctccttcttcctctccctctgccctcccttactcttgcacatgcacatactctctcttgagaaatataaaataaaataaaataaaataaaataaaataaaataaaactaactttaaacctgtaagaagtcttcctttttttccttttgtgaactttagatagaaaacctaggatttagactttttacaatgggctttttttttaatacatgaaaattcatttcagaattcttattttaggggcatctgggtggctcagaggttgagcatcttcctttggctcaggtcgtgatcctggagtcctgggatcgggtcccacatcaggctccctgcctggagcctacttctccctctgcctatgtctctgcctctctttctgcctctttctctgtgtctctcgtgaataaataaaatctttattaaaaaaaacccacaaaattcttattttagtaaagcaccatttcttttctacttggctcttttttgagacagatattctcctggatcataaaaatcaaattcagaagatttgtatttttaatatacataacccccatcttgtcagttgccatctgtgtagatgtagctttggtggcctgacaaggaaagaggaaagtgttgtctattattttttttcttgcttgaagtgtgcaattgcttatagtctaccatagtggttcttaactctcatttttcatcaaaatacttaggggagcaaaatactctggggcaccaccccagagactcaaacccacactttatgtggggtgaaagcacaggctttggcatattttttaagtacccagttgattctagtgtataataggtgttaagcacaactagagtctaactcaattgagtcttacttttaactttttaggctgatcctaaaaaaacatttaattaggcaatctttctttctttctttctttctttctttctttctttctttctttctttctttctttcttctttctttccttttcttttccttttcttttctttctttttcttttcttttcttttcttttcttttcttttcttttcttttcttttcttttcttttctttcttttcttttcttttccttttcttttcttttctcctttcctttcctttttcctttcctttttcctttcctttctttcttctctttcctttccatgccaaggagatcagaaagtttagaattgagacttatttacctaagaggtcgagaggatattagaaaacctctaattgaactccctgttttttatagatgagaggaaaccaagacccagagacgatagatccagaactgttatttatgactcaggtcacagtttcttagcattattttatttgttgcctattcctcttatttctagaactcttcttcttccttttttttttttttttttttttttagaactcttcttaaaacctttggagaatgtactggctctgcacagtcttcctttgcccagaaaagcatgcagctactgcttatttgtgatttttatttttatttttatttttattttttttatttgtgatttttatttttttttttttttttttttttttttttttttatttgggatttttaaatgcaactgaatgctgcagcaacctctagagcatgctctttatttgagtgccttcttctccctatttttctcatttattaactatcttgtatttagagatacttgtggttttagcttctagataagtgctatctaatagaattttctgtggtgttgcaaatgttctctatttgtgctatgcactgtggtggttggtagccacagccacatgtggctactgagcacttaaaatatggctagtgaaacttgggagctgattaaaaatatttctgtggtgaaatgtattaacataaaatttgccattttaactttttcttattgtggtaaaatatgcccaacagaacttcccattttaacctttttaaaatatacagttcatgggcactaattacattaacaaaattgtgcaaccatcaccactattgtatttccaaaacatttttatcacaccaaaccaaaactctgtgcccatcgaacagtacctctccattcttctttcctatagcctctgatttcctttcttctactttctgaatttgcttattctagacatttcttgtaagtggaatcccataatattagttcttttgtttcttgattattttccttaaccataatgttttcaaggttcatccaagttcatccttgtttccagaacttcattcctttttttatggctgaatactattccattgcatgtgtatgccacattttgtttatgcactcatctgttcattgacatttgggttattttcacctttggcaattgtgattagtgctacaatgaatattggcatacagctatttgtttgaatctctgctttcagttctttgtggtgtatgtctaggagtggaattgttgagtcatgtggtaattctttgtttagctttttgaggagccaccaaactattttccacagcagttacaccgtttttgcccaccaatgatgtatgcgtaatttttccacatcttcaccaacacttgttctgattttttcttttctttaaattatcttcttcttttttttttaattcatcctcgtaagtatgaagtggtatctctttgtagttttaatttgtatttccctaatgaccgataatgttaagcatcttttcctgtgtatattggctatttgtatatcttcagtggaggaatatctgttcaagttgattatccatcttttaattagattgtctttttgttgttgagtttttagttctgtatatattatggatattaaaccttcattagatacatgatttgcaaatattatctcccattatgtgggctgttcactttcttgataatgtcctttgaaaaggttttgaatttaatgaagttccaatgtatcggtttttttcttttgttgctcttgtcatatctaagaatatattatcaaatttgcggttgtgaagatttactgtgttttctactaagaattgtaagggtttatctcttagatctttgatccattttgagttaatttttgtatatgatgtcagattagtagtccaactttattcttttgcatgtggaaatctagttgtctcagcaccaattgttggagagactgtcctttcccaggggctggcacttctgtcaaaggtaattctattccattggtctgcacatctatccttaaagcagtcccacactgttttgattcgggcaactttgattcctgtaagtttttgaattcaggaagtgtgagtcagtccttcaactttgttctcattatcaagtgttttttgttttgggttttttttgttttttttaggagtagttttccttttcttttcaaggtcttttgtaatcccatatagatttgaggatggacttttacatttctgccaaaaaggctattggaattttggtagacattgtgttgaatttttagttcaccttggtaatagtgacatcttaacagtatgaagtcttcctatctatgagcacaagatgtctttccattttttatttcttaatttcttttataattttcattggacaaaactttcaccttcatgcttaaaaggcattttattcttttagatgctattgtaaatggaattgctttcttaatttccttttcaggttgtttattattggtgtgtggaaacacaactgatttttgttgattttgtaccgtgcatctttttttttttttaatttttatttatttatgatagtcacatacacagagagaaagagagagagagagagaggcagagacataggcagagggagaagcaggcttcatgcaccgggagcccgacgtgggattcgatcccgggtctccaggatcgtgccctgggccaaaggcaggcgccaaaccgctgcgccacccagggatcccctgtaccgtgcatctttactcaatttgtttattagcgctggtagatttcttgtaggttctttggtattttctatacataggatcatctcatctgcaaatagagatggttttacttctccctttccagttgttctggctagaacttccagtacagtgatgaatgacagtggtgaagtgggcatccttgtttcgttatcagagggaaagttttcagtcttcattgactatgattttagctttgtgtttttcataaatgctctttatcatgtcaatgaaacatcatgtcagaaattcctttgtattcagttttatgagtgttttaaatctgaatttcaaaatgtattagattttatatagattacatataaatttaatcacatgtgattactggtattgcattgggaagttttagatctctacaattcttgttcctattctgcttttttctctctctctctttttttttttttttttgtcattagtctccttgaaagattcttttagtactggttgttaataatccttggagtttccctaaaggtgtaggaaatactaatttttcttaaaggtaattatacattattagcttttcattttcatttatgactatgtagaacccctcttccaggtaggtcaaaagcagtattatttttttaaggaatgaagcactgccttccaagtccagttgactaggtatatcaagtggacatggctggtggaacttcatatttcggagagagtgaggatatagaatgtctctttaggtctagtgctaacttatttcaaatgccaatcgttttgggaagtgaccagttagaaaatggttttattaacacttaatagtcggtagcctaaggaagagaggaggtaagtttcccagccctgtacacgccaaatactgtgttctcttccagaggtcacagcatttgcttgctgtggttttcttttcctaagtaatcaaatgaatttcctaaatgtgtacaactttttttccttcttttattttaatagaagtggtactcttaagatattaactagaggataatggagctgttgagttataacccacttgccattagctgctgccttactctgtatgaatttccttagtgtattaaatttgctccttaattcttctttattcattttttctttttatttttttcaaacattttatgaaatactacaaaaaggcaaagaataatgtaatgaacacctatgtttatagctctcaggttatgagataaaacatgacaatagagctaaaaatttttggtgtaccccttctgtcacatttacccctcacttgtagtcactagtttcaaatattctcttattctattttttgaattaaaaaaatatatttttagattttatttatttattcatgagagacagagagagagagagaggcagagacacaaggcagagggagaagcaggctccatgcagggagtctgacgtgggactcgatcccaggaccctagtatcaggccctgggctgaaggcggtgctaaactgttgagccacccgggctgtcctgaatttaaaaattttttttaaaagtaagctctactcccagcagggggctcaaactcacaaccctgagaccagagttgcatgctccaccagctgagcaagccaggcacccttgttctctctcattttagaatttatttatttgcttaggagggagaatggtgtggggcaaagggagagagaatctcaagtagactccctgccgagcacagagcctgacgcggggctcaatctcacaaccctgagatcatgacctgagatcatgacctgagccaaaaccaagagttaggcactcaaccaactgagccacccaggtacccctgttctctcttatttttttaaaaagcagttttcctaaaaaatgttgaagaagaagaatatttcactagactatttgccttttcttctccaacttgaaaatacagattttttttctcccagaaaagattggaattttcatctgtatccacaaacctagaataccttaagaatttgtgtgtgtgtgacagtgaaaatgactgttctgacaaccaagaagagaagaaagtagggtaggtcttctcatagtccatcctgtcatcctttcctaccctccaaacattaatattctggattttgtttcattgaaaactgtgggtcacgtgcagcagttagttgcagggatatcctgcacctgttcccttcctcatcttcaattctctggcctgtggacactttctaggagttgcctaaacacttagaaatgaatagaatattcctctcttcatttccctatgatccagtatccttagattgatttctttatctgttcattctaccttttacttatgttacagagaacctaaagagtaatcttagccctcagtggttgttttagaaaggaccaggagatctatgatttaaattttgacgatttgatcatgacagttaaaatatgtttttacctaatagtaaaaatttcttctatctagggggaaaaaggggttaaaccagttatgaaggatggcttgttgtggaaataactaattgtcataatgtggtaaattttgctttgctctgcttatgtagctacttgaagcgccctctggccttaactgcctggacaaattctagtagctggtactattggaagactgacctgtatttctatggatttgccagttgttggagaacctatggtgatttcttctgaggtctgcatgctttgacttcttttatgcaagtgcttttagctactaagtaggtttttattttgcattgtgtgtttactaatctcctaagtattggctactgtgctgtaccaactctctttgtccatggcccttacacactcttggcactatatttttatactctctatggtgtaaatgcttcagatggagtgtttgagaactttgttaggcctgatattaaatgaaacgacttttcttaacttttttgtattgagacttcccatagagtatgttcattttggttttgagagcaaggcagaggggatagagctgagtttaaaagcatattacagcaagtctttttaagccaaccaacatttatcagactactccgtggaaggtgctagagataggagcagctatcgccaaaaacagaatgatcataatcagtggaaagtaagttacaggagttactggaacaaatgtctactctctgattatagaataagacagtgataataacgctataacaggtataactaagttattgagaagaagtagagattaatttgagcctaagattcatggtttgagtaggactctgaaaaaaaaaaaaaaaaaaaaaaagaacaagcttggtaggaggggagagtagagggcatttctgtttgacttggataaatgaaaagctagaagctttacagtgcctaaaagatttggcatgcattgaagcattgagtacattaaggagtaatagtttgaggcagagtcaggaaagaagcttgatgccaaaccagagagggccatgaggggctgaggagttggggctttatacatcaggcctgtgattgattcgtacctgcaaaagcaggagagaggcacacgggatcccccactcatggctgtagtgagccactgtggccagtgggggtggcacagtcttcaggtatgttaaagtgaagttagggcagttaagcaactcagcccagagtctgctgccgtccgtggagagactatacaacttgactcctttttgtagtcagaagtctcttaaaggacagtaccaatctcaacagctttatttatagagagtagttttgatacatatattgtaaaactacctgcttgagagttgaagtagtttagttggtttccatatatgatatgctttgtgaggtggggtagctacccacttgaatttgttctggaagagtgtgaggggaagtaacacttgtaaactgaatcattttacatgagcaaagggggatgctctacaaattctactgttgtatagttaattttagagcaagacagtaatcatccgccctccccactctgtccccattaatgcatactttagatttttttcttgtcagcattttgaactgagaatcagtattgaaattttaatttccagaatacattgatttttgccatttgcagatgacaaaattttctactaattcttaatttagaagcaatttgtatgagtggacttgtttgtaatttatccttgttttctatggaacacaagttgtttaggtctggaatggggttgagcaaacctttacttaaagagccagataacaaatattctagggtttggggatcgtatggtttctgttgtaagtactcactcagttctgctgtacataaaacgaaagctgtacataaactaacaggcatggctgtgttccagcaaacctttattttcaaaacaggcagcaggctggtctttgctgactcctatctagaattttcttcatttaagccaatttcatatctggaggagaaaaaaaaaaaaaaaaaaaagaacagggcaagatgccagtgttattgcataagtaattcctgtaacttgggcaactatggtttgcagaggccattatttttaagttacaccatattaccttcatatgtgtaatcataggcagaaatattttcttctgtcctcctttccatcctgctctccctacccctcaaatattctgagagcccaccatggagcagatggcaggctaggtgctgggaataggtggcacagtcagggtggctcctgctctcatagagccacaggtcagcagaggtgacagacgggaagcaaacaaaataattctagattgtgataagcactttaatgtttgcaagcattgtgctgaggtagagaatacagggaagagggggcttctttatgttgggggcagcctctctgaggaagtgagtttaagctgagacctgaagttgagaaggacctaatatgtgaaaaacctgacgggatttgtcaggtttttcacgtattagcatcagaagacggtcatcctcccctccttcatccccccaatgtcagtgtagacacagataaactattcacactttcgtagagaatattaaaagctattttatatgattttttttcctctccccttttaacttccttttttaaagcaaggctagaggcagtaagaacaactgaaaagtttttgtcttctggttaacacatgcgcatacattctgagtgtgcatggaagagttggctaccagaattaaggtttggacattgtagcctattgttcagagcctctggggtgtgtgaggtttgtcattgcttttgtgaaatggtaacctctggcattctgctacactatggcgctcctgaagaacatgtggatgcggtgagggagtggggccctctgctggtcgactgtcactcatcactcttgtgcgcctgccacagcctgcatccaggcagaggcttgaaggcccctgtcgtattacaagtcccttgggttaagccttcgggaatattcacaggtggtcacagctagctctagctcctatgctttgctgctttttttgtgtctgtagcactctgcttaccagtgctcttcgcttaactggctactcatgctttggtggaaggtgaagaggtgggtgtggacagagtgaagcttttgtgttttcacgggctgtctttagcagctaagtacccagctaatgtcactttgctttactgataagtgacgttgacagatacacaaaatgaatataaatcggtgatgtgtgtggcagtgttctgagtctttgtacaggaggagcatgttctacttgaagtgaccgtcgtgcagaagccttgatccagatgaattcaccattctggcttggtttggggtttttaatttttgttattggggtattttgtttgttttgttttgtttgttgttgtttgttttttatttttattttgtcccaacattttcctttatagtccaccattagatattgatcagttgaagctcattttaagactcgttggaaccccaggggctgatcttttgaagaaaatctcctcagagtctgtgagttgatgctttgattgtaattatctgcccttttgggagcctctgccacttgccttccatcagtctgtactttgccctgagtatgtttgtaagcatgtgtgcccttttgtgctgactttcaggatgaggggtgtgtgtgtgtgtgtgtgtgtgtgtctgtctgtatgtctgtgtgtacatgcactcatctgcccccatgcatgagtgtgttttattctctgttggagtatgtacttagatcatgagagcttgtattgggcagtagtatccatgatttgagattgtaactcattccatgaaattaaagaaaatttgtctacgttatcaagccctgacatcatctttctcagaagtttacatgcatttaagctctttttatgttttggttagtgtttgttctcagagcgtgagctttaccacatattagtgtagcttcactataagaatgaagtgtgcattgtgttcacactactgcccttttccagaagttactgccttttactgctttagaatagacaactcgcatatcttgtataagttgtctgttcccaacaagggcacctctccaccctgtttccagaccagtcctggtaactcacatcctctggagtagacttgtaaatccttcctcccacagcctccctttgtaattacaagtcaataacctgagaaaaagctttggcgctaatgctttcctgcctctaagcagggatttagagagaagccatgggaatgtgactctggcttactttggcttcaatttcctgctgttggtcattttctggggccagaggcaagagagaaatcatgaaagctcagcctttctcccttttctcctctgtctgctgccaggcagttgactaaaagggaaaaagaactgtggagccaagctccaagtgtgccttcctgaattctcctcccagcattctgactaaaggggtccctttgcccaactggaaggaatgctgggtggcttgaggcaggcttgagcaggtgagtttgaatggtgcatcatctctcttacaaaataaagaatattgtcatctggtatgtttctggtacattctactaacagaccacaaagtccagtgtatttatgaatttccactctgagagatgtaagatactgtgctggctctattattttgtttcatttatttatttaagatgaagaaggaaaagcacagaaaagctgtgacttgcctgagtcatgcactgagtcacttggcagagctgagcatagatctcagatgttctgataacatcatctttatttttttattttttattttttgataacctcatctttaaactttaatctcatgcaattgcacactattttgaaagtcatttgtcaaagtgactgaccactgtgccaacacaaaggagtggggaagctggatagagtgaatcaaagaagataagaaatggtgctttcttgttttaaatgcatgtacttagaaagactggtaatagagaagacatgggggcaagggagtgggggtgggagaaagttcagtttatttaccaatagtactaatgagactaagatagtaaattcattctctgtctgggaatggtcactagcagctctttctcagtccctaatctgccctatagatatgtgtagctagtcacaagatttttaaaagaaaaagcatgggtaatatcatatttacctattattaatccatcatttattgttaagaaagaaacaaaatcaagtgcccaacctaataatgagatgtctttatcttatgtgaaatagggcacatcatacatttaaacagctctagagttgggcataataaaattatctaccagaatgcagaatgtactccaataatagtgtgttgagtatgggaataagagaggcttttttttccccctacatggttatgatgaatggattaaaaggttttaaacattcaaaggggtagacaagattaatttgacattactaataatgccccaagtatcagtttatcttaaaagcacatgatgtgtgtgggacgcatggtgtgtaaataacaaagccaggtgagtaaaattgttttaagaattttaaaaattgaaggaaaaattcattagtgaaggaatgtaataaaagaaagccaatagctattttcattactcctgcaaagtagtaagatggtgatgccataattttttcaagtctttatttaaattagttagttaacatacagatgccatcatttatgtagaaatccagtcaacaggtattaggacattgtaagataatgcaataatggatgggctgattgagaacaagttgggatgtgctgtaagaaaggggataaatggcccatggcagctaaggagagaggagtgttttgcttagtgacccagtacctatagtaatcagtgaaagaacaaaaagtcatataaagaaaccaaaagccctttcactgactcccatttttccctagaaatatattcttgctaacctcctgacaggaaggggatataataatgcatttgactaaaggagacaaaagtagaaattgcacaggccaagtattgttcataagaaagaagaggtggcaagattcaaagattttaaaacccaattggtattctactattcctagtttacttaatgagccatttttattgtatttcttcacatgcaaagtactgttggtatgtcatttgtttaaaggcaaatctaaactttgttgagagaatgttaaaagggcttcatgccaccttttaaatttgctggcctctgtccttgggcataaggagtatgaaaggcaggatgcagcacatattccagctctctccttatatatttgcagtcccctgaccactagggaatttgagttctgaggatgaggtaatgtgaaaaattagtgaaggaagccacaaagaagtgtaattgcttgaccagggtgctcattgaagatgctgctataaccaggggtggggatgggggaattaatagtttacaaagaaagaatagagacagatttttattgaattgcaattgatttttaaaaatcccatcactactcctttaataggaacatgtgataaactaacagttcatgtaacattttggaggagggggacttgtgttaaagttgatggggcagcaagaaaagagaagtttgacatgccacttccatgtgtgcttgtgcatatggaagacctactagtttcgtccttgtcagatcattgcagagcattttgcagacttcttcccagctgtttactaagtgaagtcagcctattcacctgttagaaacttgtggaagaaatcactgtggcatgctacaataccatcagcagcctgtgacttctattttgtctttgccattagcttctaactttgccctgtgtgtcctctttcttcatcaccattgtgtgtttggcatgttttataaatgtaccactactaatgtctttgaaacttggcattgcttatcagctcgcacacccaccaatgttttacatttggaggggtggtgccttggagagttaccagaacctgtgccacgaaaatttaaccacttccttgaatggatatattgaaaattttgttttgtccaaagctgaatcaaaattttctgaatcatctccatttaccccctccccctccccaaagcaaacaggttttggccatcaatatttgaaaaccattctccggctggcatcctggatcaaggggcagtccctttccagggagcctaaaatatttcatgttaaagatgatgctaaaataaaagagaagtaatttttcttatctgcatggccagttcctggctgcatgcctaataattctcatgccattccatagaagcgtgcgttcacatgcagccttgggctctggcctgggatggatgggacgggtgggaaattgattttttgttcatttggggtggcttttttggccttcttgagaacttgagttgaaagttatttttttgcactgtatgtttaacaatgcccttgactaggcatctaagatattaaccagcttcagcagattatgcgtctgacggggaccccccctgcttatctcattaacaggatgccaagccatgaggtgagaacaaacagactgtataggaatagccaattcagaaggccacattctcattttattgccactgtataaccaacacagtttttaatatcactgagtgcttgcatgtgccttgaggggctactaaggtgatgagtgcgtatgtgctatggcaggatgctgacatttgggataaaatgtcatccaatcctatgggttgagaatataatttataggcttgtaaatagaaaatgatgttacttttatatttgggttttataaatttagtgctcgagaagccattatgttttcctagttagggtatgttagcatctgatgactgtagcctggaagtgtatttaactgagggccattaggatgctttcctattcattagttttttataatgaccaaaagaagattcttcccttaagttaaaaaccaaatctataaaatatccaacactgataagtactatatttaaaaggaaatatacaaataacatggaataaatatgaacacttctatagggttaggtgtcttctttaccattcttactacttaatctttaatgttagttttattatcagagatggttgaggcacttctttctaagatgtctttaatgtttttgggagccaggttggcatcacagaggccctttgcagcagcagtgtttctatttcagttatatgcaggtagttttaaaatttacctttatgtatcttattagagggatgactgttctctgcataagacaggtctctcttacctctgtcttcccttcatcctcaagtaggaagggattacagacatatggatattcaattcctggaactctcttttcaaattggaaagattcccaacagctttgcaaagtggacctcttctacttggtccacgtacaatgactaagaaggtgaagttgccctagtaaccagaactttttctaagcttgtgtgtggaaatacacagacacacacacacacacacacacacacacacacacacctttactgttgagctgtattaaaatagcaattttaaggaaattttatctcatcttctcagatggactgagagtgggatttatttttttgaaactgggaaagtcacagacacagcttaatacctaatatctaaagcacacatttatgagttacatttgtatttacatgattaatctcaagatcagtttttggtttgccttcatagagctatcagtccttaaaagtatctggcaccgagagttccttccagtggagtttggaaattgtgaagttgaaacacccttagagaatgagagcaaactttctaaaggcaacagggagaacagctaatgtttgttgagctctcactctgcaccaagtactgtgctaaggaagtactggtttgttatctccaatccttgtgtggtagacattgttaatctctttttatagaaaaggaactcaagccttaaagagaataagtaacttgcccaaagtgataaagtcaagattcaagcccgttccaccatagggaccaaacttctaaaactatattggtaatataaatgttgtttgtgtcagaattttagtttaaagctctttcatgagttttatctaatttgaatatcacaataactgtatgataaaggcaagccaaatactaatatctaatactaatattttgcagaagaggtcaccgatatgtcagttgagacttatgaaagaagatgtagcatctaagtggtaggggaaagatttctgtgtaggccatgtaacttataatccactcttcttcatttctctaagttgctttagtatttttaaaatgtgttcaggacttttagaataatacagtaagcttatgtttacttccttgttaccaacattactttgttagcaaggtttaacactgatgccctttttatgaactaggagtacgtactgagatcagcaccatcagaggactactggtcctcaactttaggagtacatatccctatgctaattataggtttctagaaaggctatctcagaaaggagagcttcttagatatcttggcctccttttttattttacttgtgatcctttgattagaaagctaataaaaggggacttagttgcttagcattctccttcactggaaatggaactgtgagagataactggaataaacaaaggtgctgatcacatatataagggcgttgggatggcagtaagagaaatctttaactgactatcaaagacagtcgtaaacattgaagctagcacactttgtcagttaacacttgttctttggcaggatcgagactctctgggagcagtaacattactgaacaaagccattttgaaaacctcttatttttacaggcaagaaactacattcagtctttgacccagatgccgaaaatgaactttgcaaatgtatttattggtgccaatcccttgggtaagttgatcatatccttacctcatgaatattgaattgttaatgacataaattaaggatttaaaggagagtttttcccccttttgattaaacagggtaccattaattaaatcctgaaaggtggtaagtaatgctgtttgggttttttggggagggaattttattttacagagagaacacaagtggggggaggggcagagagagaaggaggctcctcactgaggagggagccctgatgcagggctcaatcccaggaccccaggatcatgacctgagccgaagaccagacacctaacaaactaagccacccaggcacccaggccatttgttatccatgtttgtgttgttaggttttttaatcacatgatatgcttatatgtttatatgatgtagaatgtggtaggaggaatgggcttgtacggtgaagacaggacagcaaatagtggggatgttgagaggagagatgagaggtgcaggaagaaggaggtacagaggaaagcctatgacttcgcaactgctgccattgtgtggtgtccctttttttttttttttttaaatttttatttatttatgatagtcacagagagagagagagaggcagagacacaggcagagggagaagcaggctccatgcaccgggagcccgacgtgggattcgatcccgggtctccaggatcgtgccctgggccaaaggcaggcgctaaaccgctgcgccacccagggatccccattgtgtggtgtcccaaaccaagggtgaaaacagctgaagcacagataggtgtttagaggacccccaggagctccctgcagactgccctgcactgcctgtagcttcccagtactacaggtcctgctatccttgtgcacttttcctttcttctcttcttctatatgcccctccctgcccccccccccgcctcccccacccccattctgtcttctttgtggagataatttgccacctcagactttaaggaatggctccacattccttcctgccaccatcacttccaggatcctttgcagagggaagtaacagtggtagctgcaggatatgtactgccttggctaaaatgaaagttgatttcttccttgaagttggcgttattatgtgctttggttggctcctaaaagtggcactgcctgagaccctacctccctgaatcaaggattgtgcagtggacagtgccatttaacagcagacagggaaaaatcagaccaggccttcctgtgacagggaagggagccatgccatgataatagtataagcaaccttctcactttcctgaagattgtgttatgttggcatgttaaaaaaatcatccctctgcttggtcccagcagctgtacttcaggttgttttgccctttgagagctgatagtcatgacacccttttcagaagttgtaatgaaggctaagtggtttcccctttttaagtactttgtccacagtgctcgttgagagtgatttcagtgttcctgtgataatttttacaatagcagagatgcttacattcttcgaaatgttgggcagttctgggtgagtctgtgtcagccttggagattgtaagtatgtgagttctcagcagggctactctcccatccaaaaatgagcccacaaactcgtcagggctatacacagaattctatgccattggttcagatttgcatctgccccgatctgctccccttggctctgtaggatttatttgagttatattatcaagttcaaggatctgtgagaagctctattcaagtcataaatactctaggatgttgggaaattatgctggatgctggtagttttcttgtctgtcattctgttttgaatgtattttcatcctatcagttcatgtttcagacctggcagtgctcactgtttgacttcctattagccaactccaagagatttgttaactcatttttctagagaagggagataagggggcggggagtatgtgtgtgtccccacagcttatttaggtcacatccatccttctctggaatcatgacatttaaacattcaaaagaactggataccacttagcaatacagactgccaatgagttgaatggaggctttgggccatctggtgctcagcacggcagttctcagaatctaaacatgcctgatagctcattgccaaatagtgacgtcatacaaagagtctcttcttgcagacagaacatggtgttactgaccacgaacttgtgcccagcatattaactgagcaggaacacaccgatgatgtaaataatgacagctgcattttgtcagtcactgacttcatgttcgactattattctcaaaacacgaattaaaagttgaattgacctttgatatagtgtgtgtttgtatctgtcaagatcttagaggaaccttttccttacccctgaccttattcctcatcaaggtattggttatcaggacatggttcttttcaccctaggaacctcagtcagatgtaatgtgtggttcttaattggatcccagtttgaacaaaccaggtgtaaaagacaactttgggataactggagaagttttaacataaactggatttttagatgatatttcagaattatttgtcatatataatggttttgtgattatatagaaagatgtatttatgctgaaatatttagaggtaaagtgtcatgtctatcattttattttaaaatggtccagcaaaagctccaaataggtaaaaaaagaaataatgttaattgttggatatgggtggtaggcgtatgagtaatcactatactattgttttgtatattgaaatttgtcatagtgaaaattttatatttcttttatccaaataccgtgtctcacccacacacccatgtaaaaccctcagtttgttcattgttggaagatctgtttgatgaatattcattgccttatgttagtaaataaacagcacagggagacaaaaaagtgaaaaatcaaaaaatccctgcttaccttttctagattagtttggttataagttttccttttgacacagtttgagtacagtcttagctgtttgacactgacattctacaaaagtttgttcatacagagtttcggttatttttaaaacttgttctttagtaacgtattcttaatacaaaacacatccctagacatacatacacataaagaagaaaagagatcatgtttcttagagcagacacatggggggagaattctttgttccatatgaagactcaatactgtgtatttgcttaataaggcctgatttttttggtgacgtgttaaaaacttttttttttccttctaatctgtggggctgatagctgtcgacttgctggagaagatgcttgtattggactcagacaagagaattacagcagcccaagccctcgcacatgcctactttgctcagtaccatgatccagatgatgaaccagtggctgatccttacgatcagtcctttgaaagcagggacctccttatagatgaatggaaaagtaagtcataagagcaggattaacatcaagtgtgggaacttagattttaaaatgtttcttaggtgagccactaaccaaaagctgtgggaaaataaaatttctggttataatcaatttgttaaaacttgtaactagtgtgtctgatgcaggatggatatgttcttctgatggaaactgtctgttgtagatgatgacactctctggacctttgaggtgcttgtgtctggtctgattttgtgcaaccccccccccttacatctgtatagagcttcaaggttctcagaatctgcgtttacaacatctgtctgagagaagtagggaataaggtatttttgtagttttacgattgataaaactctagaattatagttttataatttttaagaagattttatttatttattcatgagagacacagaaaggcagagacaaaggcagagggagaagcaggctccctgcagggagcccaaggtgggacttgatcccaggaccacaacctgagccaaaggcagacgctcaaccactgagccgtccaggtgcccctatagttttataatcgatagtctgcatcttatctgttaccttggacctacttagggacacagccagaaatgaaacctatgtctcctctatatcccaacttcaaattctttccataaaaacacattcagaactccaggtagatcccaaaggcaaaattatctattccgtagcttgtagaagtgctctgctattcttgagcatcttctccagagagcttaaaagaggaggcacggtggaatgaaacaaataagtaaaaatagttctttttgtgtatccttgaacttctatgtaatcacatgttcctttaggttataacatgtaagcaatgaagtggttatttgaagtcgtccatccaatcactggcctggacaggagggaaggatcttgagcttcaaagttaagaatgtccacctacaagaatagtctcaactctcacatccgacttttctctctcctgatttttaggcctgacctacgatgaagtcgtcagctttgtgccgccaccccttgaccaagaagagatggagtcctgagcacctggtttctgttttgttgatcccacttcactgtgaggggaaggccttttcatgggaactctccaaatatcattcaagtgcctcttgttgcaaagatttcctccatggtggaaggggtttgtgtgtgtgtgtgtgtgtgtgtgtgtgtgtgtgtgtgcgcgcgctcctgtgcatgtgtctgtctgtgtgggagggtaagagaatatgagcaaactctgatcacagtgactttacatggaattacagaagccctgtggcagcctctgtttgctctttgtgagagtcagctcaggcaggcaagagctgccatcttgttagggtttgttaaatgcaaagtaaaaaatattaaatggcccagatcccagtcatgcttttgcccttttggcctctcccatggccctggcttggggtgggaggggggagagtcgcctacatcctgtagcagcacagagatggctcacactttctggctgtttcagaagctgtccctcagcatcgctcgcagccaagaaggaccaactggcttctgtgcactagtctgtgactgacttgtttagtacgattctcagaactctgcaggtgtgtccgaaactgtaaatatgcttgtgccttaagaggagagaagaaaatgtagataggtgagacagcacagcagaccaagtgccgagccaggcaagtagtcaggttgttggaaggctgctcatgaacctgaagtaaccagggagccctggaggcattgtgtgtgcatgtgtgcgcatgcatgtgtgtgcttctcttcaccccccccacaccccaggggttgctatttctctgctcgccccccacctacagtgcagaggtttcttgtgtattagccccagcaggcagaagccggttcttgctgtcattgtactttctgtgtgctctttattcccagcagagtgacgatgtgttttgcatgtcttgctatttgagcatgcacagctgcttgtctgttctctttgggaggccctggtgccaggcaggtttgccagtgaagacttcttgggtagttcagagcccatgtcacctcggctgatgccacgggaaggtgacctcatcctctctccagccccagtgctattttgtgttgaacacaattgatactctaggtgcttttgatgtgaaaactatgaagaaatggaacagatgagtgtatagcattttcattcttgccatctggttttcgacaaactatttttggggagccatcatgggaaagatcagggcttttctcgggaatatttcagactttggaaaacaattgttctcttcactcccagtagctaatgctaagaaatgcttaaaatcaaagtgaacaataaaaattgctcatgaggccagaaactccttttgctatctttgtctaaacatggttattaaaaaaagtaatgaggtgtcttttccactcttctttggaagagggtcttcttggcagcttaacattgacttcttggtcttggttcagggagaaataaattttgtttcagaattttgtatattgcaggagtcctttgagaatgtgattccttttgatggggagaaagggcaaattattctgatattttgtattctcaactttataaagatgaaatatcctcaggggtgaagaagaattgttttcataattttctgaatttcaggtgtcttgtgctacaaaagggcccatgtgttaaaccccctgtgaaataagcaagtgtgaagccgcttctactattggctgtgtgatagaatcttgtatttgggacaaggcgtatccatttctctatcacagctcagtggtacctgaattctggagggacagggtgggacccctgagccagctggagcaagaagggaggaggcaggctgatggtgattgcacctcacccgggatcctacccctctttaaaggaaaatgaacgtaaaagcttcatctcctttatatgcagttcaaatcctcaccatccacagcaagatgaatttcatcagccatgtttggttgtaaatgctagtatgatttcctacagaaatactgctctgaatattttttcataaaggtctttgcacatgtgattgtatatgcgttaggaggctgaatgctcttggagcctggactcagctggagcccatggaagagctccttggtttctgagcattgtgctcccatctcctgatttctctgaacagaactagcaaaagagagaatgagggaaattgctattttatttgtattcatgaacttggctgtaatcagttatgccatataggatgtcatacaataccactggttaaaataaagcctatttttcaaatttagtgagtttctcaaatttattatatttttatgttggttgttttttacttagtgcacaatatggcattttttcaattgtggcctggcatatgttttctggtagaccttaatattgctcctgaaatttagaaaacacttttaacagagctctttaattgtacactttatggtgaagcagatctgagtctttgatgtagatgggtagagtaaatagcaagtaaggcataaacatagcttgcaaagtatcacgacacttggatgtcagagtggcctggggcaggggtcagcaaactatggcccacgagccagatcccatctaccatctgtttttgtatagcctgctaaaaatggtttttacatttttaaatggttgaaatcaaaagaacagtatttttgtagcatgtgaaaaataatgtaaaattcagatttcaatgtctataaataaagttttatgggaacacaaccacacgtttgtttatgtattgtctatggctgcttttgtgctagtgacaaagttaaatagttgcagcagagaccatgtggcttacaaaatctaatctattgcactctctggccttttacaggaaaagtttgccgactcctggcccgggacttcagtttccttgtgtaaaatgaagttttgttttttaagattttatttacttattttaaagattttatttgtttatgagagacacaaagagaggggcagagacacagacagagggagcagcaggctccctttggggaacccaatgtgggactcgatccctagactccgggatcacaccctgagccaaaggctcaaccactgagccacccaggcatccctaaagattttatgtatttgacagagaccatgaacggtggggagatgcagagggagagggagaagcagactccctaccgagtagggaacccaacacagggcttgatcccaggaccctgagatcatgacctgagccaaaggtagacacttatccgaccgagccacacaggcacccctaagataaagtttgtttaaatagttgtttggattcttttcagctttgacatcttaagctatctgtagaaagtatatttttatttgaaaattgccagagagaaggttgtatgcatacatatgtacattgtttgtagacctttaagcaaatgtgtttcattactcttttatcttactgcccttgacaatattctttttttaaaaaaaatattttatttatttattcatgagagacacacagagagagaggcagagacacaggcagagggagaaacaggctccacgcagggagcccgacgcgggacctgatcccgggtctccaggatcacgccctgggccgaaggcggcgctaaaccactaggccactagggctgcccaacaatattcttcaaaactactgaattacaccacaggattaaagggccacaaggtctcatggctgttttcagggcctatgttggtgtgcttcctttctcagtggcctcagaatgctaacaggtgtcccaggtggattgtgaggcccagcctgtgaggatacggagagtgtgcagctgggtgttttgtcctgtggtgtctggtcccaggctggcagctgggaataatggcagaaggcaaactaagcacagactcttttcttcatcctgtcctcattatcctcagtaaaagaaaagggacccagttgtcacacatgatctatcagcccctgtaaggatcagagttgtaggaaatattttgctttcacataccaggcatgagtgctgtgacacaaccttcagggcttctgagtggaggccctgtttactagctcaaggagaattgacaccagaaaaaagctcacctcaagtgaatccactaaaaaatggggaccagaattgaatagtatgtggtgggggttggaggttagaggaagtctgggactactgtgaaaactgaaaaaaatgataaaagcatattcataatttcagatccacttttgtaatgaagaaagagcaaatgctgtgtttctcaagtgacaccatgtctcataggctgcaatatccttcccgttttgatttttgtagcatcatcatagaggaaatctttgcaaaaatatttgaggtcttcctgcgttttcctcaatcttttgataattccattgttcttttttacaagttatcttggtgatcactttatcaacctttcccttttggtgtctggtctgagcctgccagatccacatttttgagagctaagtagttttctagcattatttatcaagttcaccaaattggccatcttttgcaagatttgcaattattgcagttaatctgcactatatttgtgtcattggtcctatgcctataatacagagaccaacagaggactagaatgtgtaggatagatgctctgggttcagatactaatgaagctaggagggactaaagtccattcattagtgaatgtttttgtgtgacaactttcacttttctgcatgatctaatagctacgaggacttggccaacaaatatgcaaatgaagacctttttaatttatagtacagatttttcttttttaagatattatttattcatgagagacacagagagagagagaggcagagacacaggcagagggagaagcaggcttcctgcgggactcaatccccagacctgggatcataacctgacccaaaggcagatgctcaacagctgagccatgcaggcatcccaatacagatatgttttaatacacatatactttgaacttagcatttacatttttcaggacttagagacctcacaagtacatgaatggaaaagtaaaagcgttattcagggtcttgttctttaagattttatttatttttgggagagacagaacaagcatgaacagggagagggacaagcagactgtgctgagtgcagagcctaacgtggggctcagtcccaccaccctgagattattatctgagccaacatcgagtcggacacttaactgactgagtcatgcagatgcccctttttattattttgtttttaatttgttttttgagagagcgtgcatgagtgtgggtgaggggaggggtagagggagagagaatctccagcggactcatggctgaacacagagcctgatggggtgatctcaaaaccctgagatcatgacctgagctgaaatcaagagtcggtcacttaactatctgagccacccaggtaccccaaggtcttgttctttataatagcaaaatattggaagtaacccacatatctgtcaatgagaacttgattaaataccatggtcgtcttacagtggactaccatatatctaggcatggatacatgtgcaagataggagggagagaaagtgagtggcaaagtatcatatgctgtcctccctttttactgatagaaagatatggccaggaaggccctagaagaacccacaccaaactcagcaactgtatctgagaggtagaattatagaaggctctaatttgtgtgatttgttgtgttttgtaaaacaacaacaaaaaacactgaataatttattttgtaatctgaaagctttaaaaaaagtttaataagattattttgtccaaatgaagttgggggaaccattccccaatttcagttttgttagtgttagagtgcaactttccaagacgggagaacacatgctggaaaggggttgttgcacctagctattgggcctctgaaaagcagaacaccatcactcctttgtagcaggattctcccccccagctgggagggcttggtagtttcttccccagtagaaaagtgtatttgagggatctgaagctggatttttcaacttttggcactcttgacatcttgggctgggtggttacatgtggaggctgacccgcatggggttgttacgcagcaccccgacttctactcacaagatgagtggcatacatactcccttctcccagttctggttgccaaaaatgtctccagacattgccaaatgtgccctgctgcaaaactgtccctagttgagtgagaatcactggtctaaagctgagacccctcagggggccctactggctccaacagtagaaagtgtgactctttgatcttggagtcatgaattcaagccccacgtcgggcatagagcttctttttaaagaggttttgttttctttttttttttttaaataacaaagcggagacacttgtagtcttgcagaatagcaaagaattgaagaaataattgaagactaacacctactgacctgttctcacttaaagaaataggaaaggcctttttaaaggtgggactatatcttctttggagaaaaggaagatgttagttcagaaaaaaagtatgcttgatactggattgaggctattccatttctcaaaaaaagaaaaaggaagtgggtgtcaaatgaataaaattattctttgttcagaagcgtatgggccattgccacagccagaacatttagtaattaaaccggggtatgactggaagattttcttaggcaggtgatgggtaactgtggaaagaatactgggttttgaagtcataataaatcccgggttcaaatcctgactcaagcttttgtcaggcatgtgacactgggatagtttttttggtttccaagtgattataaagattaaatgaaataaacctctgtgtgcctcgtatgttgtggtacccgaggcactggttagtttgtatctcactggggctgaccctgggcgttgaggctttgctatcagggtgagtgtggagtgtcctccctccagtgtgagcctctaaaaccatgtggaaggagagctcccaggacaagatagtccaggaccgagctccagtgcagtttctggacaacttccattatcaaggccagagtctgtggtctgagtatgcacagccagagggactttttaaagattttatttacttgagaaagagagcacaagcagggggaagggtagagagagagaagctgaacaggaagcccgatgtggggctcaatgtggggcttgatcccaggaccctgagatgatctgagctaaaggcagatgcttaacagactgagccacccaggcgcccttactgcaaagcttgattcattcagtttagagaatgtactttatctagaagtcactaagaagccaagtgaggaagtaaccttaaatccagttttggaatgaagaaaatctatatataccacgacctttggagaaggaggacaaaaaaaaaaaatatatatatatatatatataaggcttgacatccccttgacataaggcttgacatccccttgacagagaactctgatagagttctcaaatctatcagatccaacatgcttttgtgtaactaatatttcaaaacatccactttaggatcctgaagtgaaattcatagatagcatacacggactcacaggattccaaaggagataaatgatctaatataaatgatggataaagaaaaaagatacatttcaatatgtaaatactcaagcataaatatacaaaagacataatgaaggagttagatgcttgcacctaaacagaattgtcttgaatgtgaccacggcatcatgttgtcttggcagctcagatagcacaatacatttcaaatgaaacagtatcatcttttttttatttactcagttgtgatcctggaaattttaagtatatacacaacaacaaaaaaaataccaacctgtgttttatacatcaaatcaagttatagtctaggctcggataacgataaataggtttttccacctacgtgtatgtccagcaggacgtattttgttaaatgaagcaattcttgttgagaatctcactctgcacgatgccccttgcatgcaaaatatcagaaaaccctggtcatggcgacaaccataaatgaccccgtgacttcccaagttcacccttggagaactgctgacgtagacagaaatggcccgggggctgtggactgaagcctccaaactgaaggacagatgtgatttcctcttccccctaccccttcctccttttccctccttccctactaaaaagtaattattttattgaacccctacgtatgctctacaagtcatggctcaagttctcgtccaaagtcacattaccaagactggaatcgacaggccatcctggaatcgacactgaaggacttcttgttccatggagttttacagcattgatgttagacacgcctttcttggtttttgaaagaaaatcaagaaaaatgtatttattctgcatagtttccctaaggccttgccggctgtttctagccctaactaggtgcagggccacacccaggtcccagcccctctctcttgcctccttgctcaccagggatggagatgcaccccccagtcctcaggagagaagcagctacccatgtcctcctccaatgcttctcttcacagctcgcgccctctggcaggctctacgtgcagaatgccaccatgtgttctagccttctctcttctggtctttgtgcggggcattccctctgtgcagaagcccctgccttcttcctcactcctcaaggctaaccagctctgtccccctctgtaaaccttccctggccatccccaagctgggattcagggtcccttctgtgtacctcttgtacttgtctgcatccatcggtggtggcgctctcagcactttgtcattactgttttgtcattgcctggtgtttgtatcacctgctcaagagaaaaacatacaaaggttaaggatgcgggccccggaaacagtgtgcctgggtccaagtcctaacccctctagctccaagtggtacaatcctgagcaaattacttcgtctttctggatctacctcatagggttgttgtggggattatatgcgtcaaggcaggtaaagccagtggcatacattaaatactcaataaatgtcagttcagggctgtacgtccttgagggcacagactgtcttattcacgactgtgtcccaacacccagcatgggacctggcacacagtaggcagccaacctttgttgactgagtcagtgaatgactatcatcttttaatcacttgcagaccatcttgtcctctgcttcctgtttttataatcaacgatctttaaaagcaaaggccctctaaagaaagaaaccaaatatgtacagattatctgcccaaagaattggtgctgtgcagaagtcgccagtttgagacaagcgttaggacaattggattctgattctcttggctacatcttgctgtgtaatttgagttggatgcacagcaatttaatgacttggaacaagaatcaaaagattattgaaggtggctgatggccacgatccaggtaatgcctactgtttccccatccatctgccacttgaaaatgaaaatcccagggaaaaagaaggggaaattggaagtcattatgatatctttgctccctcattcaaccattgcacaaacacctgttgggtaacttgtatgtgtcaggcaccgggaacatggggggaaaagaagatttctgccctctccgagttaacattcttaatggggaagatagtagcaaacaatgtaccatttccctggcacccctagaacagaagctctgagtgctcattgttgggggccatttcagggccaagggtaccttggatccacctccctggcactcagctgccagactgggattttgtcataggagtcctaggccctcgtgtccttgacctgatcagctggctccacttgcagggctgccaatgtagtcacctgtttctggttctgaggtgtaaagtcgtcacctgctgccattacacaaagatccatttcccctggaccattgctcaggtatgacacagctgatggtcggggccctgtagcaaaacctcacacccacggctctgtccggtgacagaggcagtgactatctgatgatgggtgctgacaaatgcttgtggtggggcgtgtgcccatctggaggctgtcctgccactaacaaaccccacccgttccccagctgggaaacaccacagccaccgcaccgagcttctcccagttttcacctgcccactgcaggtgtgtgttttgtttttaggattttatttgagagagagcacgagcaggggaagggcagaaggagagggagaagcagagccccccactgagcagggagcctgatgtggggctcgatcccgggatctcaagatcatgacccgagccaaaggcaggtgcttaaccgactgagccacccaggtggcccccactgcaggtgtttctgtaacttgcaccaggctttccagcgtcaaagcaccgaccgggttgctttttctaactactattactcctccacagcacaaaacatgtttattgttgaaaaaaatttcggcgtagcaaggtaacttccattaacccactccctagaaataatagctgttgaccgggtggctcaacccctagatttttgaaatctgcaaaaatacgtaacttccattgaaacgaaggtgcattatcctgccgtctgtgtcaataaatggcactgagacagctggacagttactttcctccttaggcacaatcatttccagataaagcaaagacttaaaaggagaagggcttccgaagtatgtcacaaaatccagaaaccataaaggaaaaggctaattaattggactacatagagaccgtaaaacttcgtacattagaagcagtttggcaggatttagcgaggggggaagctgcatgcacctcacgactccacgttctccagaaactttcccactgggctcaagggaataaatgccggggacttttcactcagcattacttgtaagagcagaaaaaacctgaggggcacccggctggctccattggtaaagtgtccatcaaacccttgatctcaggttctgagtttgagccccacgctggggagagaggtcacttaaaaataaaaaaatttgaaaagagaagaaaaactgaggcacacctccaagtccatcaataggaggataggaagatagctgtagtgcattgcgactacaaaatccgacacagcagtgaggacacacgatctggaaggactcccctcccctccaggttcagtctgtgtcccagagacaaggagcggtgtctagaggcatttttcgttgtcacaactcggagggtgagggctgaggtgctggcatctggtgggtagaggccagggctgctgctatgatacacaggacagcctcccaaccccaagaattatcaggccccgagtgtctcggtgctgaggttgagaaatctcgagtgagcctgaattgacaggggcagatcccaccagcaatcttgagtgaaaaaaggaagttgcagaatgatccagtttgatatttttacagatacatatatagcacaaaaatcacatatgggaataatgcacacccactctgcaaatctggaacgatccatccagacctgttttttttttcttttatttttttctcatgatgccggaaaggtctctttattgacatagaggataaatagtagtgacaggtgtgtgcccccttgtctgttttatgtcgactaaattgatagctatgcaattctcaggataaacgaggtgcgcattttcaccgttgagataacatattgttaaaacggttctcctaaaagcttgtgccaatttccattcccacctgcaggtgacagttgtcatttccttttttgctctgcctccttcactcgggtatgagcctctcgaggacagggctggcgacccttgtctgtgtgtcttccatgtcttgattggtgcttcaacctacaatctggtcaaaaggactaaggctttggtttacattgcgaaatcgggtcagaggacagattgccacccatatcctcaagaaactcccagagtagtttcatttgtgtgtcaccgacaattccagtgtgagggtctgctgtgtcctacgggcatctgagaagagagaggccgcaggggtaggagtggtctaggaagtgctactgagccaggtcttgaggcacgaggggcctccccatccttggagaagcagaggaatggcattccagaagggcaacagctcaagcaaaggggtggtgccagggatgagtaaggcatgtttgtgagacaggacggaggccattggtgcacagacgcctgaggaggatctgattagcacggaaggtggtgcctggtcgggggcaagccttatccaacaggctaagacgtttgagctttttcctggaggcacaagggagctaacagggatggggaggtagaggaagaaaggccgctctaaccgggcagatctgtcacagctgggccgccgggcaggtgcacctgcactgggctcgctggccagccgccccgccgggcccccctctgcaggcacccaaagctagatccagccctgggtgaggaagggtggcccccgggagggacaggagagagccaggggggcctgtgaggcagggagaggcacagtccccggggcccagaggacccgctggcacctggcaccaagtaacctgctgatccctgttgccacatccaggcgtgggctgacagcgccggagcccactcgtggtgactcttgacagctgactttgtgcctctctcctcaactgcatgttcagtgacaacaagctggaagcttgaacttggtcccggtggaagtatttgcaccatggaaatcgctacgcactacacatgggggctctctgtcccccagcgccagttttccaacgcaccaatggctatttccttctagaaatggattctgcgattagatttggggaaagatggaagggagattcttgtttagggaagccagatggaaactttaggaagataagcgtgtggccaaataatggaggcaccatccggagaagtgaactctgattccggaaggcaaaggctgggcctccaggggcgcggtccatgcagctgagtgtagtggtcgccagcactgagtgcacctgagactgcacgggcttgaatcctggctctgctccgcactagctgtgtgaccttgggcaagtcactttgcctctctgtgcctcatgtttgtcatatgaaaaatggagtgtattattaacgcatctcatagggtccttaagaggatgaaatgacttagatggacataaagcccttagaacaatttttggcaagaaatcagggctttatcaatatttgtgaaatacacaaaagagaaaacagaagtacccagagaggcagtgtgacttacctaaggtcacacagaaaatgagcagcagagctggcatcagagcccaaacgtctgccatggcagatggtcccactagtcttatctggctttctttggcctgcataaagattgtggggctcctggggatgatgattcatgtgtcctggtgttggatgtttacgtagaaagggtggaacaggcagtggcctctgccctggaagggcaggttgttgagatgccctctggggtgcacagcctccttggcctggactggggcacccaggatcccaggcaggacactgacctattactgcactttggcaggtcattgagctgggatggccccgggcccgaagggagttggccaacctatgagttgcaaacaaagaagacagagatgcttttgttgagtgccccctctacgtaccggcagctcggtcagtcaccacatgcaggcactgttctaggcacttgagattcagcaatgaacaaagtagtcaaagcccctcttcctgtagacccgatgttccaggagagacagatgacaaacaagtaaactgagggtcttaaaggaagagggggccgggagaagcaggtggggcatggctggcgatggggtcaggaaggacactcagaggaggtgatatatgagcagtcctgaaggatgtgagtgagcaaccgtgcgtccatagtttcatgaaaccctcctgctccctcatctactgatgaggaagctcagaggcatgcattcacctgctcgaggtcacacggcccataagtgttggcacgagattcaaacccagctctgcctcccagtccttgttactccccagagtagcccaaggacactggggtcatcacaaagcctgggtgtgtgtgttgggtgggggcagccagggtcacggggctgggagggtatatcctgggcgactgaggtgagcaggtctggagttcactctggaacacctccttgaagaggtgggttaagagctgaatcttcaagatccggaaggaagggcaattctaaaggtggagggtctggcttatccacagggtcagtgggaacagtgaaggccgtaggcagggaggcacccgctttacgatggaagttcagtgcaaattctcagtgagagaagaggtcctcaaattcaggtcgtgtgcccggttcttaatcaaaagccttttaccatcacacagaggagcatgacgcccataggccctgcctcagagagcaatggaacagtacaagaccaaacagcctccaggatagactgtgtccaaccagagaccacacgtgccccccaccccccaccgctgcttcctcagctcaaccatttggctcttcaaatcccatacctctcattgcctcttgaaccaacaacagacaaaaatctttggttcattcattcactaagtatttgttgagcacttactgtggaccacgcacagtgccaggggtggggggcctcagcagtgaccgagatgctgccctcaccctcactgagtcatctgtccagtggtggaggcagacatttcatggaggacagtgcagattaattaggattctgaggaaatgccacagaggacaaagcagatcaaatggagcagcgtccgcgccatccctggagtagctcaccagactcacctcaggccacattttcacaggactgggccaaggggcccgtgtctgcaggcccggcaaagagaggtgggtgttggggtggatggagggcagagcaaggaacagaacttgtatggtgtgaggaggggaagtttacctctggggccccgaagccagctgggagcgaccactccgccagagctgtccccaaccccgtcctccaccagagggtgccccagctgagggcagggagaggacctgggcagaacgaggaaaggagagagaaagctcatgcagttgaggggcacctgtgagaagggggagcccgatattctgttcttgggatggatgttctgctcaggccgagtctgttgactggccccagcccccctagaaggggaagaggtgctggggaacagggcccagtacccagaggctggtgagctgctcttctgtggggctgagcagagccggctggagtgaagaatgaggggggtggggtggggggagaggtaggcccagatgggggaacccagtggaaaagttgggaaggcagacactgctccccccacccccgcgccgggcacacctgcacggctcccacccctgcgcagtgaggtgctgctcacagatctgtctccacgcacaagcactcctagtccttcgtcgccttgcctggcagtattttcttcacagtgcttagccctgcctgactgacatttgcttgaatcatctgaaatcagcaatttcatgtggctcaacctaatgccaccgatttgttcagtggttctccagctgcctccgcagcaggaaggtcagctccatgaagggatggggggtgggggggtggggtctttatctgccacatttcagttacatccccagcacctgggccagtccctggcgtgcagtagaccctcaataaacagtgagtggatgggcgcaatgctgggttaaaggttggggggggcggggtggaaactaagaaacagactcttcactccagagaacacactgatggtgaccagaggggaggtggcgggatgggggaaacaggcgatggggattaaggagggcgctggctggccgtgatgagcaccaggtgatgtgtgggtgatgaatcactctattgtacacctgcaactaatactgcactctatgttaacaggaatttaaatgaaaacttaaaaaatgttttaaaagcgcggcgcctgggtggctcagtgattgagcgtctgccttcggctcaggtcatgatcccagggtcctgcatcaagctccttgcagggagcgtggtctcccccctagttaacaaggcacagggcagccaccacacgcggcgcggtcttccctctgcacttccctacctcctctcaattttgactgttttgtggagttttgaaagcccttaaggagcaggggagtctctcagagctggaaccagagctctctttccattttgtcctgacgagaccccaggcacatcatgctttctcactttgtagcagtctcctggccaattgtggggaggatgtgagtggctggccctgcgcttgggacagggagagctgtagtgtttgaaaagtggtcagattcccgaggcaggttggagtctgggtggccagggtggagggcacgggcagccagcctcgttgttttgtgaggcttttgtctctgtcctaagaaaccagtcatcagtaccctcaaaacccatgcccttgccctctgatatcactagcaagacaacacaatagtcacctcccagaggttgctgggtgctgggctgcctacttggtggttaaaagtgcagattctggagcaggacaacaggctggaaaatcacatccaccaacttcttggtctcgtgtgactttgggcaaatcacctaacacctctgggctacggtctctccatctgtcctaggggaacaatagcctccggacaaaacaaagcagctctgacatcccggagctgcctggccctctcagccaggccttggtgttgctcagagctggcctggcacagctcccccttggtgtgctcctgttgcacacagataaggccatctgtgaccgtgataggtcaagataaaaacaagaccattccataatcacgtctgaaaacagacaaaacatgaatcttgtccagaccacaaaaatgaccaatcatcccctgcagagctaatctgagtaaaggctgcttctcaaccaattacggcttctcccttctccggctggccctccttctaggtaagatttaagatacccagcccggcctcgcctctacttcctgacagcatctaatccagatcaaagtcttgcttccttaaacccttcgccgatcacctaacacaaatgcagacattagagcaagtcctttctagcaccctgttaccaagacgcccgtggatccccctcatgcacattcctggctgcaaggaacaatgaaccctgcttgttcactcacaggtgtgcttcacgtcacctttggctggaggcactgacaggccctacctcgtggggttgttgctgtactgccctagggatgacacattcccaggactctttagttacatctgccctgctttcctatcacttccactttacaaaggtgtcactgagacttctgcagagaagggcagtagctttgttcagggccacacagccagtggtgcagagttagggtggcaactcgggcccccttccaaagttggcttcctaaccctcttgcctccaccttgcctccagggcagaagccaacatgacaacgttgggccaacatctgggaggagaagagcagagggtcttggagttgaaagagaagcctggggctacaagaggggcacacccaggacgtcctcagggaccccctatgcttcctctcccaaccgtgacttccccgactggatcctccaagggattcttctctgaggatgtgtgccttctgagtaaacacaggcccagctgaggcccgagaaggtgggggtcagtgtcatcggactgaggcctgagtcacttcctgaccattgcttaagaggcatccagtgccacagcctgagtggccagctcatgccctcacaggactcgggcaggtgcacttccctggtattcctcagctttctgggctcacctctgcccatgctcaggttattgagacatacaacaaagatgcagaagccctgtccctgccttggggaactggatattcaacccgaggtctctggaccattctatcttgccttgcacctggtcctgaactccggctcccaggacctcaccccagcttcagaatcaggatgccttcccctggcaccaccaaccccaaaggtccaaatctcctgcagcccttgcaggcacatagccccttcccttttcctcccacaggtcctaggatcagagtagaggatggggcagggaagatgccagatgccctagtgtaggatgtgcagagggagacatggtttgatcagtagacatgtcctcatgatgcgagtaggggggctggtttgaaatacagaccatttcctttaagaattaagacctttcaatccagagacatcgcataggcttgcagctgagaacacagcctctagagccaggctatgctcccatctttaacccagctctgccctttagcagccgtgcaacttgcagcaagttacttaacctctccctacctcaggttcctcatttctaaaatgaggataataatagtactgactcatagatctctcaccaggagtaagggagttgtatatgtaaaacacttggaataatgactggcacacggcaaacacaagtgttcagtaaatagttcgccactttgaatgggccgactcctccattcattctcaatacagtttttgacatcctactgtgtgccagatatgaataaggcagggtcctggaatgtgatgcctgctgggcatttctgtgggatccccgcaccgtccccgtcctgcagtggtctccagactgtgcctgatgctgaacgacgctgggagtgaccacggcccagggcttgggccacaagcaagttccttgccttcttcaagatctcttctctccctttgattaagtgaagcgagtggtccccaccccttccacgaccccttccctgtatgagcacagaatcagccaccagacacaggtggcagaaggccctggcccgtcattgccctcatggggcattaggatgccagcaaaaaaaaacgttcaaaattggaaatttgggcctggactggaaagttggtgctatagaatcactgttggtaattttagatgtaaaaatgacattgtggttatgtcttaaaagcagtccttagcctttagagacacaaaaaatatttatggatgaaattatatgatacctggtgttgcttcaaaatgatggaaacaaaactggctgagagtagggacgcctgggtggctcagcgggtgagcgtctgccttaggcttgggatgtgatcccgaggtccgagatggagtcccgcgtcgggctccctgcagggagcctgcttctccctctgcctgtctctgcctctctctgtgtgtctctcatgaagaaagaaataaattaaaacaaaacaaaacatcagctaagggttgatataactgttgaagctgcggggctggggtcacgatcgccagaaagtgaggtcccgagagtctctgagcggagcgggttcgaaatgcacaatcttggctccgccccagatcaactgggccagagtgtgcattcttttttttttttttttttttttaagattttacttatttattcaagagagacacaaagagaggcagacacaggcagaggcagaagcaggctccatgcagggagcccgacgtgggactggatccgggatcccgcagccacccagggatccccccagtctttctaagcaaacacaagtcccaggggattcagggcacgttcaaacgtgggactcaccggtctcgtctgtctactttcgtaccttttcgaaacttgccgaaatcaagagttgtggggttttgtttctccagaatcgtctccaccagctccagccccaagcacgcgactgatacactgagtctcatcactaccttataatgaattcattgttttgttttgtttagctcacgtaaggggtaattcaaaatctgcaattctaaaaacctctctttagggatccctgggtggcacatgggtttagcgcctgcctttggcccagggccatcctggagaccctgcatcgaatcccactgtaggatcccggtgcatggagtctgcttctcccgctgcctatgtctctgcctctctcagtctctctctggcggcatcannnnnnnnnnnnnnnnnnnnnnnnnnnnnnnnnnnnnnnnnnnnnnnnnnnncgcgggggaggagcgggcggcttttctgccccggtgcagggagccggcgggcggcgatcgcaggcgccgcgctggggccgccgacgtcgggcgcccgggatgagcttcacccggaaaaagggcttctacaggcaggacgtcaacaagaccgcctgggagctgcccaagacctacgtgtcgccgacgcacgtgggcagcggggcctacggcgcagtgtggtgagaccccggggcgcggggcgcggggcgcggggcgggcggagcctcccgaccagccgggccggcgccccccttccccgacccgcctcggggcgccccccgcccctgctgggcgctcggggccgcgcgcgccacctccgggggggggggggcggcccagggtcctgcggggctggtcctgcggcgcttggagctgggaggaggccgcaggcctcaggctggggcagaccgggcgccacctcactgttcccaccggctttgtggggtctctgggggctcaattaggactgggggtctgggtccccagcgcttgaatcccacaagggaccccagagttcatccgggttacaggtgggtacaccgagacccaaagagggagaagtgcgacttgccaaggtgcaaagagtgagcccccctccgggctctggatccggttcatgcacccctcggtcactgccgcccctgagggcactgggggctgctccctcaccttgcggctcgtgggctgccttctgcgcagcccagcctgctgcccgggaggggtttcggtgaggatggcctgggctccccgcagtggcctgggggatgccatccgggttgtggtgtgggggctgctggcgtggaaagaaagccacagccccccggacctctgcccgtgccctgcagctgtgccatcgacaagcggtcaggggagaaggtggccatcaagaagctgagccggcccttccagtctgagatctttgccaaacgtgcctaccgagagctgcagctgctgaagcacatgcagcatgaaaacgtaggctgggcctgggggaccggcgggtgggggcggggcccccaagcatcctgactaggtgcacccttcctcccccacttttgagtgtaggggagatggcaagaaggccgtgagagtacagatggctcaggaggggaacaggggaaggggaatctcctccctgcccctcccaccactgttcctcacttcattaaaatgaggtgccaggacctgccctgcctacttccaggaagggtgcaaagtgtgtttttggcagtggagcaaaatgaactttgtgaggtgcaaacttactgtttcacattacgaggaaatgcacacggaggaacctcgtagttcgttctagctctcagagctagggtgcccagcatcctggttactgtggcttccacacgtggctctgccaacgacaaccagggttccttgagccctctatgtgccaagtgctgtcctcggagctttgcgtagactaacttgtgaatcctcacaatatcacgggagtggagtactattacttccatgtacaggaggggaaactgaggcacagaaagactaatgggttatatggttagtcagtgtcagagctgagatgtgaacctaggcagcctggcaccaggccttagtgcataaccactggagatcctgtctgttagaaacccctgggaagtctagcgacccagcgctgggcctaacaactgggctttgctccaggatacgtagattggtaaaataatgattccaaaatacggtaggcaagtaggaagccctgtccctcttcagcaaacccctccccatagccccccaccccccaccagggtgacattgcccctggctccgaaccaggccttgttccctccttgattcccttcaccacttgtggtttcctgcttgagtggagggtgaatttgcaggcctgccttgaaccccagacttggggctggtagacacagggatggccccctccgcttctccccagcctgacattccatcactgtgccctgcgagctccctcccagttaaggggattcctcttctgcctctgcccttttctctgctccccagaaggctgggaacctacctcctgccgggatggttattcagagagggtgggtggtggtgggtgcagctggggctgcaagggacagggggagagggctgtggcgctgcccagcctcactggcaaccttctctcccaggtcatcgggctcctggatgtcttcaccccagcctcctccctgcgcagcttccatgacttgtgagtcgggctgcactgggttccagggcgttctcaggcctcactcgctgctctgcctgggagccagcagggcgagcccagactgtgtctctgggcagggcctcctgttccggctgtacccgccccccatgagtgatgctctctggagattctttcagctggggatggagagaaaggcaggcaggcagggggggctttgtggggtgcttgcctgaccagaactgtctgttcagctgctgcacttaactgccctctgtcatcccagccaggacctcactggcagtcctcacagcgtctgcaccaacttacctcgccaactctgcagggtccctggtgtgggtctggaccttggggctcttcctggcaggaagcaaggatcaggaagtcccggccacctctggctggtggggtatttgactgagtcacacagaaccagaaatcaatagttgattatagttgttaaatgcatggctttgctccccaagtgcctggtcttaaaacgtaggaaacctttgggaaggtagattcgttttccttttgttcccccatccctatttcagatgcagctgaaggtccctgcttttgttttaaatttaatggggtgattttgaaggaaggtttttttttttccctctaaagccagctatggggcttagcattgggaattaatttatttttattttttttaaagatgttatttatttgttcatgagagacacagagagggagagaggaagagacacaggcagagggagaagcaggctccatgcagggagcccgacgtgggactcgatcccaggactccaggatcacccactccctgggtggaagggaggtgctaaaccgctcagccacccagggagccccagcattgggaatttaaagtggaccagcccccccacccagccccaggcagggtgggggtacagcttctaaatgcatagtcacagtagtgtggttggtgctgggactgcctgctgcctcggggggctcagcccccaaaggatgaggaggggtttgctggaggtaaaggtgcgggaagcatcttaggtagaaggaattgtgtggacaaaggaaaggccacggtgcatgagcctggactgttaggggaatattggtgggttcaatgtggctagtgaagaccagcggctggtttggtcattggaagagtccagacttaatccacaggcagcctcgagtccatggtggtttcgaacattggggtgatgtggacagatcagatttgggggatttggcaggagggaaaaagcagggagcagctctaggagcagagaaagcctggtgagtggtgtcccagacccagaccttgagctaactaaggcaggggtgatgggaggccgagagcagacttgaggcccatcaggagataggaccatctaaaggtcgtatctgttgggagatgcagtggccaggagagggggcgtaggtcaggcagccaggctcgggcctggaatacaaggtagaggaagaacagatcttgggaggcacataacaaattccatttgggacacaacttttgaggagcttatcaatgttgaggtgtttaatcagcagttgcaaataaatgtggagctccgggggatctgagctcaggtggaacatgatgtgctgctgctaagaggtcaacagagaatcttgagggagtgtccgattttgctagaggtcccataggaagcaagggaggcacgggtgtgtatattgggcagccctcagtgaccttgattcgagcagtttgaaggggtgggagcaggcatcaggttgtcaggggattggaagttaaggcagtgcgttgggaggtatggactactccagaagttcggttggggagggaaagaggtaaaaggggtggttattcaaacaaacaagtcaaggcaaggccgttcaagcacagcaagacttcagcaaatttgtcagcagagaagaaggaaccagggtccatgtggaggacaaggacgacactggggagggctgtgcatggagcagggtccccatgggggagaggggatgatcagagagaagaaagcttcagaaaatcacaggtgtggggcgcccaggtggctcagtcggttaagcgtctgccttcgctcaggtcatgatccctggtcctgcctggggttgagtcactacaatgtcagtcttgctctctgctcagcggggaggctgcttttccctctccctagtgctctctctccagcgtgttctctgtctctctctctctctcaagtaaataaataaaatcttaaaaaaaaaggaaatcacagcctcatatagacggcctccaccatatcctttcttttttcttttttggtaaatagtcctttctaagtctatcgtcttttgttctggactttgctattactactttggggaacagctatattttgctgaccttgacctgttttgcaatcccttcggagagtgcagtggctcagctactccttcctcctgccctcctggaagttgtttgattaccgccttctcggaagggcagacggtcttggctgtttgcggagctctcccagcctgggcatgaccctctgggggagaaaacgtttggatggaagcagaaggaaatgctggcaggtgtttctaagtcacagctccagctttctatggggcacggaggagggcgaagagagggcacctttgaagagagggagcacagctccatttggttttcctgggcacgctccagctgaaatgcttgcccagagtgctgccaatggggcagccagcgtagccaggctggaagccagaagccagggggcctgtgtgggggtctggctggccgtggccctggaggggctggtgactgcaggcagaggctgcccctgaggcctgtctgttctgccccagcccctgtgcctcctcctagctcagaccggggctgggtgggcctggggactgtcatgaagctcctgtgctttgcagctacctggtgatgcccttcatgcagacagacctgcagaagatcatggggatggagttcagtgaagacaagatccagtacctggtgtatcagatgctcaagggtctcaaggtgcatgggggccgggaaggtggctggggggtgggtggtgccttggtgtggagaactgaggccgtgggggctgggagagcacagtgggacagggtggaggagtctggagccagcctgaagcactcgggatcaaagctggccgctggactcatctctctctctctctctctctctctctctctctcagtacatccactcagctggggtcgtccacagggtgagtgctttgtctgctgtggtcctccgaggctcctccaccctgaagggattctccacagtcaggaaggaggaaaggagtaggaggcaaaaatcctctggagcctggaatatggatttttcagacccagccttggcccagaaaggccctgctcagaagaatgctgtgttctggggaactttctggatgctacaaacaaagcgagccttgagctaggtgtttcagctccaagaatcaaggatattttagagctggacaggcccaacaggacacccggtccagccctcattttacacacgaggagactgacacccagagagaggagggggacaagctcccatctcagcctctcagcccagtgctcactctctccctcatctaggacctgaagccgggcaacctggccgtgaacgaggactgcgagctgaaggtgagtgggcgtgggcagggtcagcctgggcacagggtgggcccccatcccctggaagcccccagaagctgctcctgtccgcagcaactctctccctgtgtcccctgagtcacagatcttggattttgggctggcccggcatgcggatgctgaaatgaccggctatgtggtgacccgctggtaccgggcccccgaggtgatcctcagctggatgcactacaaccagactggtcagtggccagccacccagggagggccaggggccttccctgacagcccctcaaaggccattgtggttcctctgggctgactgcctgcggggtcagctggtccaggtgatgcttcctcccctccctctgcagtggacatctggtctgtgggctgcatcatggcagagatgctgacagggaaaactctgttcaaggggaaagattgtatcctttgctggaaaagccagactctatctggggattcactccttcaacggacaccttattaaatctcgctcttttgttttctttgttaatgggaaagtgatacactttacatacatacattacagacactgtacatacactgtaatgatacagtgatacacgctcactgtagaacaattttatttatttatttgatttgattacttttttttttttttaagtaggctccacgcccagcatggagcccaatgtgaggcttgaacttacgaccccgggatgagacctgagctgagaccaagagtcagacagtcaaatgactgagccgcccaggtgcccctcactgtagaacaatttgaaaatgcagataagggaactgctggaaagcagtcacctgccattctaccaccatgtagaaaatacttcacattttggcaccacatggactaattgagcggccgtgtgtgctgtgtgggctttgaggggaacatgtgggatctgcgctgcccaccttggcctgggcgggggcggggaggtgacaaagagatggaggccagctgggatgggagctgggaaggcggcctgtccgggagcatctgtggggaaggaccctaacccagcctggcaggtgggaagcctcccagagacctgcaccccctcctgggagcatgtctggtgcctggatggttgccccagtgcctgggtgggagtgatggaagggcgccacgaagggcagccccgatccaccagcagagaatgaggccgagccttaacctgctgccaagacctggaccagctgtcccagatcctcaaagtgaccggggtcccgggtgcagaatttgtgcagaagttgaacgacaaagcagtgagtggcagatgggtctagaccagcctcggctgtgcacttggctaaccaagggtcacgcgggctctgggcctttgggagggagggtttacttatcctctcctttttgccctggcaggtgctctggccttcatccggagccatcagcccagctctggggcttttctggagtccctgccctataccccgaagcctgaggcctgaggggctgacagttggggatcactcacaactcttctgtcttccaggccaaatcctatatccaggccctgccacagagccccaagaaggatttttctcagctcttcccgtgcgccagcccccagggtgagtcctggggctgcccctccgggcacctgccctcgtccccgtgggcggctctcccaggcctgggatgtgaggtgctctctgtcgctgcagctacagacctgctggagaagatgctggagctggacgtggacaagcgcctgacggcctcgcaggccctcgcccaccctttctttgaacccttccgagaccctgaggaggagacagaggcctcgcagccctttaatgattccttagaacatgagaaactcacggtggatgaatggaagcgtaagagctggaggcctgggtgggcctccctcctttgctccccctgctcctgagcccgccctcagcctgcccgctgccctcccggagctcctcttggagcagacactgtctcctgcgtgcatttctctctccctgcgccgacttctgctccgctttccatgggggagggaggcgtcttccgcgctccgctccgcgctccgcagcccctacccgcctcgagccagcctgtgttttgcagagcacatctacaaggagatcgtgaacttcagccccattgcccggaaggactcacggcgccggagcggcatgaagctgcagtgatctatctagccagacccctggctgagcccagggaccccctcgaggcaccccctgccagatacactgtccccaggatgagatctgcttgtcacgacgacgacaggcccagtccttctgggattatagcctttcaggcggaggagagaggggctttgtcctggggcaggaaacaggcctcgtagctgcagaattcagagatgttggttgggagaaagtaactgatcgcaacgagccacattaaaacatctggagacttgcccacgtgtggggtccttcctttggggccatagcggggctgaggggtgggcctagccgggccaggggtctgtgcactgatggcagattggtttgttaaggctgctgcgacaaatcaccacaaaccagatgacttgaaacaacagaactgtgttctcccacagtcccgaaagtcagatgtccgaaatcaaggcgtcggcagggccatccgtgttccctctgaaggttctagagcagaatccttcctggcttctgtgtagcttctggtggcccctggcccctttggtgtgcctgggctggtcactggctccccatggccctctggcctccgtgcagctctgtccgtcttcgcctgtccttataggaacaccagagattgaatttagggctcgtcgcatcctgtatgacctcatctcagtccttactcattacatccgcaaagaccctattttcaaatgaggttacattctgaggttctgggcagacacaaatttggggaggacaccatttaaccccctacagatggccacgagggaggggccccttccggggccctgggctctgttgcagaaccaaacgtgtttggctgctaaattaagggaattgcagagagagctgcagctggtgagacgttacacgcagggtattttgggtgagtgataagcaatcaggatacgaaacaatagcaggcttgtgggctgggagctgcggaaggcaaaaatgggctttttccaggctttacggaaaaatggctctactcctccctcctctcaggaatggcatgtctctcctgggctttaacctgacaagggctaggatttgtctgtttgcattcaaaaagcttcagtagaaccaattcccaggtacagggaaggagccaggaacctgcccccgactctcccccggccgttgttccagccctgggcactgggggcctggctcaaaaatgcaggttcctgggcactaccccagagattctgatttagcaggatatgcgggcgaggcctgagaacatttgaatgaagatccgctcacccaagcccagggactctgatggatatcggaccatatttagaaaaacatttggctgatgtcagtcccatttgccaggaggccaaaatcagcagctgacgacggaagtctgaggggcccacatgggcttcacacgttttacagatgttagaactgaggctcacatggggcactctgagggcagtgaaactatgctgtatgacaccttaatggtggctacatgacattatgcgctagttaaccacaggctttagttaataataatgtatcagtatcggttcagcacttgtaacatgtcaatggggggaactatgaggctgggggtgggagctgtgttggggagggagcatatggaaccttctgtcctttggcacaaacctgaaattgctctaaaaaagaatgtctattttttagaaaagcttaaggaggccccaggaagatggggtcagatacccacagttagaaagtggtggaagccagatttgaacctagcagccttgaccaacttggattcagcggtggcccagccttccgtgccttctatcctgcctcactgagctcctttgctgcctatgtccatggatcctgcttcctctcccaccaagtgaccctgttgtcaaggagggaggggccagccatgtcctaccatagccctgtccttgctggttaccaatttgcccaagccgagtccaaatccctcagtgaaatccttcagccttctgagattcctcactggttccatgaaaaaagtccagtctcgctggcctggcactcaaagccccttgcctctgatctaatgtcatacacccccactacctccatgttcctgatcccagcatagtctaccagaatgctggtcctgggatacaccacaaggcttactctgcacatgaataagttaaagattctgacaagtcctgccataaagaggtctgttcgacattgttttttgttttttgttttttttgttcaacattgtttaatgcagaacttcccaagtgtacctatccacgggaccccatttcctcctgagagccatcacacacagagctctctttgcccagtgcagcccagagcacaagtcccaggactctccaggtgggcctggagcttcttttcagagccctccaggtctaaggaggcccttcatccccctcctcacttaggaaaagcctcctcattcctcaagactttgcctcaggcctccatggaggaagcagttctccacaatcctcctcctgagaatgggtatttccctccctctgccccaagccccctgtggacagcatttacagggtgtgtagttctgctcccctcccccactgcacgctgtgagcccctgcttggaagaaatctctgtgaatggaagaatgagtgcatgaatggatgatgtcctggggtcctggtgatcatgtctccgccctgaccagactgcatggtattgagggcggggggaacccagcaggaagcagaaggcgggtggcccgggcctgtatctttgagtggctcccatgaaaatgtctagggtttcagactcccaggcctttcccccaacacccctcagtgtcctctagcccatctcccatcccagaattaaacttccatgtgtcattacagccctttccctataattctctcaaacccgggaagtttctgcatagggaggtgaagctgccaagcagtgggagggagtctgtgcattctggcctcacccgatgggcacacgtccagagtgacaggaactgagtccaattataggctgcctgggggatctgggcttggctactctctgagtcggcctgggggacctctgacaagtgagtcctgtgtcccaccttcccgttggtgaacaagggtgggattggtcctgcaacaggtggggaagcttggaaggtcttcacagagacgaggaagctaaactgggcctggggacagttgagtaacagcatctgtgtcctggatttcctcctttgtgaaataaacgatgtccttgtacaatggtgcagctcttctcccgagaccactggggtctacactggggcctggccacccatgtcacccagagcggggcttgcctggtgccttaggggtggcagctcatgggaagcagagacagaggaactgtccttgcaaggaagagtctggtgggcacagttgccccactgcctgcgagcctggaggcttctttgaaagggggaatggctcaacttttgcctggcacagtgacctaccgcttgttctccaccagggtgtgggaaaaccggctacggaggagggaggattctcttcccgcctcttcttcccactcttggcttttgtgtccttaaatccagttgaaatgactccctaagaaccaaggctgggatgctccccctcccttgatgccacagtgagcttggggctctgtcctcatcctcccaaatcctcctgtgatttaaggtaagaagcaagggacttcctccttttccactctgggcagcagaggcccaacacctttcaatcaaattgaagatctcagtgagaggtcctcgtgagctttctcggagcaggggcagtgcctggtgggattctcatctgctccctcctgcaggagctgactgtctgctcttgctctgggccagtgtcaatgaggaccctctgggcaggtggctcctcaccattttctgtgcctcggatcatgtctcagaacaatattttcctgggcatataatgaaacgcacaggattacaaaggaagctagtgatgttgaaataccgttgtgaaaacactgaagtgtgtgatgttgcgattcacggggttctgcatgaacgcgtcaaataccaggatcaggcttggagcctgagaaactacagatctgaagtagaaatgagcaaaaacgatgtttcaagataactacagcgaccgtaaagtgaagtggaaaagctccatgctccctgttggcgctgctgctacagccatcgtctgcggccttggctcagaaccggggaggctgcaactggaaggaaagtggtaatattttttcagcccaacttctttggctttgaatgaccgggcacagtctgtggtgggtgcaccccagggaagaacccttgttctcgatatgaaaatgtgactttgggtgccttctgttatcccttaaccaacccccagccctcccctgcccgctccccggcaccccatcctccctcttgcatagtcacagagccaggtctaaaacacccacatcctcacctgatagcctacaatacatatccccccaccccatttccctgtgtctcccaactgcagcgtccaggtaggaatgggtctccccggggcattctgctaggggatttgcagaggcctctctatatacctctcggactacatggaatttacacaacctcactccacagcatttgctctaaaccattttactgatgaagacattggggcccagaggagagatcggggcccaggcctcctacccaccactgcgaaagaggcatgatgatttgcagacgtctgtattaaccatccctgtccacccagccaccacaggcataaagacagcttggactagaggcaggtttgtgttcattggtcaagagaagaagctaccagaaaaatgtttgtttttctcttttttcccccaaaggactcatctttgagaacagtttgctaggattctgggaagagaaaatgttgggagggcagtacacctgcgaagtggtgtggcttctcctgaacagaaagaggtagaggcctgttagtccccatattctttggagactatgaccagctccctatcaacaccctgcttgagctcaggaggaggctgctgagtgtgctcagggtgcctggaccctagacacagggctcctcatcttggctgtgtcccgagtgtgtcctgtggcatcagaatcatggacctgaaagagcccagtgaactgggacagagttcttctgttacagacacagttggtttcctacccatcagccacactcccttcttccttgaagaacccatattttattcagactgcaacttgccccagaaagtggtcctcttctccagcccagggggtgacccatgattgttctgcaccaagtgagctgatgttctctttgctacttactggtttaggactcagttccgaccaagaggacctaggggaggtctgggaaggagatccaggtggcctgtacttactctgtcctgaagatggttttgtgagctctggcagccattctgtgactatgaggaaacaaacttaagggtaaaaagtccacacactggggatgataaaatataaaaataacaagatccagatttcttggagacatcaggaggctgtgaaaccactccagggactgcccacctccaggcttcttcttatatgaaacatgaaatggcccagggcactatcactcagacactctcctatgtataggttgcacatttttacctaatgcaacatctcagtggttttcagtatggactgatgagcagaggtgttttccttgtgtcttgggatccataagatcctagaacttctgtgtaattctaaggaggagcccaataaagactacagttggatttcctccagcccagtaggattagggccttggctttagaagccccagctccgtccagcccctccttcttatcctccatcagaggagcggcacctctttcgaacgctgtcctttccctgtgcgcaacaggagctaagcactgggcgctggaggcaacactgcctgctgctctgccacgaaccagccaggtgaccttgggcctcagtttcctcccctgtgaaacgaggttaatataagtaaagcactcagaacagtgcctgacacataggaggccctcgtggagcattaagcattatttttagtatattttcctaccacgtcttccttcttccttgctgactctatcttcctgacatcttcccttcctcctcaacagcacttttcttggctcacctggtctcccccacatcagatcgtccctcagtaggtcctcaagagaccaggccccagtgacacctggctttaatatgactctggggtctggaaggcacagagcgtggaagtgagaacaggggctttctttgcacacaaaaaaccctggggttaagagaaaggagcatttcagggattggttcacttgatggggagggagtagtgtcggcaagtctggaataaaaaaactcgttttggctcttaagaccttcaactgattggatgaggcccacctacattgcagagggaaatctgctttacttcaagccaactgataataaatgttaaccacatctaaaaagtcttcaaagcaggggcaaagccacccggctggcttagtcggagagcatgagacttgaccttggggtcatgagttcgagtcccacattgggtgtaaaggctacttagaaaactaataagtaaataagagaaaatgtaatttaaaaaattacaaattcttcagagcatcatctagactagtatttaaccaaacaactgagcatatacgttggccaagttgaaagacaaaattagccatcatacagggtgtcgggggcagggtatcttacttctctgagcttcattttcctttgtctaaagtggaatgagagaagagcctagggacacctgggtggttcagtgattgagcatctgcctttggctcaggtcatgatcctggggtcctgggatcgagtcccacatcaggctccccacagggagcctgctttccctctgcctatgtctctgcctttctctctctgtgtctctcatgaataaataagcttttaaaaaatctttaaaaaaataagagagtgagcctaacgtgtaggacccgtgagggctaagtgcacacagggtgcacagtaactgttagtcttcttcactatttgacctgggctcaaaaatgcatgttgatgatggcaatactcttggggaccccaggaactacaagccgcagtagatatattggtaggtaggttgcataggtatcatacaaaaccacagaggtgcgctgtgcccatctgagtcctcacccagcaggtgggtccagaaccttctgtgatgtgaaaactcccccagaaatggatcttcaggacttctttgctctcttgtttatgtggaaaggaggaaagttttccaccagttttcttcatctttgagaccgtggagggcttgaagcaataggtcaagaagcattcaatttcttttcttcagcaaccagctcacatttcgtaagaactgcatattcatgaggctacatagcctagtcggaaccagatgacagctcagttttcctggaaatcaggaaatcaatcaagctgccaactgagatgtctgcattgtgaaatactgctaacattccagaaagttgtcttaagtgagagttatttttaaaaaggaaattctttctctctctctctctctctctccctctctcctttttctcgattgttctccccctatctccctcccttccttcatttttttaagcaagtgctgcccactgttgcactacttctagtatgttcaggctaggcatgagtttttaaaagtaggtgagatgagacatgggtctctctgcctctctctgacacctctcccttgttcccactaactggcaccctcctctgcttgtccaggaacccgcgtgcctttgtccatgccggtcctccactgtttcctgcgctcttttacagtgaaaacatgacttcagccacctccctcagactcaggaataaaaggattccaaaaaacattctctatttccagtatcaagctgtagctgggcggggggatatatacatatatacatccatacatatgtgtgtgtgtgtgtgtgtgtgtgtgtgtgctttgtctctctatacatgtattttacctgtaaaaatatgtatacacataattataaaataaacttttacttacagaatagtttcagatttacagaaaaaagctgctgagagaatacagagaactcccatatacctggaatccagttttcctgttattatcctacatgagtatggtgcatttgttaaaactcatcaactaatattgatatattgttcttgttttgttttgttttgttttgtttttttgtgaaagatttttatgttttaagtaacctctacactcaacatggggctcaaagttacaaccccgagatcgacagtcacatgctcttctaactgagccagccaggcactcctaatattgatagattattcttaactaaagtctatacttcatacaggtttccttcgtttttacataatgttctttgctgtcccaggatcccatttgggatgtccacgtgtctcctgaggctccttttggctgtgacaatttctcaaatttttcttgtttccagtgacttgagcagtttggaagaatactggtggtttgcaaaatgtctgttggttgggatttgctgctgttcttctaatgggatcatgtgtttggaggtgaaggccacaggggcaaaatgccattcttattgtgttgtatcaacatacatactatcaacatgatttatctctgtcgatgtcaaccttgagagcctagctgaagttgtgtttgccagatttcttcactgtaaaactacatttaccccgttttcatattccttttggcagcaaatcactaagaacaccccacacttaagaaggggcagttatgcttcacttccttgacgagagaatacctaaaaaaatgatttggagttcttctgtatgagagacgtgttccatttatttacatcagcgtggactcgttgctatatttttatacttcacataataaataataaaataaaaataattaagaatagataacaaaagctttacttttgacttcattatgggttttcttccttccatggggattgagcccatatccttaaaaggatctggagatactgcctgcagccaggaggagagcccactcagcaagcgtgcaaacatgtgaggtcctagggatcaaggaaaacatttttcgcttcttcctttcgctggtcacccataaagtccaccttggatggcggacatcctgcaggcacttcctctcttatacatcttcactctcattgctcctcctaatcttttccatccctgtgtccacctatgcctagtaaggatttggaggagggaggggactttcattttatttgcatgacaaaatagggctaaattctggggggcctaggtggctcagtggttgagcatctgccttcagctcagatcgtgatcctggggtccccacagggagcctgcttctccctctgtctgtgtctctacctctctctctgtgtctctcatggataaataaataaataaataaataaataaataaataaataaaatgttcaaaaaaaagagagagagagagagaagaggactaagtacaataaataacattcacaggcattatagctttccttctattgctagttttctaggtgcactattttgggtactataaatacattatctctaatcttcacactaatgataaagcaattattattcctatcttacagaagtggaaactgagtgtctgagaattgaaaaaaatctcctcaaggttttcctctacgtgcaaaccgtgctccttttcagtagtttcctccactagtttctctcatctcaaccaccctgagcattcacctcttcccatctcttcctaaagttcctctcttcattcacttccctgtgaccacgagcaaaccacttgctctgggcctcagttgtcttgtgatcctgttggatgaattcagggagatccatggaaccaggttcaataagtggcatctataattactgttaatttcaacaggattatgttaacttaataaaaaaaacctctctctttctgttcttgggtcctcttctgtttatcttcatctcttagtggtctcatctcttctcatggctttaactatcaccaagacaacaatgaataccacatgcatattgctatgatcttccctgtgatcttttctttttaaagatttatttatttatctgtgatagacacagagagaaagagagagagagggaggcagagacacaggaggagggagaagcaggctccatgccgggagccgggcgctggaccgatccctggaccccaggaccgcgccctgggccaaaggcaggcgctaaaccgctgagccacccagggatccttccctgtgatctttgatcttccctgagaatttcagacaaggcaacatcttcacttatgtgtcttaaaacaaaaatgggaggtttttttttttttttcagtactggttggactctggacaaaaattttaaaaacacacaattttgggcacctgggtgtctcagttggttaagcatctgcctctgactcaggtcatgatcccacattaggctcctgggtcagtggggagtctgcttctccctctcctgctgcctcttcccttgcttgtgctttcgttctctctctcagatgaataaataaaatctttaaacacacacacacacatacacatactttaaagagactagagagaaaagcaggcagaaagtggagggcagtcaatcattggtagaagggcagtgcagtgcgtaaaatttgtgattataaaaattttgcctgaaggcattatgtagaatatgtagcatgtgatggccataattcaagtgtaaatctactagtcttactggtttgacaagttagagaatgggaaggaagagaaatccaagaaaggaaggattcatagaggcttgctatttatttatttatttatttatttatttatttatttatttatttatttatttatttttaaggatctaaaaaaaattttttttaaagacttttatttatttattcatgagaggcacagagagcgagagagacagagacacaagcggagacagaagcaggctccatgcagggagcccgtgggactctatctgggtctccaggatcacacccttggctgaaggcagcgctaaaccactgagcccccccacgggctgccctcgggttttatttatttgacagagagcacaagccaggggagtggcaggcaagagggagagggggaagccgactctccatgagcagggagccctagcaggcctggatgccaggaccccgggatccccgcgggaggggagcctgcttctccctctatgtctctgcctttctctgtgtctctcatgagtaaataaataaaatctaatatatatatgtattattatatatatataaatttaaagaggaaatatatatatatatttcctctttaaatttgttaatatgctgtatatattagcaggttttccaaggttaaactatctttagagtcccacggtagatccttcttggtcgtaacacatacacacacacacaggtgctatgtttatcagtgaggttggtgtgcaatttttctctctcccactagtttcctttgattaatgataagtttattttaatctatgaaatgattttgggaattctctctctctctcttccctagaagagtttctatatttgtattagaatgaaatgatatgttccttaaatgttcgaaacatttaaaccctttgtgcctactggttgtgtgtgtataggtatttaataactgatttgattttattggttgtaggtctattaaaaaaaaaattttttttaaagattttattgagtccatgcaggactcaatcccaggaccccgggatcatgacctgagccaaaggcagatgctcaaccactgagccccccaggtgtcccattcttcaaattttctgtttcacattgtgtcaaagcattagggtacttttggcagaaagtgaccaaaaatgtaacagtggcctaagtaacaagtcctctcatcctcctgtttcacacaaccagagagaagaggaggtgttccaaggctggagaagatattcaaggacacaggctccttcaatgtcctcactcccttatctttagctgctagcttatcacttcatgttctccagttggctacagcatctttgggcaccatgtggatccaaacagggacaagctgggaaactttggcttttcatttgggacagcagtcagagttgggactgatcttttctgagatcaaagattctttacctgctatttaattaaattggagttctgtgcgcacgcatatgcacgtgcatgtctgtatctgtaaatatggttgttgaagagggaacaaaggatagtgtttgtcaatttgttttggtaaagtacaattttgtaggaaattatactatgtatttcataagaagttatatgtatcatctaagattttaatatatcagtacaaagattgtcatagtattctcgaaggattttcagatttgtgttatgtctctcttttctttcttaatattgcacttggcattctctgtctctcagttttgccagaacttttttaatttattagttttttgaaacttttggtttcgttgatctatttatatatttattttgtattttcttttaaacaaattcatttctgctcttggctttcattcttttttcaggtttatcttactgttcttttttctaacttgttaagttggatgatcagctcattaattttcaatttttctccttttctaatacatacatttaaggccataatttacttctcagctgcctcccataagattcgacatgttaattatcttaacttaattactatttagttttaaacatttttttcaaatcttcattatgatctcttcttgggtcagtaagttatttataataagtttttacatccccaacctctgagatttaaaaagtatctttttgttatgcatttctaactcaattgtgaaagaacatgatatgggtgctaatgattccttaaaatagagtctacattttagagagttgtgggttatagtgtagttgaacctcaagtacagagacttcaaacacttgctctctccctctcaacggtttcctctattgatattttttaaagatttcatttatttagagtgtgtgagtcaggggaggggcatagggagaaggagacagagaatctccagcagaatctctgctgagcacggagcccaatgtgaggctccatctcatgaccctgagatcacaactggtgccgaaatcaagagtcccttgctcaactgtcggagccacccaggtgcccttctatattattattgacatcttgtagcacatttgttacattcaatgagccaatattgatattctcttattaactaaagtacatagtttacattaggattcgttgttcatgctgttcagttctgtgcattttgataaatgcctaatgccatatataatcccccattacaggattatacagaagagttgcactgccctctgtgctccatctattcattcctcttgccctcctgctgcacctctggtaatcactgatctttttactgcttctgtagtcttgccctttccagaatgttgtatagttggagtcatacagttggtcgccttttcacactagttttttcatgtagcaatatgcatttaaagttcctccatgtctttttgtggctcgataggtcattcttttgggcactgaataatattccattgtctggatgcaccagtgtgtttatctgtttacctactgaaggacatcttcttacttcctgcttggggcaattagaatcaatctgctaaaaatccatctgagcttttgtatgggcatgagtttttaactcagatctttaaatattcagaagcacgattgctggattgtagggtaagcctctatttaacctcaaaagaaattaccaaactgttctccaaagtggctgcatcattttgcgttcctaccagcaataaatgagagttcttgttgctccacatcctcaccagcatttggtgttgtttgtattttggattttagccaatccaatagttgtgtaatgatatcttgttgttttcatttgtaattccctaatgactcattatgttgatcatcttttcatatgcttattttccacgaggtatcttttttggtgagatgtctgttcagatttttgtccatttaaaaaactgggttgcaggacacctgggtggctcagcagttgggcatctgccttcagctcagggcatgatcctagggtctggggatcaggtcctgtatcaggctctctgaagggagcttgcttctccctctgcctgtgtctctgcctctctctttgtgtctctcatgaataaataaataaaatcctaaaaaaacaaacaaacaaacaaaaaaaccacacacacacacaactgggttgtttgttttattattctatgagttttaaaagctctttgtatattatagatgtgtgtcttttgtcagatatgtgttttgcaaatattttctcctcttctgtgacttccctttcattctcctaatagtatctctctcttttttttaagattttatttctttattcatgagagacacagagagagagaggcagagacacaggcagagggagaagcagactccatgcagggagcccgatgtgggactcgatccctggactccaggatcacactctgggccaaaggcaggcactttaactgctgagccacccaggcgtccccctaatagtatctcttgcagagcacaagtttttaatattaatgaagcccaactgactagttctttctttcgtggattatgctttgggtgttgttttgctgtattaaaaattcattgccagggcactagggtggctcagtcagttgagcacctgactcttggttttggctcaggtcatgatcctgtggttgtgagatggagcctgacattgggctctgtgctcagtttggagtctctctccctctccctcctgctttctttctctctctcaaataaataaataaataaaatgtcaaacaaacaataaataaaatgccaaaacttcattgccaaacccaaggccacctagattttctcctatgttatatgcttgtctgatctgaaatgtttggcttttcattcttcttcatggtataattctcttttgcctttgattcagaagtctctgagcccttcattctagctgtttctgttttagcaatcccgttgctgaatccctcatttctcagagaccagttttcttccctgggtcaataaaggttcactattttttcagttttccagtgtctctggtcacaaagttgtgttctttcacttctggagagtgatcactccactctttaatcctcaaaacattgccaccaaggtcaaaaaaaagggggaggagggggaagcaaatgataaagaggtagcatttactcctttccagaaccagcctcaggagataaaaaagaaaacacttcccaaactttgtaattccagcctgtttgatctaaatttatatgcagtgctcacttgttaattaacagccttctttattgattttccttacagctttagcaagaaaactcctagaagaaaaggtttcagtgacagaatttacactgataatatctgttatatcagaaaggaaaaactaactcgtttcttatttgcctttttccttcatgattgaataacctaagttcctaaatgttctaatgatcatacctttattttatttagaaacagtaagaagaaatgtgttcgagggacttgttaggtaagtgattttataaatgactgcccattctgattaggcatgcttcttacatagttaacccacgaaccattcccaggatgcctgtcttacatgtttaatttaaccaaactgagacaaagagtttgtgttagttttcaagggctgttgtgacaagtttccacaaaccgagtgagtttaaacaatcaaaatttgttttctcacacttctggagaccagaagtctgaaatcaagatgttagcagggtcatcctccctctgaagactctgggggaagaagaatccttcttggcctcttcctagcttctaggggttgctgggaatccacatcactccttggcttacaggcgcatcactttggcttctgcctctgtcctcacatgaccatcttacccctgtgtgtctccccaaatcctccttgtgaggataccagtcatcagatttagggcctaccctattccaacataacctcatcttactaattacatctacaaataacttttcccacataaagccacagttatgggtatcagggattagatgccagcatatcattctgaagaacacaatttaatccacaccagagttcatgctgtaggcctaggctataaacatcaattttggaggagacacgttaccctaaagagaaagaacacacaagacaaaaacctgcctcaggagaacaatgggtaggtaggggtgtggttacagtttagaagaagggctagtccaggaaaagatgtctattctaaacctcctaagagaaacaggatctaaatatgtttgacttcagtcctgaaaagaataacaaggaaaacagagggagtaaggcagtaaaagctaaatccaaaccaatcacacctcaacatgagtaggacacaagagactaggtctcaagccaagttataaaaggcaacataaccaccataccttaatttttgtttcattttttccttgtttttggtttgcttcatgatggattgctcaagagtctggtagacatttctcatctctgtcttgtagactggcatttccttcaaccataggctcaagtctcaaatagcattggctgtgttatcatgccactcatgatacctgagtccaagggagaaagaactcagagtctgttgagaattatctggagggaaagggtgagccagactgcgaatcttttcctccagctgagggatgaatttgacctcgagaggaacttcttacatttgcaagcaaagtgattacccaggaaagagaaacaatagtttagctggggttgctatgtacggactgctaatccaaggacgccccagtgacacacagtctttggttgttggttcatatcacactgttaattgaatacagcagctgcagtacactaaggaatgggaactgcatacactccttccaggtgctaggtgaccagaaggctctatatgctcagggactatagaaccatggcttccctgatcaactgtgacccatatgcatatagcttttgtcattcctttttttttttttcttgtcattccttatgactatgacacatgccgtgcagcaaccggagccattaggatccccctctggtgtcaccagtgtctgtgaaggcatggtgtgcatggtgctgccttctttgctctgtgtcttgtcctaaagctagtcaccttcagcctgcatgagcatattgtgacttctgagtgtgatcgacaagctgaggccgaaaccctctggtcttgtggtgtctcaactcttacagggttggggattacagtgagtgtggttttaaatgtcaaatgctattgagcaactacaatatcaataaaatatcatctcttgaattgacagatttttcaaatttacttatcagctctagtagagatttttttttcatccattccttacttatcattttattgtgaagatttcctgtttcccaatgcaatcctccccaatgcttactctcccctttgttacacaaaatggttagttcatccactgactcatactgctaatccaaacataggaaagtatatatcatatcacaccttggtatgctttgccaaatgccttgaactttaaattgtcaccaaaatattgtgtatttttatttttgaataaatcaaatccaaatgacgtgataggcatgacttttcatttgttcaagtattttctgttgctcagtaagttgcccatttcttgttaaacttactcctgaaatttttatctttttggttacagttgtaaataaaactcttcttccattaacctactgattcctgaatattaattttgtatctagtcacctgactaaagtctcttattattgagagtagttttaaattgttattcttaggctttccagttgaataactataccatttatgaataatgataaagtttccttctttcccaggatttatactccttagttttctctcttattgttgtttaatggatacagtagaattactcagaaatggggtccatgttctcatgaaggtcttgtttattactcagcaaaatattttgtatcctttccattttggaccttccctatgattaccttgaaaaagaatgttcttggggcacctgggtggttcagtggttgagcgtctgcctttggctcaggtcgtgatcctagggtcctgggattgagtcccacacctgggaccctgtagggagcttgcttctccctctgcctatgtctctgtctctctctctctgtctctcatgaataaatgaataaaatctttaaaaaaaagaaaagaaaaagaatattctttgttgaaattttagagaacatctttgagatagaggtaagctatgcaaagaagggttctttttagataaaattcacataacataaaattaaccattttaaagtaaataattcagtgacatttagcatactcagtgctgtgctaccactacttctatcaaggtccaaaatcaccaccccaaaataaacctcatgcccactgaacaatcactcctcattctttcttaactctagcccctggcaaacccaagctttctaaggctttacctattctaaatatttcagataaataaatgtctcttacaatatgtgaccttttgtgtctggcttcatttacttagcataatgcttttaagattcattattattgtagcatgtgtcaatacttcatttctttttatgactgaataatattccatcatatggatatactacaatttgtttatccatttatcaattgatggacatctgaattatttctacttttcaattgttgtgaatagtgctgctatgaacattggcgtacaaagatttgttttgagtatctgctttcaattcgttggggtatataactaggagtagaattctggatcatatggtagttctatgtttaactttatgaggaaatgccaagctgtaagagttaaaatgtaaaggtactttgactcaaattatgggagagccagtgtagaatacaggagaggagagagtaggcaggagtgaatggagacgtttcagtgttgtttcctaggaattaatgcagatataatcatatcatttttcataaatcttggggaaagagtgcaaagttaagtgagtttagaaatgacattaaatcatgtgtcaagcaagaggggacagactataggaaagtgtcatgaagctgtataattggccagaatgttagcaaatgaactataaaatgagcaaatacaaagtgagggaaatagtatcaatgaagtatgagaattatgatcccaagctactactaatgatgagaaaacagcttgcagtcataactgattattttcttaagaaatcgttttagtggggcacctgagtggcttagtggttgagcatctgcctttggctcaggttgtgatcctggggtcctgggattgagtccagcaccagactccccgtggggagcctgcttctccctctgcctatgtctctgcctctctctctgtgtctctcatgaataaataaataaaatctttaaaaaaaaaaaaagaaatcactttagtgagatatgcattattgtgaatgaccaagaagaatcctggacaaaagaaaacattgtcctactgtaccatgtttgaaacttatagtcatggggatgcctgggtggctcagtggttgagcatctgccttcggctcagggcatgatcccgggatcctgggattgagtcccacattgggctctctgcaaggagtctgcttctccctctgcctgtgtctctgcctctctctctgtgtctctcatgaataaataaataagtctttaaaaaaagagaaaattatagtcatgactcaggtgtacaaagatatataactctatttttatctttttactgatttcaaccttgctgagcatcagtcattttttgcccagcagccacaaacacaaattcttgatgaaaaaaatgtaagtacattagtctggattacaaataagggtttccagcttccccagactcttgtgtataccccaggtaacacttataaaaacaaacacagacaatagatctgtctgcttcatcacttggtctgtacctaaatgactacaaacatcaacatctagctccttctttgttaagaggcatttgacaaggccactcacaatacaaagacatgggacatgagagtctttctgccatttttgaggtgaactatcactgactaactggaagagagttatccatgttgcctgtggctcacctgatcagctccttttcaagtgtcacaggatagagtcagtcagaggctgatgctttcttcttctctcacacttccaacacagagagtagagacctttgataaaacatcaatgccaaatatttttttttaaatatccattcttgggatacctgggtggctcaatggttgagtgtctgccttcagttcagggtgtgatcccagggtcctgggattgagtcccacatcaggctcctcacagggagcctgctcctccctctgcccctgtctctgcctctctctctgtgtcgctcatgaataaataaataaaatactttttaaaatgaaatatccattcttttggtttatgcatacttcttacttcactattgttggaaatttcatatttataatcataagtttgtctttttacttaaggcttttttttctgataagatgctgtcatggcattactacttgctaaattagagcaaaaaaaatgttcctagtataatgatagtggccttgaaaatataataggctgatgctttcttctctcatacctctttaaattaatgaaaggtgtagttaagctatttcttctctctaatagtaacttatataaaattcatccttgaattttgtatgtatatgaaagactgtcttatactgtgccagataaagaggatctaaagacaaaaatgacatgttggtgaggcgcctgggtggctcagttggttaagcatccaccttcagctcagatcataatcccagcatcctgggactgagctggacattggactctgctcagcagggatcctgcttctccctctccctctgcctgctcctcctgcttgtgctgtctctctctctgtcaaataaatacataaatttttttttaaatgacatatttgtgccctggaatacttacagtcagaggacaggggaatggacacagtcaatgcagacacgattacagttttttgtgtgggttaaaatatggtggacacagacctgaaaacatatctacaggttgttataactgagaactggagatggggtaggaaaaggggattcaggtagtacattatggagacagggattttagaattgagtcttaaaggacacattggagtgtgtcaggtgaaaaaatagggaaagacattttaggcataggactggtccaagaaatggcagaggcatgagaataaagcatgcctcaggaatttccaaaaacatggtaagctgcaatgtagaacataaggttggaagaggtacaagatgatgtggagaagttggctttttcaatatatagttttaaatctttaaaaaataatatcaaagatattttgttgaattatagttttagtatttgctttattctctaattaaaaaaaaaaaattcctgaaccctattacacatatgttggttcttctttgcctatcctcaatatttgctattttctcttaaatattttttctttttttcatttattttaatactaaaattttgtctcatttcaccttttatcactattaaagcttcatttgttgtgtttttatgctctggtgtttcttttaattacatcttaattatttttaattacttcttaaactctgtcactttattctgagtttttgtaattctgatttagggttttttaatggcatattttattttattttattttagtgtcttttatcttcttttattatttttaaaagattttatttattcatgaaagacagacagagagagagagagagagagaaagaggcagagacacaggcagagggagaagcaggctccatgccaagagcccaaagtgggactcgatcccgggactccaggatcatgccctgagctgaaggcaggtgctaaacctctgagccacccagggatccccatcttttatcttcttttaaaataatgttacagctttgatctactattcggcctgtcctggcatgtgttcattagctgtaggaatgttattctccatattattctcttttttattataataattttatatgagattagtctcaatattttttttgttgctcatttttccagtttttaaaaattatagtaagatacatgtgacataaagtttaccatcttaatcatttttagatgaagagttcactggtattaaacacatatataatattgggcaactgttactgccatccaactccctagcacttctcatctggtaaaactgcaatcattaaataataactccccatctccctggcaactttctgttgctgtgattttgactgctataaatacttcatataagtgaaaccatactgtctttgtctttttgtgagtggcttgtttcattgagcgttatgtcctcagagtttatctatgtggtagcatgtgatagaattcccttcctttttaaggctaaataaaatgtatataccatactttgcttatccatccatccattgaaggacacgtgggttgcttccacattttagctattgtgaataatgctgctttgaacgtgaatgcacaaatatctctttgagaccatgctttgaattattttgggtatatcagaagtggaattgctgcatcatatggtaattaaatttttgatcatttgaggaactgccacactatttttcacagcagctgtaccattacattcccaccaatggtgcacaaggttttcaatttctccacatcctcaccaacacttgttgctttctggtttttgatagtagctatcgtaatgggtatgaagtgatatctcattattgttttgatttgaattttcctaatggttaatgatggtgagcatcttttcatgtgcatattggccatttatagattttctttggagaaatgtctacttaagtcctttgccatttttgaactgggatgtttttgttgttgttgagttttaggagctttctatatattctggatattaatctcttatcagatatataatttgcaaatactttctcccattatgtggactacctctttatttagtgtcttttgatgtacaaaagttcttaaattttcattaagtccaatatgcctattttttgttacctatgcctttggtgtcctacctgaggccattgccaaatcccatgttgtgaagtttttgtcctatattatcttctaagagttttcttgttttaggtcttacatttaggtgtttgaaccatataaaggtaatttttgtaaatggtaagggtctaatttcactcttttgcatgtagatatccaattgtcccagccctatttgttgaaaagactgtcctatccctcattgaatgcatctttgtcaaaaatcatttggccatacatgtgaaggtttatttctggactctccattcttattcaattggtctatatatctgcctttatgccttataccatactgtttgattactgtagcttggtagtaagttttaaaatgaagaaagatgagtcttctcattttatttattcatttttttcaagattgttttggctaattgagtcccttgagattccgtacgaattttaagatgagttttcttttttttaattattatttttttattggagttcaatttgccaacatatagcatatcaccgagtgctcatcccgtcaagtgcccccctcagtgctcatcccccagccacctaagtcccaataattcattcttgctattgtttcccttgccttcatagatgtatcttgcaagaagttgctgtggccaagttcaaaaagggtgttgcctgtgttcttctctaggattttgatggattcttgtctcacatttagatctttcatccattttgagtttatctttgtgtgtggtttaagagaatggtctagtttcattcttctgcatgcggctgtccaattttcccagcaccatttattgaagagactgtctttttttccagtggatagtctttcctgctttgttgaatattagttgaccatagagttgagggcccatttctggattctctattctgttccattgacctatgtgtctgtttttggaccagtaccacactgtcttgatgatcacagctttgtagtacaacctgaaatctggcattgtgatgctcccggctctggttttcttttttaatattcccatggctattcggggtcttttctaattccacacaaatcttaagatgatttattccaactctatgaagaaagtccatggtattttgatagggattgcattaaatgtttaaattgccctgggtagcatggacactttcacaatattaattcttccaacccatgagcatggaatatttttccatctctttgtgtcctcctcaatttttttcagaagtgttctgtagtttttagggtatagatcctttacctcttttgttaggtttatccctaggtatctcatgtttgggggcgaaattgtaaatgggattgacttcttaatttctctttcttcagtctcattgttagtgtatagaaatgtcactgatttcttgattttatatcctgccacattgccgaattgctgtatgagttctagcaatcttggggtggagtcttttgggttttctacgtacggtatcatgtcatctgcgaagagggagagtttgacttcttctttgccaatatttctttttgttgcctgactactgaggctaggatttctagtactatgttgaatagcaggggtgagagtgaacatccctgtcttgttcctgatcttaggggaaaggctcccagtgcttccccattgagaatgatatttgctgtgggcttttcgtagatggcttttaagatgctgaggaatcttccctctatccctacactctgaagagtgttgatcaggaatggatgctgtattttgtcaaatgctttctctgcatctattgaggggatcatatggttcttgttttttctcttgttgatgtgatctatcacattgattgctttacgagtgttgaaccagccttgcatcctggggataaatcccacttggtcatggtgaataatcgtctgaatgtagtgttggatcctactggctagtatcttgtggagaattttgcatctgtgttcatcagggatattggcctataattctcctttttggtggggcctttatctggttttggaattaaggtgatgttggcctcatagaacgaatttggtagtactccatctctttctatctttcgggacagctttagtagaataggtatggtttcttctttaaacgtttgatagaattcccctgggaagccatgtggccctggacttttgtgtcttgggaggtttttgatgactgcttcaacttcctccctggttattggcctggttttctatttcttcctgttccagttttggtagtttgtgtttttccagaaatgcatccatttcttctagattgcctaatttattggcgtatagctgctcataatatgtttttaaaatcgtttgtatttccttggtattgggtggtgatctctcctttttcattcatgattttattaatttgagtcttttctattttgttttttttttaatttttatttatttatgatagtcgcagagagagagagagagagagagagagaggcagagacataggcagagggagaagcaggctccatgcaccgggagcccgatgtgggattcaatcctgggtctccaggatcgcgccctgggccaaaggcaggcgccaaaccgctgcaccacccagggatccctctattttgtttttaataaggctggctaatggtttatctatcttattaattctttcaaagaaccaactggttttgttggtctgttccacagttcttctggtctctatttcattgagttctgctcgaatctttattaactctcttcttctgatggatataggttttatttgctgttctatctccagttcctttaggtgtggtgttagcttgtgtatttgagttttttccagtgtttgagggatgctcgtattgcgatgtatttccctctcaagactgcttttgctgtatcccaatgattttgggatacaactgatttttgtgtgttgactttatagcctgttactttgctgaatttattagttacaacagtgtgtgtgtgtgtgtgcatgtgtgtggaatctttagggttttctacatataagatcaatcatctgtaaacagaaataattttacttcttctccaatttggatgcctttagttctctttcttacttaatttttctggccaacactatgttgaatagaagtattgagaacagggcagcccaggtggctcagtggtttagcgctggcttcagctccagtgtgatcctggagacccaagatcgagtcccacgtcaggctccctgcatggagcctgcttctccctctgcctctgtctctgcttctgtgtgtgtgtgtgtgtgtgtgtgtgtgtgtgtctgtcatgaataaataaataaaatcttaaaaaaaaaagaagtatcgaaaacaagcatccttgccttgttccttctgttgctcatttttatgtgaaactagtttccctgaacttttaaaaggacgtgtagctgaagagcttttctaaatttacagagttctcttttttgtttttttgtggagtgttcaaataaatgacagcttactttctgggatttcctggctctatctccccttccttccctcactgaattttattttgccttcatgttttctttgctacttgtattgtccccattctcctgaatctcttctccagtttctcctcagtttggcagtcctgagtggtcaatgtcaggtatgtatagtgctagaattctccagccccctcagacctgcatggacatggccttgcactgacaagatactggagtgagtaaaacccttcctgatttctgctgctgttctcaggatctcgatttcactttccagtaatgcttccttggactattttggggttctgcttttctaaggtcttccagacacaccattaatccatctgcttcctctcacacatatgctgctactgtgcgggtttggtgctgttgttctgggcccaatccctgttgttttggggtttgtcattgaattttgtaataggtattccacataagattttggcttcactatctagttatacctctttttttaacattgggggaaactcattatgataatctgaagaggtcacatattgtataactccatttacataacatccttgaaatgacaaaattaaagagatggaaaatggattagtggttgccactggttagggatgataggaggagggataaggaagatctttgtggtgatgaaatagttctgtatcttgaatgtattggtagttatatgaatctacacatataataagataatgtacacactgtgtaccaatgtcaaattcctggttttgatattgtattataattaggtaagatgtaaccattgggagtaactgggtgaacacaagagacttatctctctgtaccatctctgcaaattcctgtgaatctatttcagggtttaaaatttttaaaaagaggaatgaagtattgatacatgttacatgtggttaaaacttgaaaacattatgctaagtaaaagaagccagtcacaaaacaccacatattatatgattcaattcacatgaaatgttccagaatagacagacttaggagacagaaagtagattggtagctgctgaaatgggtgtgtgtgtgtggagagtagggagtgactgctgatgtatatgagcccttttggagggtgatgaaaatattctaaaaatttagatagtggtgacagtttcacaattctgtgaatattataaaaatccgtgaattgtataatttaaatgggtgaaatttatgatatgtaagttatatctcaataaagttgctttattactttttaaaagattttatttggacagcctgggtggctcagcggtttagtgccgtcttcagcccagggcgtgatcctggagatccaggattgagtcccacgttgggctccctgcatggagcctgcttctccctctgcctgtgtctctgcctctctctctctctctctctctctctgtgtttctcatgaataaataaaattttttttaaagattttttcttttttctttttttaaagattatttgagagagtgaaagagagcatgagcagtggggagagggagaaggaggctcccttctgagcagggagcctgatgtggaacttgatcctagggtcctgggatcatagcctgagccgaaggcagctgcttaaccaactgagccatgcagacaccctcaataaagctgctttaaaaagacttgctataccaagaattggtgatgatgtagagtcagtggaactcttatacactgctcatgggaatgtagaaaccactcttgaaaactacttgacaatttcttaaaaagttaaacataaattggctatgtgattccagctatcccagtgttaggaatttacctgagagaaaggaagtatatgcccataaaaacttgttgtcagggaacctgggtgactcagtcggttagtgtccaactcttgatttcagttcaggtcataatctcacgatcatgagaccaagcctcacatggggctctgtgctgggcatgagcctgattggaattctctttctccctcttcttctgcccctacccccacccccactacctcactctccctctctcttttctaaaacacacacacacacacacacacacacacacacaccaacaacaacaacaactttctctcaagtgttatagcagcttaatttgtaatgtttaaaaaattaaaataatccaatgtccatttacaagtgaatggcaaacaaactgtggtatatccacaatggcacactactcagtaatcaaaagaaatgaactactgatacatggcacaagatagataaatcctaaaataattatgctaaatgaaagggaccccacatgaaggagtacatactgtatcatttcctttatataccataggtttcctgggagggcagatgagaataagagaaaggaaatacaaaatgaccagacctaacttttggaggtgatgaatatattcattatcttgattgtggccatggtttcatgagtatatacacaagtcaaaagttagaaatttatactttacacatttacagcttatatcaattacaccataataaggctttaatttaaaaaaaaatactatgatgccatcatcatagtcctaaattcagcaatcatattcttaattttcaaaattctttactgttgtttgttccttttttcatagtattatgacttgtttttgttaaaaagttgtatctttgggactcttagtcatcttttgtagctattactgtttctttttttttttttttaattttatttatttatgatagtcacatagagagagagagagagagaggcagagacacaggcagagggagaagcaggctccatgcaccgggagcccgacgtgggattcgatccggggtctccaggatcgcgccctgggccaaaggcaggcgccaaaccgctgcgccacccagggatcccgctattactgtttctatactatttcttgaattgtctctgttttcagggttttttttccattttttaaatttggttttccactttcatgctataggcctttctcagtgttgacctttggtctcagggtgacctttggtttcctgttcatattgtaaaaatacaaaggagaacatttcaatgagggacatgtacatggaggactgcattcttttgagtaaattatcgggattttgttttgaatgaagtcctcaaatttcaaaataaggagggctttactttgggtgccaaaaatcacactagctgccctaggtccctcttgactttatgttgttatttttagataattattctgtcttctttgtgctaggacttaggggaaagggaccgtcaattactttcctgtgttaggttgcattattcgcttctgcttttatacccattaaaacaatctctcattccttatttgatgaagctgtctctccattgcttgaaaatacatctattcccttcttttgcaagagaagaacaatattttatagctagagtcagatctgggcatgctctgggagagaaaaattcaagccaaatcctggagaagaggcttacacacaaaaaataattttagggattttgctgatttatagtatgactggattctgtgtctgtcaatcaagttaggaggaatgtaattttatattgggactgaatttatttatgtgagtgtcatactcaagattttatattcattgtggtagcagctgaggatagttctaacaatttgctcaactggttaaccaaaaccctggtttcaccctggcctccacttaacaatgggccacaccaaaatgaggggccagaagttttttgaaacaatgcattaaaagaaactcaagacttaggaggagagaaagattggaacaatttatcttatgtaaatacaaccatcaccaccaccaccaccacgaacatataattgtgggttctcagagaattcagaagatattctcttcaccaaaggcttaagacattggtgaaggagtgccactattttccaaaagtactttaatgcctctcctttgaaagccactgatgttgttggaacatgtaaatgagatggaatatctaattttaaggggtttgggagttttcagggtggcagatgtcatacagtggcacttaaccatcagaggcaaagtgggtattgttacccaaataggcagtaatgagcttagaggtgtttagtttgagtctatatttgtcatggcatttgattttccaacatccattctacccccaaatgattagtccgtaagtcaattatggtactcttattccctttgccagtgattggtctaagactagacatgtcttctattctggacaagagatatgaagggaattctcctggaggcttttggaaaatatgtcctcagtcctaaaataagatacctagcccaaacacaggaaaggacagggagggaacctatcttcttcccttggaatttatttctggaaatgacacacaaattatcgtagcaattttgtgaatttgaaagaagccagcttgagaaagaacaccacatagagggatggaaagtagagcaactggaagaacctttgtgatgacagtactgagtgctggtcataatgaaccccactgaatcacaccccataatgtgtgattttactttatgtaagatcatagcatttcaaataatttaagacagtttgaattagagtttttcttatagtcaaaaacattccctcattagtccctgggacagaagttgggcaatatactcaagttctacttgatgtatatactgaaaaactctagtgaagtagagaattacttcatttagactttatgacccaatggatccactggtgttccatgaatgggtggcagatgagaatgccatgtgatgtctatggcaagcctcaataggaatctgagcagaagcccctagagttatggagcaaaactatgagctatcaggcaagtagttattttcattttgagaaactgttgtagctgtgctccaggaaacttggggagctcaaatgttggtgtacagactgaagctgcccactatgagatatctaagctactgagtcacaaaattgggcattttaatttttttttaaatttatttatgatagtcacagagagagagagagagagagagaggcagagacacaggcagagggagaagcaggctccatgcaccgggagcccgatgtgggattcgatcccgggtctccaggatcacgccctgggccaaaggcaggcgccaaaccgctgcgccacccagggatcccaaaattgggcattttaaggaacactttatcattagctagaagaggtataatatacaggatcaggccccagccatttctgaagacacagtaagttgcatgagtgtgttactcatactctctcccctgcctagaccagaaacttgccttacagaacagccaagtagcttattgaagatccagttaagcttccaaatgagacaacacctcatgaggttgggatgctgacctgcaggacgtataatatgttcagaatcatgaaccaatatatctgtagcactgcttttcctataattagaatatacaagtgtggaaactatgaagtgaaaatgggacagtgcctttcatgattaagccaatgacaacaagtaattgcttctctgctctgtgacttggggatctgctgacttaggctttgggcatacaaaagattactgcttctttaagggaaaaaaacattttttccactattagtcattttgggcttttctaccacaaatgagtagacaaaaaaaggggttatagtgttaactgggatgactgatcttgaataatcttgactatcaaggttgaaaaatactgcagcttcaaagtgggcatggaaaaatctttttttttcaagatttatttatttattcacaagagaggcagactgacagagagaagcagagatataggcaggaggagaagcaggctcctcgcagggagcccgatgcaggactcgaccctggatcccgggattatgacctgagcggaaggtaggtgcccagccgctgagccactcaggtgtcctgggcgtggaaaaatcttaacagaactcagatatgttgttctggagtaggtcttatactaccacatccaatggaaaaaaaaatattatttttaaatatttatttattttaggggctgccctggtggcgcagcggtttagcgccgcctgcagcccagggcatgatcctggagacccaggattgagtcccacgtcgggctccctgcttggagcctgcttctccttctgcctgtgtctctgcctctctctgtgcctctatgaatgaataaataaagtctttaaaaaaaaaagatttatttattttagagagagagaaaacagtgagggaggggtagaaggagagggagagagaatctcaagcagactccctgatgagtatggagcctgttacagggctcggtctcacgaccctcagaccacaacctaacctgatataagagttcgacttaaccaacttctccacctaggcatcgttccaatggaaaaaattaatggaagattaccctacccctataaggacagaattatcaagggctcagaccccttgtgaagcctggtaggaaaccccaactccctgagtgcctgtgtgaaggcaaagggaacatggtacaaattatagacaggaaaagtcatacataccaactacatcctcataagtcattacagaataaagactgtcacctttacacgtatttccttccttgttgcataaatgtttatatatcttaataaatttttgccttcctcttccccactttcactgtttatatttggcatgtaagtagtggttaactatacactatttaaatatcaggtttattgaggtctaatttagtacagtaagtttcaacatttttatgtatacagctcaatgaattttgacaagtgtacagtcatataaccactaccacaatcaagaaatcaaatatttcctttacctccaaaattccctcatgctttttgaagtcagtttttttcttacaacacccagctcttggcaacaactgacctgattttttttttaagattttctttattcattcatgagagagacagagacagagagagagacagagacacaggcagagggagaagcaggctccatgcagagagcccgatgtgggactcgatcccgggaccccaggatcatgccataggccgaaggcaggcgctaaaccgctgagccacccaggcatcccaactgacctgaattttgaaccaaaacttttgctgttacagaatgtcatatatatggacttgtgcatgatgttcctctttgtgtctagcatctttcacttggcatagaatatttttaagtgtatgaaatgcttaaataaggaaatgcaatcacactatgagtgaacaacaagagaccgaaaatgaagcacggaaagctaagaagttgaaaaactctgagtgagagtttaagggatatgggggatagaatgagaaggtctatatgatctattaagtcatggaagagaataaagggactagagagagaggcaatgtttggaaaaagaatcacagaattttccagaccagatgaaaagacaagaatccttagatctaggatcagaataccatgcatgatagtgtttttttcttttaaaaaaagaacatctaaacacagtaatgtaaaactcagaacatgaaagacaaagagaaggcttaaaagcagctaaagagaaaaggcagatcacctacaaagtagaactaagagtggacttctcaatagcaacagcaaattctaagatattggaatagtgctccaaatcctgagagaatagccatcaatctaaaattatacattagaaaattctctttcaagaaaagttatgaactcaaggtatttttagataaacaagactaactagcctctctgaaggaatttatatagggtataattcaggaaaagggaatataatcccagtaagaacttctgagatgcaagggtaagtgatggctaaaaacacattgtgaacatgtaggcaaatctgaacgagcattttgtaaaatgataataatgaaaaggtctaatccataaggttaataaaaggtgaagatgtggtaaaaaggggttggtgaaagcaatttctcttcttaaagatgtctttcttgcatacacttcaagatctatgggggattaaaaaccagtaaacttcagtaagactgagtggcagatagcatctgtgcactcaaaaaggtgtaagtgctgccaaaagcatcacagaaggtgcagtgcctggggtgggggggcagttggttgagcatccaactcttggttttggctcaggtcactatcacagggtcatgagatcaagccccatgcagggctctgaggtcagcacagagactgctggagattctctccctctgccctgcacactcatgctctctctctctctcaaataaataaaccttaaaaaaaaaaaaaaaaaagctttacagcagctacagagatcaatagatacgacagcagatcaagtgaacagaaagaggccagaggtgacagatctcacaacatattagtaaaactatacttcctgtgggtaaagaaagctcaccttgaagtgagaacctgcatcctttacacactgcaagagctgagagagctggaaaccactagtcaggaagcaactggtcagaagctgtgtggtggatgtacaataaagatgaggtgagaacagagaagtgcccagaggtgacagatttcagaaaatgcccacttaatacatccaccgaaggaacctcttgtcattgcataaagcatcataaaaagggaactagcatatcaacatgacaaaaaaaatactgtaagaaaaaaggtgggaggggatagcaaaagttaagagataaaaaaaacagacaaggaacatattaaaattctgatcaaaagttaactacaggggtgccctcagttggttaagcgtctgactcttgattttggctcaggttgtgatctcagggcttgccttgcctcaggctctgtgctcagctgagcgtctactcaaagattctctccctttgcccctcctccaataaaataaataattaaaaaatgttaactataaacaaagcaaaataagtaactgcttaaatggagaaaggcttcatagcagaaatgcaagaaatcaaggaagaaatggcaagaaaacaggagatgaaatatgaattggccaaccttaagaaagaagtagaagaataaaaataaaccatctctgaattcatgatctagttagaaagggcccaagggagaacagacacaatgcaaaactcagtaaagggacatcgaggacaaaagtgacaaaagtaaacgaaatggaaataaagctcaaatgagtgtccctgtctactaaaattttctgtgatgatggaaatgtgtgctacatatgtgctgcatatgtgctgttccatgtagtagcctctagccaattgtggctatggggcatgtgaaatgtgagcggtgagatcacagaacttaattcttaacttgatttaattttaattagttaataatcatacgtggctagtggctaccatattgggctgtgtaggatgagagagaaaatgataggtatagaagatggcaaaggaggggcacctggatggctcagtccattaagcatctgccttcagctcaggttatgatcccaggtcctgggatggagccctgcatcgggctccctgctcagtggggagtctacttctccctctccctcttcccctgcttgtgcttgctctctctgtctctatctctgtcaaataaataaaataaaataaatttttaaaaagaagataggcaaaggagacagcctgcacatgtaactggaatctctgaagaagaaaaccaaaccaatggagatttaagtatttatgatacagttcaagatctatttcaagatacaaatttgaagttctttcctgaaataaaagaagatttggatcttcttttcaaatcaaaatatataccatgtgccagggaaaatggattcaaatgtatcttaataaaattattagaatggaaaaacaaagaaatgtttgggcagccaggtatcttctcctccctccaaaggaagtcacttatagaagaaaaaaattcagactgccttcagatttctttacagcaatactcactgctagcagaatgtggggcaatacttgaaaaatactcaaaagaaagtgtgagccagggatttactctccagtcagggtgtctttcaagtatgaagattacagacacacaaaaactcaggcggatattgttcccatgagctctcctcaagaaaacatctaaaggataaactttagccaactaaaagatggattgcaaagactatgactatagtatggtgatgaacatttaacctaatatataacaattggaataagattaaggtaaacgtggagatcgggatggcaagtcagtatttaaatgaaatatggtctgatgatacacataaaaatgggaggggaagggaaaaagaagatggcaaatatattaaattggagaactgccttatctgtaacaactgaggatcaaataatatcattcagagttgacaaatgaagtaacagaagcagaatcatatttaacttttcaaaggtaaacacagagaaaggtattttttttataactaacattggaccgtagaagaaaaggagggcaatgggaaagaagacaaaacacattgattttaacattagtcacagaaggaaattcatactatctaaagaaatagagaattaaggatattatataaaattataatcataaaaagtaacactagaacaaaaatgaaaacccctctaaatccgaagagcaatacaacaaaaagtaaaacatagtgaacatactgaaagacttaaacagaaaaatatgaaatacatgacaactcaaaacaaacgtactggtcatctcaacaaatataaatgagcttaaatcatccatgaaaagaaaattatttaccccaacaataattcagaaaggtaaaatataaaggaatatacaaaaagtacattttaaaaatacaataggtataaaacttgaaaagtgaggtcttgggcagcccgggtggctcagcagtttagcgcctccttcagcccagggcctgatcctggagacctgggatccatgcatggatcctggagtcccagtcgggctccctgcatggagcctgcttctccctctgcctgtgtctctgtctctgtctctctctctgtgtctctcatgaataaataataaaataaaatcttattaaaaaaaagaaaagtgaggtcttgctcttactgccagaaggtagaattcaggcactaaaagaattaaatgaggcaaagaaaaagattactccataattctaaaaggcacaattcacagtaaaggtacagttaatatttatgtaacaaataatatggtagtcaaattaataagacagagacaggaagaaatatacaggataaaactttaattcactcttttcggtatttataagatccccacggataaaaacaagactaacatacacacatacagatacactcacacctagagtgtgtgcacacacataattttatactctgatattgagaatatacttacttttttttttcaaagactttatttatttattcatgagagacacaaacacacacacagaggcagagacacaagcagagggagaagcaggctccaggcagggagcccaatgtgggactcgatcccaggaccccaggatcacaccctgggccaaaggcagatgcttaactgctgaaccacccaggcatctcatatacttacttttcaagggaccatggatacttatcaaaacatacttgagaaacctcactgaactctcaaaagtaaagataacacaaactgcattctctgaattctaatgcggaaattaacaataaaatcagaaaacaaggggacccttgggtggctcagtggttgagtatctgcctttggctcaggtcctgatcctggggtcctgggattgagtcccacatcaggctccccacagggagcctgcttctccttctgcctatgtctctgcctctctctgtgtgtctctcatgaataaacaaataaaatcttaaaaaaaaaaaatcagaaaacaaaagcttcttactagcaacttaaaaacactctcttaggcaacctttcactcaaagagaaactcaaaactgatattacagaatttctagaaaacaataatataaaactatatattagaacctgagggatatagctaaagctgaaaggaaaattcacagcctcaaatatttctgtcagtgaaagagaatgaaaataagaaatgtatcctactcaaagagttagaaaaataacaaaggagtaagtcaaggaataaaagataagaaaaataagagtaaaggcagaaattaataagtgagaaaacaaaagcaaaagaaaccataaataaatggaaaaggtatggggaaaaaaataagtcaatcctaacctaatgaaacaaagatagaagaaagcacaaatacacaaaataagaaattaccatagaaacaaaaataaagtctaaagaatcatttttaaattactgtaactctatgcaagcaattctcaaaacctacatgaaatatattacttctgaggaaaacataatttatcaaactaagctcccaaataaaaaaatcaaaacatgacagtttttaaagaatacctttcccaaaaaattcagttgcaggtttcagaaaaaaaattccaccaagccttaaagaaacaaacagctgtccaatgcttctttcccaaattctttttaaactatttcaaggcaacaaaaaagaagaaaacttccaaattatttctataaagcaagtattacaatacccaaatctgacaatggaagaaaggaaggaaggaaatgacagaccagtctcatttctgaatattgatgcaaaaagactcttcgttgtctattgctgtgtgacaaatgaccacaaatacagtggcttaaaacaacatacacttactaccttacagtttccgcagacccaaagtctgggcatggcttagctgggtcttctcagagtcttaggaggtcagccaagctatagtctcgtgtaaggtgcacgtcttcttcaagctcccatggtggttggcagaaatatgtttctttgcagctgtaaaactcagggcagctggtatcttcaaagccagcaggaaagcttctttgagttcagggcaggtcctaaaccctctttgaaagggtttacctgatcagggcaggcttatgcaaggtaatctccctttcattaactcagagtcaacagattagacaccttgattacattggcaaaaatctcttcccccttgccatgtaacgtagcacaatcatgggagttttcatagaacctgtccaccctcaagggaaaaggattatatgagggtgtagaatgttgcctactacactaattaaaatagagcaaacaaaacccaggaaacattaaacaaaaacatgagagacacattatgatgttgattatttcagaaatataaaaagatagctcaggataagaatatcatttgcacagatactaagaagactttgataaagttcaacaaacattcttggtttaaaaatagtttaaaaagtggggcacctgggtgcctcagtggttgagcgtctgcctttggctcaggtcatgttctaggagtcctgggatggagcctcccatcggcctccctgcatggagcctgcttctccctctgcctgtgttgtgtgtgtgtgtgtctctctctgtgtctctcatgaataaataaataaaatcttaaaaaaaaaagaggaatgatactagaagcataacttacatacagtgatatacacagattttaactgcacagttccaccagttttgacaaatgtatacactcactgatatatacacacccttgccaattcccagggaaaaggcaataaaaatggctttaaacatatgaaaaggtgctcagactctttcatagtaattgaaattcaaaataaaattacaccaaaatattttttaacctgttagattggtgaaattccaaaaatttgctaacacgttctattgatgaaggtgtgagaaaacacattcatacatggcttgtatgagtggaaattggcacagtccttctggagagctgttacatttccaaatgcatatagcctttgacttaggaattccactttgggcgatttatcccatagatacactttcacatgtatgaagtgataaatgtataagtttattctttacagcattgcttgcagtaacagggctcaagacaactgaaatttcagtattgtacaggtaactaaattatagtaatccatataatgaaatatagatagttttgctctacacctaagatggggcttgaactcatgaccctgagatcaagagttacatgctctgactactaagccagccagatgccccacagatagctatttggaaaaacaaaaacaaaaacgcaaaaaccacaaaaaacaacccccccccccaataaaacaccctcgtatgtactgtttagatatctgtgcactgatatggaaagatcttcaagacatactaagttttgtttgtttttttttttaagatttcacccatctattcatgagagatatagacagagaggcagggacataggcagaaggagaagcaggctccctatggggagcctgatgcaggactcaaccccctggacctggggatcacaacctgagctgaaggcagaagctcaaccactgagccaaccaggcgtcccgaagacatactaagtgaaaaaaagtaagatcctgctcagcatactacctttttttattaaaaaggagaagtggaatctatgtcactatttacttgtgcataataaaattctggaaggatacataaacttaaaacagtggtctcctatgagagagaactgagcagatgggggtaaacatgggatggagacttttttgctatataccattttatttttttctctctttttgaaccatatgaatttattatctagtcccaaaaattaaatttaaaaggacaggtcgaaaatactaaaaaatcatagtggtgtaatcagaagtccggtagttggaagagttctaagttccttgtattattcaggaagacttagggtattgattagtttgactttgttaaatatgcacggtaaaaatttcagcagtaaccagaaaagagtaaagttagaatgtataacacctaaacaagtaaagaggagattcatgggggaaaaaataccaatcatttggaaaaaatccaaaatgagagaagtgtgtgtgtgtgtgtgtgtgtgttagggcagtgggggcaaatacagggaaaagtgaacaaagaggaaacacaaagcaagatgataaaaagaaggccaaatatatcaataattacaataaaactaaggagccatttaggacagagatacttcaattggatttaaaatgaaaaacaaaagctaggagtatattgtttgcaacaggctcatacaaaacttaagaccaaagagaggctcaaagtaaaaggatagaaaaggctgacttggacaaatactgacaaaagaaagccaaggtggttatattagtatcataaaaagtggactgtaagacaaaaacattatcaggaaggaagaaattcattatatcatttaaaagtacacaagggagttacataaaattggtaaaaatatggaagatctgaagaatacaattcagacggagtacctgggtggcttagttggttaagcatctgctttaggcttaggtcatgatcccatggtcctgggattgagcctggaatcaggctccctgctcttcatggagtttgcttctccctctccctctgccacccacaccccatgctctctcatgcatgtgctcgcgctctctcaaataaataaataaaatctttaaaaaaaaagatttgaagaatacagttaattgaatacacaatagagcctaaaacttagacagcattcatttttctcaagcatatgtggaacatttataaaacttaaatactagtccataaaacaagtctcaacaaatttcaaaggactgctatattgatcacattttgtgattgtaatggaattaaattagatgttaataacaaaaagatttttaaaaacccttcatgtattcagaaatttaaaaacacatttctaaagatgtcaattctctccaaattgatatataggtttaatgcaattcctattgaaatcctatcaagatgttatgtggaatagacattatcctaaaatttgtatgaagaggccaagtaactataagagctaaaacaattttgaaagagaataaagcaggaggatcattttacccaattttaaggctttttatagagctacactaatcaagactatgtagtattgacagagggatagacaccgtagaccaatggaacagaatagaaaaccctgaaatagacctataaaaaatgcccaactgatttgggacaaagtcgcaatagcaattcaagggaggaaagactgcctgtcgaacacatggtgcaagtaattgatgtctgtgcacaaaaacccacatgaatcttgacaaaagtttcatattttatacaaaaattaactcaaaatatatcacagacttaaatacaaagcataaaactacaaaagttttagggaaaaagggagaaaatattcaagagctagatctagacaaagatttctttctaagactttacaccaaaaacatagtccataaaagtaaaaattaataaatcaaactctacctgggtgcctgggtggcttagtcagttgggcatctgactcttggttttggctcaggtcatgattcagagtggtgagataaagccctgcatggggctctgccctcagcacagagtctgcttgagaatctctctctccctctgcccctctccccactcgtgttcatatctattaattaattaattaattaattaaaaataaatttaattctaccaaaattaaaatcttctgatctgcaaaagaccctgataaggagatgaaaagaaaggctacaaactgggagaaaatatttgcaaaccatatatcaaaaggactactatctagaatatttgaagaactcacaaaattcatcagtcaagaaccaaacaatccaattagaaaatagttatttgctgaagaggatatacagacagcaaataagtgcattgaaagatatttaatattattaaccacagagatgcaaattgaaactacactaaaacattcaacatgtacctatctgaatggctataattaaaaatgttgacaatatcaaatgttgacaaggatccagacaaattggatcatttatacattgctggtgggaatgtaaaataatacagtcattctagaaaacagattggcagtttcttttagttgttgcacaacaacaacaacaaggtctaggtctatttcactttttaatggatttaaaataatttctatgtaagaaaattttttacatcaaaagaaaccgcgtgtgaaatataccacaaaaatggtgtttcaatatccaaagaaattaaaacaagtaaacaaaccccttgtaagactgaaactgttttccaagtaattgagccattttacattcctattggcagtatatgggactttctccacctctttctcaatattttttattgtctgtctttttaactatagccactctagtgagtgtgaagtggtatctcgcacggttttaatttccatttccctaatgcctgatgatattaacatctttcaggtgcttattttacatccatatatcttctatggtgaagtgtccattcaaattttttggtcactatttaattgggtgtttctgagttgcaaagacacaagtcttttcttgaatacatgatttgtaaatattctttcagtgtggctcatctgttcattttcttaatggtgtttaaactatataatttttttaatttgagaaggtccaatttaccatttttttcttttgtcaattgtttttggtaatctatccactttcatttttgttcaggaaggcatcataattttgacttaaaaatatatagtagatacatttttcttacctcttcaccaattttgaataaatttcatgttgtggtggcaactctctcttgatttagtatctgttttgcagagtgaaatacaagtgagggagaaatcattttttgttttgagattcaattgacataaaacattatattagttttaggtatataacataatgaatcgatatatgtatacattgcaaaatggtcaccacaataagtctagttaatgtctatcaccatatataggtgtaaaatttttcttgtgttaagaacttttaagatctactcttttagcaactttcaaatataaaacacagtattactagtcaccatgtcaccatgctgtatattatatccccaggacttatttattttatatctggaagtttgtacattttggccaccttcacccatgtcccccacccctatctccacctctggcaaccatccatctgttctctctgtatctatgacttggtagatttcacatataaatgatattatacaatatttgtcttatttcacttagcataatacccccatcttccatccatgttgttgcaaattgcagtatctcattcttttttattgctgaataatattccattgtgtatatacaccatattttctttatccattcattcaccaatggacacttaggttgttttcatgtcctgacttttctttttcttttcttttcttttcttttcttttcttttcttttcttttcttttcttttctttctttcttttcttttcttttctttttcatttatttatttattttttgagttgggggagaggcagagggagaggaagagagaatcttctacaggttccatgctcagatcagagtccaaacatggggctcgatctcacgaccctgaagttatgacctgagctgaaatcaaaagttggatgcttaaccaactgagtcacccaggcacccccacgtcttgactattgtaaataatgctgcaaagaacatggggatgcagatatcttaatctattgttttcatttcctttgaatacatatccagaaacagatcacatggtagttctactttttattttttgaggaacctccatattgtttccatagttgttacacctatttacattcccaccaacagggcataaggattctcttttctccacatccttgccaactcttgttatttcttatctttttgataatagccattctaacaagtgtgagtgaagtgatatctctttgtggttttgatttgcatttccccgataattagtgatgttgagcaccttttcatgttccttttggccatctatgtgtcttctttgggaagatgtctattcagagtctctgcccattttaaaaattggtttattggggtttttattaatgagttgtaggagttccttatatattttggatattagccccttatcagatatatgattcacaaatattttctctcatttggcagattgtcttttaattttttaaaaaaatattttattaatttatttgagagagggagaaaggcaagagagagtatggggtgggggtgggggggagaagagtgagaagtagagcttgatcccaggaccctgagatcatgacctgagcagaaagcagacacttaattgactgagccacccaggatccctatcttttcattttattgatggtttcctttgctgtgctaaagctttatagtttgatatagtctcacttacttagttttggttttggagtcagttccaaaaacttattgccaagaccaatgtcaaggattttattacctatgctctcttctagaagttttatggtttcagggtcttgtgttcaagtctttaatctattttgaggtaagttctgtgtatagtataagatagtgatccagtttcattcttttgcatgtgggtgtccaattttcccagcaccatttattgaagagactgtcctttctccattgtatattcttggctcatgtgtcataaatgacctgccaatagatgtgtgcatttattctgggccctcttttgttccatgacctatgtgtctgttttatgccaataccatacttttggttttttttctaaagattttatttatttatttgagagagagagagcaagtggggtcagggagagggaaaagcagactccccgctgagtgtagagcccaacccagggctcaatctcacaaccctgagatcacgactgagctaaaagcaaaagttgggtgcttaaccagctgagccacctagatgccccaataccatactgttttgattagtctgtaatatggtttgaaataaaaaagtgtgatgcctccagatttgttctttctaaatattgccttggttatttgggtcttttgtgtgtgtgtgtgtgtgtgtgtgtttaagattttatttatttattcatgagagacagaatgagagagagaggcagagacacagacagagggagaagcaggctccatgcaggtagcccaatgtgggactcgatcccaggactccaggatcatgccctgggccgaaggcaggtgccaaaccactgagccacccacggatcccctcttttgtgtttttttacacattttaagattgtattttctgtggaaaaaatgtcattggaattttgataatgattacattgaatctgtagattgctttgggtagtatggacattttaacaacattaagtgttttaattcatgagcatggaatatatttctatttttttatgtcttctgggttggcagcttattaaacacactaaacatgcaattaccacatgattcagcaattgcactcttagacatctatctcagagaaatagagacatattcacataataacttacacaaatgctcatagcacttaatctgtaaaggctccaaactggaaacaattcaaatgtccttccatggatgaatggtaaaacaaagtgtgggatatccatagcatggattagcaataataaggaacaaattattgataaaggcaacaatttggatgaatctccagagaattacgcttagtgaaaaaaaagcgccaaacccaaaaggttatatactgcatgattccacttacaaaacattctagagataacattccatttataaaacattctagagataacaaaattacagaaatgaagaactgattattccttgccagaatttaggaaggaatagaaaggcgtggctataaaaggacaacataagggatccttgtggtgatgaaatagttctttagcttgattgtattgatttcattttttaaaaaagattttatttatttattcatagacactgagagaaagagacagagacacaggcagagggaaaagcaggttccatacagggagcctgatgtgggactcgatcctgggaccccaggatcacaccccaggctgcaggcggcgccaaaccattgcaccactggggctgcccgtttgtattgatttcaatatgatagaagccactttcaaaatggtggagaaaggactatcaaaaatttgcttcttgataaaagctatgagaacaatggcaaaaattatcaaaatcaacattttcaggactctggaaattaaccaaagactgaacaacctgagtattttttcttgaaaaatggctgaatctcaataaacaagagaactttgtggcattttaacttgctctattcccatccctctctccttagtttcacagcggcgttggaacctaacagccctgcaatcactgtacccatgaaaaccaggagcctggtaatcaacagacaggacaaaatgggttttggagcttctcaaaggtccatcctcaaagaatatatatcatttgacctgtctggaagttccaggtaaagcaccactctcagggcttgcattatttgaactgactgagagctccttcattgtgaatacccttttccctggaacatttgatggaaaacaatcagtggcaattgtttaacatccctggtgtttcaggtgataacaattgggtggggcaaagaagtggacaaaaacttataaggaaaaacttcagaataagatatctatgggtatctttgaaaaagataataacataatcctggaaatctagaagaccacatgcaggactatttgcatgcctaggaaaggcctgactgagaagtctctaaattctctcaccactggcagatcttgaagcaggaagtaaagatgcaagcagagttgtccacagtgtgctggagtcttgaagatatgcacacacacactcacatacacacacactttgcaaaggctgaaaaacttattaatgaatggcatgtacagaagtgtctgaccatttattccctgatcactaagctaaccgagatgagattatagcggctacattatgacaaagaatagacttcacagaattagttcaggaaagtcactaaaagacagtagcagcagtagtaacaccaacacgtgctgggaagtgaagggattctgattttgacagttgccacattatattatttaaagtgtctagttttcaacaaaaaaattatgagacatgtcaggaagcaggaaaatatgagatatatgaagggaggagaggaagcagtttttttttaagattttgtttattcatgagagacacagagagagagagagagagagacagacagacagagacacaggctgagggagaaacagaccccatgcacccatgcagggagccccatgcaggactcgatcctggaactccaggatcatgtcctgagccaaggcagacgctcaatcactgagccacccaggcatcctgagaggaagctgttaatagaaattatttctcaggaagcccaggtggatagattttattagacaaagattttacatcagctattacaaatatgttcaaagtggggtacctgggtgcctcaactggttaagcatctgactcttgatttcagctcaggtcagatctcgggttgtgagattgagccctgtgtaggactctgtgcttgagggggtgtctgcttgaggttctctcactctctctccctctgtccctcctcttgttctctctctctctttaaagtaaataaataaaacttttttaaaaattaaaaaattaaaaatgaaataaagtcaactttattgaggcgtggagtctacttaagattctctatctccttatgccccttccctctccatctctcactcttaaaaaatgataatataagttttatattatatatattatattattatatttttagttctataatacattgtagaactaaagaaatatatgagaatgtttcatcaaatagagaacatcagtaaagagacagtataaaagagaaccaaacagaaattctggaattggaaagtacaataactggtaaaaaaaaattttgctaaaggggcacaactatagattcaagctgaaagaaagagggatcagcaaacttgaagacaggcagttgaggttttccagtctgaagattataaagaataaagaaaaggaacagaatgtcagaggtctatgaaataccatgaagtgtaccaatagataacgtaacagaggccccagaaggagaggagagagagaaagaaatatttgaagaagccatggccaaaagcttcccagactgggtaaaaaccatcaatccacacatccaaggagctcaatatactctaagataaattcaaagaggtccatacttagacacagcaacataaaactgttgaaaaccaaggacagagagactttgcaagtagcaagaaagaagtgattcatgacatataaggaagtcttagtaagattaatagctgaattctcatcaaatgtcaatatcctagttgtgatattttatacagttttgcaagatgttatgattggaggaaactgcataaagtgtacatggaatctctttgtattatttttataattgcatgtgaatctacaattatttcaaaataaaaactttaattacacacacacacacttggaaaacagctcttgagtctaggatgaaatcatagtagaaatgtaaaaaatatttagaactgagcaataataaaaatatgatatattaaggcttaagaaacaaacaaatagtagtgataatttgaataaacttatagccttgatgtctatattggaaattaagaaagtctgaatattaaagaattagacacccaacttaattagaaaaataacagaacaaactccagtagaaagaaggaaataaaaatgattagagggatccctgggtggtgcagcggtttagcgcctgcctttggcccagggcgtgatcctggagacccgggatcgaatcccacgtcgggctcccagtgcatggagcctgcttctccctctgcctgtgtctctgcctctctctctctgtgtgactatcataaataaaaaaaaaaaaaaaaaaaaaaaaaaaagtctgtttcaaaaaaatgattagagcatcaagaaaatagaataaagagaatcaacaaagccaaaaactggttatttggggggggggactaataaaatttacaaggaggggagagaaaagaaaaaatattagtaatgcaaaggggacataatcatggatgcaggagagatttaaagataatattttgcaaaatttagatgaagagaatctagagtaatataactcaagaaatacaaatctcaaacaattctaggcctacaaaagaaactgaaactagttaaaatttcttacaaagaaatcatcaggattaaataattaggtgagttctatcaacttttcaagaagcagttcatttcaatcttatataaactcttcaggaaaacagaaaaagaggaaatagtcccaattcattgtatgagattaataaagcttaattcccaaagtaatcacattacagcccatctcactagtgaacctagatgcaaatatattaaagtattagcaaatcaaatcagtgatgtataaaaggggtaataaatcgtgacaaagtcaggctacttccaaggatataagaatggttttattattagagaactaattcttcccattaacagtaaaggagaaaaccaattatcatcttaatggatgcagaaaaagcatttgataaaattcaacagtcatcatgatataacatttactaaaataagaatagaaatgatctttcttaatctgttagtgtatttaacatacatctaagataaacatcattcttaatggtaaagggcatccccctcctcatttttaaaagattttatttatttattcatgagagacagagagagagagagagagaggcagagacacaggcggagagagaggtaggctccatgcagggagcccaatgtgggactcgatcccaggactctaggatcatgccctggcctgaaggcaggtgctcaaccactgagccacccaggtgtcccaagggcattccctttaaactaagtaacaagataaggattctatgatcactacttctatcccacattgggctgaaggtcagtaagacagaaagaacgaaagaacaaaagaaagaacctagtatttgaaaagggaagatcaaaactattattcaccaataatataattatctaaaagagaaaacccttaagaacataccaaattactagaaataataagtttagcaaggtcgctaaatacaagatgaatatgcaataatgcattccccaaactagcagctaacagagaaatatttaagatactatttacggagcacctgagtggctcagcggttgagcttctgactttggctcagggcattatcctgggtcctgggatcgagtccctgcattggagcctgcttctccctctgcctgtgtctctgcctctctctgtgtgtctttcatgaatagataaataaaatcttaaaaaaaaaaaaaagatactatttacaatataggcagttgtggcaatgacctggctagaccatatgtgatttctagtttgttctccagtctcctgtcaattgtgagctctcctgaaacccttccagtaaattctttttgcctgaaaactgttagatttggagttttgttgcttgcaaacacatatcctgcacttatgctattacattaattgatttttggaataaaatctgtgtcaaggtttgtcaagaccagccccaaattcaaggattggctaggaggaatcataggactcagcatgcagctgtacttatggctatgatttattacagagaaaggatatggcacaaaatcaacaaagagaaaaggcacatggggtttagcctggaggaaaccaggcccaagctttcgtgaggcctctctcagtggagtaacagaggacaccctattttcctcaggtgctgattgtaacaacacgtcaagcaagtgttgcttaccagcaaagctcattaaaactctgtccagggtttttaccaggggcgggttacataggcaccttctgccttctggaaggcactcaaatcccagactttcagaaggaaagcaggtgttttgcataaactatattgtttgtacaaacagtttggacacaacgagtcactgttatcagtaagggtggtaagaaccttcacaaaatccaagttcccagatgccagccatggaccaatcttgcaagcaggcctttcaaaggatagctttcaggtctgctacgctagctcttttctgcatgatgggcatctacttgacatattgaattgaaaagctaatatattatagccacttgtcaatccatttacttcattatggaataatatcatttatctttaaatatgttttatattaacttttatgagattacacagttttagaaagtcaaataatactatgaggcttaaaaataaaaccagagatccctgctttactccaactcctgctctcccaattcaaaagcaactattacaaacttcagcagtttttgccagtatttatctttcatttctaaatagtatgcatttactcttggatcttgacttccgattttatacattatccttcaattatggacgatgaggatttaaccctcttagatatcttacttcatagtcccaaaattgttttatcataatttttagctaactccctattctgttttttattattatcattatataaatgtttgcaaatgagccacattggctcaactgaaattacatttttcatgagagttgtctttcctagatttagtaagtgcttgttctaaaattttcattttgtatgttcatattattaaattcatctgcaaactctccatcagtgctgaaaaacttcctgtcatatggtcaaatgcttccggtaatctatccattccaattgtttccaaggtcctctctgcttcctctaactccaatggttgcgctctaggggtgatacacaattcttccctggtattccctttcaccataatcctggggttgctttttatttctctttcatattagatctcattttatagatcctgtgacttttacttttcttattttctccacatcattttttgtggtatctttcagttgcttcctgagaaagactagataagtgagaacttgcatatctgaagatgcctttatattatttccacactcagttgatattttggcgaggcacagacttttatatcaaaaacaatattctctcagcatctgaaagggttattctattggcttctagcttgatgtcattctgactcctagtcctttctatgagatctgccttttctctccagaagcttctaggatcctccctttttctagtgctggtgttcttgttttgggcctttttgcattcaatgtaccagatcactgggggagccttcattctgtaaactcactaccttcctttccgggaaaatttctcatttctctttttagagttactattaaggagatgttgggctccctgaattcatcctcaaattctcttttccgtttactgttgtatttctttgtcctctctgggaggcttcctcaacttcaccttccaaatgtccccttgtatctttaaaaatctttcatatttttggggggatccctgggtggcacagcagtttagcacctgccttcagcccagggtgtgatcctggagtcctgagatcgagtcccacatcgggctcctggcatggagcctgcttctccctctgcctgtgtctctgcctctctctctctctctgtcttttatgaataaataaaaatctttaagaaatgttttttaaataataaaaatctttcatatttttaatttcaagccccccccccctttttttggtctctctctccctagtaatatcatgttctgatttcatggatgttactctttgaggctaagatattcatttgtcaagatttcttggttctctgcattgactgttttcctttgttttagactctttcaagagattattctcatctatctgtaagttctcaacttttaagaggtttaaattaaaaagactatttaaaattgtgtgtattcgggtagggtgaggcagttcttgatatgtggtgggtttcggtataaggcaaaaatggcaagttggatttcttttttattattagatatgttcctccatcactattcataaatggtctttactttcagagacgaatcctggaattccttaatatcctctaatctatagctcttaaactttaatatgcatatgaatcacctagggggagtcccactaaaatgcaggttttagtttattaggtctggagtggggcctgagactctgcatttctaaccagctcctaggggatgccaatactactggttcttggataacaattggagtagcatggctctcatataaacttggcttccagtattctcaaatatgaggggatggaaagggcacggtcactgacgattttgatgtcatgaaaatacttctttcaattacccctgaaaaaaaatggactggctcaaaatgctctcatcggatatttttctcctcccccttctggaccacaagtgccagcaatttgtactagcctctcccttcctctttatcagccctgagaagggaaatggggtggagaaagggttgtctcaccattcattacatagagcttcatttcaactcccattttcaaaatggcatttcattcctgccatctttagtaactgttaaaaactgtgtctacaagtccagatgtctttagtttaatttcttgagatggtaaatgtccaaagagtagaggggaaatttggcatctaactccccctttaacagatttttcagccaattctaacttcaggtctattctcccagttaccagacccatccaccacttcttcagaagttatctgtagtctctaacttctaagtctttctagtggtctaatgtaaatcaggtttttttaaaaaaatatttttatttacatatttatctgagagagaaagaaaaagagagagcacaagcagggagagcagaagagggagagggaaaagcagactcttcaataagcagggagcttgacatggggctccatcccaggaccccaggatcacaaccgagctgaaggcagacgcttaacggactgagccactgaggtgccccatgaatcaggtttttcctggctctttttgcagacttgttttagcttttcctgatttgttcatccacctacttccattcttcaaaattttattgataattctcatctgctattccctcatttttgttcttgcagacattattgtttttttgtttttttcttttaccatttactaacatatcagtgaagttttggggataaatgcatgtgcttaatccacatattttaactatccatcattaaactttcctggaaatgtctccctctcatgatagagtactacagtgtagaaggtagattgagtttaaatgtgccttcatttcattgcttatttgttccacctttactatgttccttttccttgttctctttgtggttattttatgattcccttttctctctttgttagcttgtgagttatgtcctttatttttattctcttaatggttagtctaaaaattaaaacagatattctttatcaactcaattgtggtacaatttacataaaataaactacagctattcagtagtgtgaagacttttgataaacgtttctccatcaccataatcagcttacagattgtttccatcacttccaaaagttccctcatgcctccttctagttagtactttcttccacctgtgggcagctaccaatctttctgtcactatagattttgcattttcaggaatttcatgtacatggaattatactttacattacagtaggtgttcttgactaatcaaaggctaatattaatctttgaacttttcccttttcccagacaattcaaggactttaaaacactttaatcctggaattctctaatatgctgtagtccactgcttcctaactttgatttacatattgtgttagtcagggttatccacagaaatggtatgtgtgtatataggtatgtgtatacataaacacacatatataaaaatacatgtatatttgcatatacatacatgcaaatatgtgtgtatatgtatatagagatagggatattataggaattggttcaagtgtttatggaaaccaagaaatcccataatctgtcatctgcaaactggaaaagcagggatgtctactggtataattcaatctaagtccaaaggcccagtaaccaggagccccaatgcccaaggacagaagatcacgttctagctcaagcagacagcaaatttgattttcctctacctttttatcctgttcaagtcaacagattggatgatgcccatccacattggtgaaggtgatctttactcaagcctactgattcaaatgctaatctcttctggaaatgccctcacagacatacctagctctctgggcatcccttggcccagtcaagctgacacataaaattaaccattacatatatgtaggggaggatcctctcctcctaggggaggatcttgtaatacgcaggttctggcttagtaggtatcattgtttttgtgtattttccctctttaaaattataccagatagatggcaactgctgggctggtcctgctaaaatacagaaataacatattttatggtatcctgactttactctgattaagaaattaggatttaaaaagaaaaagaatttaggatttaatgggaatgctaaaggctgaaatgagaagacattaaaccagtttgaacaactgacacttgccacaaaatatttactttcaggcctgtggctgaccattctactgagtgtatgataaaaagtgttctagctagaattcaagtccacagcgaataatgcaagccatagtagatggagaatttaagccatattataccatactcttctcacccgactagatcttcgagtgtagaactattcaagtcatttacctgttccaaaactcatcggggactactgccccttcacaaccagttccctaacagtccccacactttgactttatttttacttttctagccttctctctcacatctcccaattttgggttaaatggggtactgcactgtatcctgaatcaatcttatggtgttcctttcacctttctttgctaatgctggtgctcaggctggtccatactctgtattataccatcctcccagttgacactcaatctaaattttaaggtggagctcaaatggcaccttattcacaggaccttccctcttttctctcttctctaaactctcatgctattttgcttgtatctctctgagtggcttatatgctgtatgtatgtttattaacatacttgccttattcctgtgatagacttggaagtgactcaggcctaaaagcatggccttttcacctctgtggtttcataagcataaaatagaaactcacctgcagctcacaattattgaatgattatgtattttagcatgatcaaaagagacttcagagaacttgagctaactatttcctcagtccttgggcccacatacccaacaggggctcctatgcaatcctctgccacctcttaattttcaataattatagcaacactgtaaatacctcctaagtctgaacctagatgatcttctccattgttcctatgttcaatcagccatcaaattattgatctatcttctgatttctgatttgaatcttcctttcccttctcctctaccatccttttgatcactctggataatgcccttttattgtcataattcctgattacttatagtaaattcttcctgatttacctaatactgttccagctctgatttatcctgtacacaatggggaccataataataataatagagttaacaggttgataaatgagaaatggcatgtatactgggcctattttgtatatgtgcccactgtacctttggagattcacctcctgcccatgtcctctggtcctagcagtagacaatggccagacttcatcagagtatatcatgtctttctggtcacagctatcagttcaggttggctgagagacagctagagacagtatcctgatgagataatttgagtctcttggctttgcctaaagccagatgtactcctggactttctgattatgtgagtcaatagattttctttattaaactaatctgaatttgttttctaagtgcaagaaagatttttgatattacggtacgtaaagcactaagcatactaccttgtacataagtgttagggattattcttattatctttatacccttgccatacaccatatccaattcaaccttttcttaacatctgcccatatagaccagctagaataatttccttattattccctgcatattgttcctttgcctgggcttccctgtcaccaacctaataacgttattctacactcttttcagcaattcacatccatcattatttaggacctggctaaaaaaaaagcctcccattttccttttgaataatggtggcttcacactgttcactgccttatctaatttctcctgcatgtgttttctacttatttccagcttgcttcttgattgtatgttactcaaggcaaattaaaataagatcattgggccctttttaggttgagattttgtcattattttccaaatattttgtacagaatgggacacataataggcgttcaataagtgtctgctatcggaataaatgaatggaattaaatttagaaggtgtgatattcaacttaaaacctattgttaacccaactttttcctttttctaagcaaacattatattcttaaaccattttcattatggcaaaaaaaatatcacaatggttacaacctcaaacatttttcccatttatggtttcatacttttggccaacgtttaaggaaggaatattctattaaaaacaatttaagaatcaatcaaagcctattttctctcatcatacatattaatccagtggcattgcatctgacccttcagaggtttcttgctctggtaaactaatgataataataaagcattgacaaaaatatcctgagatgctgaaaaaaaaaatgagggggagaaatttttgtattcacgtttccttttctaaatggtaaaacattctcctacaccaccaaataagttagtttatactcaaaaatgcatagttttgaaaaactgctatttggaaacaaaggtttgtgcccatgtttgttgaacttaattgctgtaccgttaatggaagagctgagggctagtgaatttagactctttaaaatagctaaagattaaagttaattgaatttagtgcctctgggatttttgatacatgttccaaatttgtttttaatgacataattgtcccatgttacatttaagattacatcattgtgaactggttatatatgcagttaacactaacagaaaccaatcccaaatgtcaaaaacaaataaataaatgtcaaaaataaatgtcaaaaaattagagttgaggacaaccataatgttgccattaagaaagtggaagttgaaaacagaagagaaacactccattgaacaaggtcttactatgaaaacttttaatagaaagatctggaaatcaaatgtattaactctatgctttttcaagagcatttaaatcattattttacacttaatgttgcaagtagaaacgaatgcattttcccaaggcatctattcattaactttagtggaaaaagatagttcccaatcacacaaatgggaactgtgctaaataaattttgtgaacatttatcaagaaatagaagttacaaaaaaaaaaaaagagaaagaaatagttactagtcatatgtataaatggacatagttcatattttcaaagaactgaagttcagtatttttgtttcttttagtcttcggggtctcaccccccccccccttaactaaaagtaattgtaatattcttttgcctctggggctttcccttccacaattaatcattttttatctacaccttccctccaaatgattattcattccccctagccttagaacacttgacattaattcatactccttcagcatcagttttcaaaacattgccctgcccttgcttagctccacgagacactcccttttctttcagaaaattggttaacagaagaatttttgctatcactctgctatcactttgacaaggtgctaccatgaaatcagaaaaacatctttgtagtacaaattagctttccttactttcatcgaatcttcaaattcaaaacacaatatatttaaattccttgcgataatgaacatctatacttcaaaagtggtgatatgctccgtttaaacatttggaagacttggatcctgagactatctttcatcctctgactctagaagccgtgtccttgatcatcagaaccaagcaagaaattgtgaaaaagtctcaccaggctacaccaccagcgcgggcagaggaaacgctttcaaaatatgtcattcatcttcacattttaaaggcagtctatccatacatgtcttatacacatcattaaatattggtacttaagacttcagtcgtatgaggtacgttttccaatttacaggggacgtgggggggggggtgccgaaggagtgttcctctccttaaatttacttatcgaaacaaaagccagtctgattacatctgaaagtctgaggttgccatttgtcaagagtttttttagaaagccgcttattgcattaaattaaccgattcctagccaaatcaggtttaaggagagagtgctgctcctgtctccagtgacaaacgagttgccagacgtccttaagtagactgtcaaacttctatgtttactcttttaaacacataagggagagaatagcacctaccagaagtcagggctgtttctgcaaaaacgcgtcctctggggaacagacgctcacctgtgcacctcagacgggctttccccgccgccctccctggcggaggggatggacatcgctagaactttgtcctcgggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattccccccccggccctggcggcgagccgccgagtcccgcccccgttatgttctccaattggtcagaccagaggagggttccgccccctgagcgtcccttggcccccggtttctcctgacgggcaggcgaggcgaccagtgggcgctcgcctctctgccccgctggttcgctggcgctagctttctctgtgtgagggtcggactccgcgtcagtcggcctctggtgcgctcgccccctcccttcaggggaggcgatgttatttccctcctttctcctcggaagggtcaagattcttctggaagaggtgcccctttaaaggggcaggggccttggcaggggcgctccctgtctcctgagtctctggtgggctacgggggacacaggctaattgcagaaactcctcgtccttcggagacctggtggggtgggcgagtgggggctcgggggtgctgagaggacctctgggggcgttggggtatcaggaggcgtgtttgtggcaagggctgtgtgggttgagaaactcccgccaagaaaactggactgtaagctccttgtgggcgaaactcgtttcctcagcagcggccctcgcctctccagagttggcctcccggtgcccagaggctgggcaggacccaggaggttttccacagatgctcgctgctggggtgacggctgacccaagctgctaaggaggtggcagggagggagaagaatatacagcgccttaacaaaggagggtccacaacctctgtctaaaactttgaggttagcgttgaggcagattttcaggcctgtgcgaggatctccctgcccatgagggcttgggggcaatgaagcaggactgttagcctgggctacccccccccccccccgagttggcatttgtcgggcatgtagtggccaagggcctctggaacctggacagaattgctgtgatgattctgttgccttttgttccaaatggggtgtgtgcctgcctggcactgttcctcagccaagttgttttttgtttgtttgtgtcacactttttttttttaagattttatttattcatgagagacacacagagagaggggggtagagagagagaggcagagacacaggcagagggagaagcaggctccatgcagggagcccgacgtgggactcgatcccgggtctccaggatcacgccctgtgctgcaggtggccctaaaccgctgaaccccctgggctgcccctcagtcacacttttaaatgaagatcttaataccttattcacatagagcaacccttaagggatagatttcattttcattttactggtcgagtgtggaggcccagagagatgaagtgactttctccaggtcacacagggccaagattagaacctagatagccccagagcctcgttttgtaccagaccatggcatctctatggtggtccttcttcccactgagatgagttcaacacatcaggagatccgggtttgaattgtagcttcgggttgagtggcacctttctgagcttgtttcttcatttgtaagatggagatgatatctgttctaccttccaaactagttgagagaaatgttaaaaagtgaaagggattggggcacctggctggctcagttggtggagtgtgcaactctttatctcagagtcaggagttcgagccccatgttgggggtagagactaatttttaaaaatgttttaaatcttaaaaaagtaaaagggatttgtaatctgcaaaagtgtgctaaattatcatcatcatctctgctttatagataaagatggtagatcctgcaaccaaggtgacaaactccttttctcttttaaatcctctcactgttgtacttttccaagtctctgcctgcaccctggggtaccatacctctaatgtctttcctggtagtgatggcctcaagtaattgctaccacagcttcttaggagcttgtcatagttccttttacccatagaatgatgtgggaaactttagggctttctcctaaagtttcccacatcatttctccttgttgcataagggtagggtaggtataagtatttgggggagagagggacatttgaggtaacagaatgcattaagagtttatctcagatattgccccaatcaccttagctgtaggtccaatgaggatcccagataggccacttaaaacttcagtgccacttggggccactcccagagcttctagtgtttctgcttagatatactagtcagtgcatcctgaatgctggcttttccagagacaacctgcataggatagtttgaagtctttagcctgcacatagtagacatttcaggtgccttcacctcttcattcctgggttcaggggatagggtttctgatcattgtaatatgggttgggagagggctttagacctgtgaggtgttttgttgttgttgtttgtttttaagattttattcatgaaagacacagagagaggcagagacataggcagagggagaaacaggctcccagatagagtccaatatggaacttgatcccaggtccccgggatcatgacctgagccaaaggcagacgctcaaccactgagccacccaggcatcccaacccgtgagtttttgatcttctgatggggccactggtcataaacagagcttgaaaatggatgctatttttgtttcctttttttctgaacccttgacctccccctccttttccatagttagctgttacacagcctacatgcatcattagaactctaggtgtctcccatgttgtaatgatctgtttacttttctgtcccttcaattagatggagcacctagatggcagggatcatgcatgttggaatttttttttttttttttttttttttgcatgttggattttgcctttcattcatctgatacttactgagtgctaacttaggagctagcaccatccaggtgctgggaatacaacagtgaacaagatagacaaaattatttcccctcacggagcttacatttctgtggaaggaagcaaacattcatgataagtaggtaaattacatagcataataaaaaatggtgttgtgttatagtgaaaaataaaacagaatgagagattgctagtgggggaaagagattggcagtattagataagagtggtcaggctctcattgagaagcagtgtttgtgaaaaaacttgcaggagcaagttgtgtggatgtcagaggggcaggatgttcagacagaggaaacagtcttcttggtggcctctcgatcagatggaagggtgaatgagtgcatgcctgaaccttcagctctgcctcctggtctctccataggcctgtccccttggttcccaggtgccatgaggaagccgcgccggaagtcgcggcagaatgccgagggccggcgttccccatccccctacagtctgaagtgttcacctactcgggagaccttaacatatgcccaggcccagcggatcgttgaggtggacattgatggacgcctgcatcgaatcagcatctatgacccactcaaaatcattacagaggatgagctgaccgcccaggatattaccgaatgcaatagtaacaaggaaaacagtgagcagcctcagttccctggtaagtccaaaaaaccctcctccaagggcaagaagaaggagtcctgttccaaacatggatctggcacttccttccacctcccgcaacccagctttcgcatggtggactcaggcagccagccagaagcacccccactgcctgctgcctactatcgctacatcgagaagccacctgaagacctggatgccgaagtagagtatgacatggatgaggaggaccttgcctggctggacatggtgaacgagaagcgacgtgtagatgggcatagtgtggtgtcagcagacacctttgagctgctggtagaccggcttgagaaggagtcctacttggaaagtcgcagcagtggggcccagcagtcacttattgatgaagacgccttttgctgtgtgtgcctggatgacgaatgccacaatagcaatgtcattctcttctgtgacatctgcaaccttgctgtacaccaggagtgctatggtgtcccctatatccctgagggccagtggctatgtcgctgctgcctacaatctccctcccggcctgtggattgcgtcctatgccccaataagggtggcgccttcaaacagaccagcgatgggcactgggcgcacgtggtgtgtgccatctggatccctgaagtctgcttcgctaacaccgtgttcctggagcccattgagggcatcgacaacatcccacctgcccgctggaaactaacctgctatatctgcaagcagaagggactgggggcagccatccagtgccataaggtgaactgctacacggccttccatgtgacatgtgcacagcgggctgggcttttcatgaagattgagcctatgcgtgagaccagcctcaatggcaccatcttcacagtacgcaagactgcctactgtgaggcccactcaccgccaggtgctgccactactaggaggaagggtgactcccctggaagcctcagtgaggctggggatgaggaagggctgaaggaggggtgtggagaggaggaagagaaggaagaggtggaagaggaagaggaagatgaaggccaaggtggggtaggtggccccctcaagggactgcccaagaagaacaagatggctttgaagcagaagatcaagaaggagccagaggaagtgagccgagatacaccctccactgtccccatggtcactgtcccacagataccttcttataggtaagcctgcccaggagggctccccgtggactgatagtctcttcttgggttggtgttggccctgagccaggaactctttccccaagcatggttggtgaatgtttgttctcttctgtgccttctcctttgggccccaatctggtttgtggttttgattttgccttgagagcaatgtatttcctgtgctttaaggtgagacagttaagtggcttagaaacccaggtgaagggtgtctaaggcaatattttcaacaggtgcacaagtgacatttgagacaggataattcttcactattaggactgcctcatacattcctcaatgtttagcatccctgatctttgtccgttagtgccatttgcatcccctccctcattgcttggtctttgtgaccgtctcaaacactccccacatatgttaccaaaacctcctgtggtgatagaagtgagaaccacacgactgctgtccagaaagctctgtctgggaatgatggggactttgtgtgagggagtggtggtgtggggaagacatgatctttctcttcttgagaatcttctagatttaggggaaaggatcacttggttcagttgtatagctaagccaccttggtccccagtgagtcttatagagagaccattgtacttatttttaaccatcagagaagtagctgttggagggcagaaaagcaagagactggaaagattttccagtagaagctcatctcaagggtgatattctttagaaagtatgcagtgttggagcagaaaggaatattggaaattattcatctaatgtagtccttgcaccttctcccacacccccagatgaagaatctgcagccacaggaggtaaagttgttcatgcctttgttcattcactgaggtgtttattgagtacttactatatgccaagtcctgttcaaagggctggaaccaggtgggaagctatagaacctgaccacaagctggggctcatgatgccatgtctctgttcctgctgtttgccttctcttgttgaaaaggatagggagaagtgagtgctggagggtagcagggaatgagttgtaaggggaacaggcaaccagacttgtcagtctgggaaggagaaaaagagcagagaagggcaggagggagaggctcctatggcgaactatggctggaattagaattcagtcaactggaaatgacttgtagtcacagagctgttgtaggctcttctctgatgttgagttggtccatgcttagaaacatttgtagggtggctatgccctgggactagtctctttggttgtcacatctgctctgatagatgtgtcttacaggggtcagcatagcatgctggcttagaaaacagaccaacctgcttttgaatcctgctcctgttgctaactacctgtgtgacttttggcaagttacttctttgagccttatttctttctaaatgaacctcatagggttgttgtgagaaatgaaggagatgatataaataaagcacttggtacagtgcctggtaaatagtaagcgctcaataaatggtggctgctgctgctgttttattcttcttcttcctctctctacctacacaaatgctagggggacactccatggccaagaggttatagagggagggggctgcctgcatctgggcaggtatgcttggcatgggcattggtgggggatttcttctttggggaaaggcttagatcttgattttgtaagcttggctttggggcaagaatgtctgtggaaatgcatagggcacttaacttcctttcagtggatagagatgaagagaaaaagtggggggcacacaacaggagtattgaggccttgcttattactcttactctgtgaataaccaatttggggacacagggtgctgtagcagagagatcactgattcaaatcccattcagctccaccatccttctggccacattagtgactttgacagttcatccagcctctgttcctaagctgcctttccatcttttgttaccatgagactgatgttacccaccttgcaacaggactattaggataaagattataggctcttattaattccctccccttttgcctctacctctcccacctgccacatattattaagtcctgaccttaagacttctctattgggttaattgagccagctaagttttcagattctccgtcctcttatccagttttttcttttcttgtttgtttcaaaattagacacttttaggctgctgagatcgttaatgaaaaaccagaggtcagacggctctgaagtgttgcatttgagctcagagagccatagcctggcgtacttctagttttccttccagcttgcttgtggactattctctggtctggggggaccctcagccacagggcgcaggaagtagtgaccacattgcccatagcttactcaagttcctgctctcttttcctgcctatatcaagagttcagggcacaggcctatttcccaggagtctaggaccacaggaaacagggttcctgggagagagttcttctggagaatcaggactgtaagataggggggtggaaaatcaagtgatacatctatcacatgctgaatccgagctgcttaactttgctttcttttttttaagcctttctctgaggtgaggcaattggccacttgattccatcttctttcatatgtaaggttcagaaatgagctagggtctgaagaggaggctgtgatcagggctgcccactgaccttgtctttcacttccctgtgcctctactcaaggttgaacaagatctgtagtggtctctcctttcagaggaaaaaccagttcatacagcggcttcacaactattggctattgaagcggcaggcacggaacggcgtccctctcatccgacgcctgcattcccacctgcagtcccaaagaaacgctgagcaggtaggtgaagtgattgaaggtggtggaggaggtggagagtgaaggaggaggagggatggttgggtcaccactccctgagccctctgtagagcctttgtgtcaataggcagtcacacttccagatggcatctcccaggaacgacctccagcactgtagagctcttggtcccagacagcagctcctcctggatgggagagggttgattttggagcaaattctagaagagagtagagagcaagcccaacttccaagtatgtggggaaaacctgtagacatggcagaaaggaaaaaatgggtttaatgagggccaggtggccatgttgcataaattaggacaaggagcatttttcttaagacactgtactgacatctgccagaaaatgttttgtagaaaacatgcaaatgtgccatctaagttgtagcacagagcctggccagttgtggtgaccttttagccgtggaaccttggttggaggtctcctgagagacttttttttttcccctttttttaaccgtctttagttttttctccctcctcacttgctccattacttctgcctttaaatatttccacactatcaccgcaaagatgaagcaatcatttacgtgactctgatgccctctaagttctgtctgatttcacttttgccttttgtaactaaagtcctgaagtgtaagtctgtgtttcctccctccttgaggtggggaggattgcctgctcccctgtagcctcctttggaacgtcaaccacctcctcccagcccagcaagccttacctcacattctcaccgtagtggccgatgggctgcattttcaccatggatcactcttagagcttctccatgaccccatatccctccttctccacctggctgactgcaccttgtgctgacttgacctgttactcctcagtagtaacattcccagggctctgatgcctgcccgtttgctgggagagctcgtgcactctcatagttgtaaataagcgtggtaatagctccagatttcttgtcctcatcccttttctctgcctgtagtccctctggggcaaaggaactgcagatgtccatgtagatgttgtttcctagaattcagatatcggaaactgaattctttatctttcttcctcttggtaaacttatttctccattattattctttttttaaagatttatttatttgagagagcgagagcagagggagtggcagagggagagagtccttaagcagactccccactgagcacagagcctgacatgcagctcaaccccacgagaccatggcctgagccaaaatcaagagctggacacttaactgcctgggtggccacccaggcacccctgcccattattgacatggaaccttctgcctcctgacctcagacattccccatcttggagttacttttgattctttcctccataacaagacacagttaatcatcccttatgctatttggggccagtttattggcatatggtcttttgtctccattctacagctcacccgctcacccaaattcccataatttcagcaatagctttctaggtagtctcccgcctctaattctttctttgctgttcaactgatactgtcttacacaccattttccagaatctattccttttccagaacatagtccccctctcctggcaggccacatgcaggttcctttgcctggagttgaagcttcttaccagctaaatcctggagcttccttggctactgtggttctccagcctctctgctctggccgggccattttttctttcttctttcttttttttttttttaccaagcagagagtcatttttttctgccttcacacttcttccctgtggtccctttggttccagcagaggcctttcttactgctttgttcacctatgtccatcactacatgtgaaatcctagtaagattgcttctgtgggaagccttccctgacctaaaatcaaccctctcagatcctctttatttatcttctcaacattttatattcagtttacctttgggtttttattatgtttatgctactgtgcccttgtgtgtccaaccctgggcctcttccttcccccaactctaacctctttctagggcaggaatcacttttttgagtacttgtagtgttttaaagtatgttcaagccagctagtacaagctggtaataagaattttactttgttttttagacaagtggcagctttaggatgaaattctttctacctcgaggtattggtttccttctgaaattcttttccagccctaaggggcacagctccaccaccccccttggtatcctcaggaggaggggaagtcgtcccagctctcactccagtggtgcttattgtggggcagttaagaagcattgctggaaggctaagggagtgcaggagaaaggcatggggcagagagggcagaagggctctcaggaacatgggtcagccagggtgtggggcccttacctgccgaggccctgtgaggctagaatagggaaagggctctggacaggaagcgggcctccagcaactccttcctctcccttccttcctgcagcgagagcaggacgagaagacaagtgcagtgaaggaagagctaaaatactggcagaagctccggcacgacttggagcgggcgcggctgctgattgagctgattcggaaaagagagaagctcaagagggaacaggtgaggaagatcccccagcctcagggcttttgttcaagatctttttctcctactgtcagtgtggcatggagaaagccaggagatctgcctggtgtctgcttcctccccttcctgctcatcactgtgggctccaagacctgctagtctgtactgggtatggtgctgcacatggcttctaactgcggattcagcttctggtggcctcatgcggaggctcattatcatctgcctgggccccatccctggaatttatgactcaaaatctcagagggaatctggtgttaagtattttgaaaagtttctcaggccattctgatggtcatcactgctgggagcttctgagagcgttttcacttggcccttaaaatacttacggtcttaatcatttaaattttccaagctctagccaaggagggtctaagcatctaagtctgaggaatgttgaggaaggtagtgtaatgcaggggttaggaatatgagctgtggcactggattacctgggtttaaatcctggttctgtcatttagtgctcatgtaatattgggtaagttgcttaatctctttatgcccatttccttgattataaaatgagggtaacaatagaacctacatcatgggatccctgggtggcgcagtggtttagcgcctgcctttggcccagggcgggatcctggagacccgggatcgaatcccacgtcgggctcccggtgcatggagcctgcttctccctctgcctatgtctctgcctctctctttctctctgtgactatcataaataaataaaaattaaaaaaaaaaaaaaaagaacctacatcataagcttgtgaagaagagatgacttagtatatataaagggcttagagccgtgcctggcatgtagtaggggctatagaagtgtcaactgctgtcatgatcattattgatagtttttgcttccctgaagcgtccactggcacagtctgcacatcacagagagtaagtgctattaattgaatgaatggcaagccaaaactgttatctccagtctaggaataacaactattacttgcatgcttcagaggcctggattaaagacgttccttcttctctttctccaaaccctacttcaccattgagctccagcatgagcctgtaacctcagtttccaccaccgagactaggcagctcttgccatacctagcatgtctgggtggcatggagggcatctcaggatcttctccatggatttaaattgtgttcaccatcctaggcctggtctgacagctgagtttttcttcttccctctggttcagataaattaaaaggaaaaggaagcaggtgggcctgttttaatgtcaccaagaggaaggaacatttcatagccttttcacattagggcatacatagaaaatcacacttacgttggctgaggaggtgagcctagaggccctagttatcccaggccaacccagatgccccaagggccagtgggatcaatattagcttactaagtgggaattctggcccaggtcacattttatatcatcagtgtgctctttgaactaagtcagtcctgggttcaaatcctatcttgttgggttagtgacttcctcatactctctccaaacctcagattccatatttgtaaaatggggatagtagccatttgtccctcaggattattgtgatgattaaccggagtaatgcaagtagagaaggcagtatggcttagtagtgaagagcacacactgtggaatcagactgtctgggattgagtccctactctgtccattattggcagtgtggccttgggtcagtcaattacttagtctcgctgtgctttggttgcctctttataaaataactcatctgtacccacctcatatacttacattgaataaaatgtttagagtgttacttggcatttgggagggactgtggacatgttaaatattttttaagttttggtatggtgcttgatacatagggaacatttatagagtggttgatagctgttggtcattatttctagctgagggttgggtgatcactcctcatgtactggttagcttaatatcctgtgaaaatgtgtggtatgtgattggtgaaagtcaggttatgaagaacaagtttggtgcctctttgcaggggcgtcctgatctctttctaccttttgcacaggtcaagatccagcaggctgccatggagctggagctgatgccattcaatgttctgctgaggaccacactggacttgctgcaggagaaggatccggcacacatctttgctgaacctgtcaacctgagtgaggcaagttccctcaccacttcctgagcagtgagcccctcttgaactggaaacagggtctgagtaggccaggaagggggttgggccacagggtggacaaaacctgggggtttctggcacagctaatagacttgcccatagtgagggatcagcaggccagggggtgggccagggtcctggggctctgactgagccagcgtgccaaaccagaaaacggggaggcaagagtgctggtgaagggtgcacctgtttggctagtaaatggttgttgtaattgtacaggttttatatgtttaggttccagattacttggaattcatatccaagccaatggatttttctactatgaggcggaagctggagtctcatctataccgcaccttggaggagtttgaggaggactttaaccttatagttaccaactgcatgaagtataatgctaaagacacaattttccaccgagcagctgtccgtctgcgggacctgggaggggccatcttgcggcatgcccggcggcaggcagagaacatcggctatgaccccgagaggggcacccacttgcctgagtcacccaaattggaggacttttaccgcttctcctgggaagacggtgagaagcctggatgggtggggagaagaaggactaggaggaggcacagggatggagcctagagagccagggactggggtgggccttggagctatatagggtagacacaaggaagagagctgagggtaggcacaaactgggatatacctgcttgtggctgcattaattccaagagttagagtttaatttgctgagtgtttctggaatggtaggaaagagaattaggtactagctgtctatttgaaaagctcaatctttagcaggggtcttcctcctctggataccctctgtatggcatggagcatggggcagagagagtgcaatactagtctatatgtggctctttcagaagagtgtaagtagaggatcaggaaaacagaattgtctctgagacccacactctggctgcctcgtgcctactccacagagcctgtaattatgactgtgaactgcttcctgcagatgtttcccagattctgaccttgtccctgtggctgccctctgggcagtggtgtcaccagggccaaggccccatagtgacgctgctggaagccactggcccaggtgttccaggagaatattttgcatccgaagaatccagtcccttccccttgccctgggctgggcaggtccttcagccccttctgtcctcccttctccctggcagtggacaacatcctcatcccagagaaccgggcccatttgtccccggaggtgcagctgaaggagctgctggagaaattggacctggtgagtgccatgcggtccagtggggcccggacccgccgcgtccgcctactgcgcagagagatcaatgcacttcggcagaagctggcacagccaccaccaccaccacagccaccatcactgaacaagactgtgtccaatggggagctgccagccgaggcccagggggatgtgactgtgttggagcaagccccacaggaggagccagaagacgatggggacagaggtgagagacaggagcagtcagggttagaggccaaggtaggggagtaagggttaagccaaaatctcatagtagaagcatctttccctgagtttcggtcttacctttgtgggtaagtgaaaacccttggaggggtcacatttccatatatatccagggatgatattcaagatacttataatcagaagagaccaaaattcagcagagtagatattggctgttgtattggagtgtgcttctggggaccattgttgtggatacttagttgctaaattgtggacaggtttggagaattttagagcctggggcccagcaggtctttactaaccaataaagaagcatcacagtattttgtacctgatatggttgtattgcacacactagttaaatattagctcaccttagaccatcacgtaagtaggcccttagggcagattaggttgtggggtgagaggatagaaaaggaagatctacctcatggctttgactccagctgacccagtctacaggcccatcccaagcagaaaggccagattgcaaaagacatccagagaggattctcagagacctaaccttaaaactgagctgttttccatccttccccttcattgaggacagaactgcattactcatacaggtccttggagctgagcctatagcttatggatggtctgccacccacacagcctaaaagggttcagagttacctccagagagtaaggggccaaattgcaagaaatggcccattttattttacattgagaataaggatatggttgggaggtcccatttggcagtcattgtttctgactccctgtgtggcagtcagcttgtctgtcatttgtatcccactcctgggctgtggcgatgcagagtcctgtccactggctgcaacagcttctcccatagggtttcaaaacaaaattcccaggccccagctcccaaagattcagataaagtaagtctgggctgtggcttggaaattttaatttttaaacatttcacttggcaagtgaacagacatgtttgggaaccagtgatttaactctcatctttccaattgtaaacttactctttttgcttgtcctgcttgcttgctttactgggtgataaacaaaatattattgatagaaggaaaaacacttgagtcgagtgagagttgtatatttctaatctgtaaatgtgaacttgcctgagtattgattaagtcaggtggcttttcttaggtgtggtgcaatgatttgtgactgtttcatcagactcacctggtaaagccttttaaaaaaataccccatcattagagatttagtttcaattggtctgggacaggaccttgacactgaaatttttaagaaacttcctaggtgattctaatacatacagtttatagttaactaatgtagataagacttaatcttgcattctctttgtctcagacaggagacctgggatatgtgtcaaaatttataaaagccccaagcctctggttcgtggttatcagtgtcattacctggcttgtaggtacagactttttctaaaatgttcaagcaggttctctttttctctaacagacgattccaaactgcctcccccaccaaccctggagcccactgggcctgcaccttccctgtctgagcaagactctcctccagaccctcctactctgaaacccattaatgatagcaaacctccaagccgattcctaaagcccagaaaggtggaagaggatgagctcttggaaaaatcacctctgcagattgggagtgagcccttgcaacgcctgctcagtgacaatggcatcaacagagtgtctctcatggcccctgatgtccctgctggtaccccactcagtggcgtgggccgccgcacgtcagtcctcttcaagaaggccaagaatggggttaagctacagaggagcccagatagggccctagagaatggtgaggaccatggtgcagtgggctctcctgcctctccggccagcatcgaggatgagcaacactcccggaagcggccaagaagcaggagctgtagtgagagcgaaggggagaggtccccccggcaggaggaggagacaggtgaccatacctgtgacttctctatttctcatctactttcctgctttgccttgccagccaacacctcccctagttggttgcctccctaatggtccctgtggacaccaatagaagcattgggggctctgtagcttagagttgggcctggcacatgggtactggcctggaagaaaaggctttgagaaagtaattccaaaggaccagattttgtctggggccctctttggccctgaggggaatgcaaagttatgtgccataaagtgattccgaccttcacttcattcattcatcagatacttctatcaggcattattgtaggcacttggggggaaaaaatcaatgaacaaaaggcaaaaatctcccttgtaggggagaaagactggaagcaaataagtggattgtatcttgtattagaagctatacagaaagatctagcagggaaggggaatagaggatactggggtggtattagagagggtggccaggacaggcctgaggaggagacatttgagtaaaaatctgaggagttaagatgtgagctattaggatatctgggggaagaacacttcaaaaagataggctagaaagtgcacaggccacggaggtagaaacacacttacatgcctggggaccagtgaggaaaccagtgtggctgcagcacagttagccagggtatggttggaagtggggttccagaggcaggtaatgggagctccatcactaaagagtacttactacatgtccagcgcaagctggtcatggtgggtcagattgagccccagctctgagagagttcacaacccaggcaggagaccacatggtgtcctaaggtgcagcgatgttagagtgccaggccgcacgtgattatgtaacaacactgctggaggcgttcagagactaggagttggaggagttgggaaggcgccacgaggaggcggtgcctgagctggttctgtgggatgagggcagaatagcgaggagtcgatggagccaagggctcatgcctgggtgcatggaaacaaggatggagtgcctgcaagggacagtttggaggggggcttcctggagcaccgggaaccaaggctggatgggtgagctgggcctggaggtgcagacatatagcttagtcttagtgggataagggagggcagcttacttggtgggaggggcctgctcttggctcttgttttttgtgttgctttcttgtccttttatgtggtagctttgggttgtgtggccagcacattgcttttttgtcttcctgcttaacacatggtttccagcaataccttcccttcccatctggcccaagcctccccgtattaaggcagtagattagtatatagaatcgagagtctgaggcctggagttaggcagaccagggttcacatctcatcttctgaccagctatgtatgctgggacagattaattaacctttcaagcttgtttctcatttccagtagggggctagtgatacccccttgtgggactcacttagcacgcagcagctgatggtagcagttactgttgtcctgtctgctctgtgaggagcagccacacagcactgagagcgctgtgcactaaaattgaaaaatcctgctattgggaagtaggtctggatgtcaggctcatccaacctgagagggtcctctgtttggggaatctgctagaatctattcatctcctactatcccagaggcctggcatcgaggactatttccgtatgactttagtggagtcttacaaaaacaggtgttgatctttggcaggcatgcagctgaggcgcagctggcttgtgatttaaacagaagccgtaacgttagaagcagagccaggctggagtccagatatcttggctcaggcacctgctcttacaggtgtaacttgcttcacagtgttctggccaagctatctgtgactgagagctcttgagctcttggctcagctgcctgacttgtgggatgctggattgtgattaagaatcggataatagggagttgaagcctctgcagctaatgagcatcatgtccctgggatgaccagacagccttcatttgcctccaaaggggcccattctataaacagaccttctctgattcatacttaatactgtctcctataagtaagaaggtactgtcttcacaaaaggagaggcaaaggttaaaaaggaaaagggacctatatttcagagcctagtctagaacccaggaattttgattctccatccaggaaggtcaggtctgctttagatctattgaagtcctcccatcctcagctctgcctagctctgctagatatctctgggtgtggctgacacagccgttaccctgcctcaacctcccttgacaccatcccaaaagaatgaagctagctgttgccagctgtgtgatggatagggtgtgtgagtgtttatctgaagaggcaaggtgggtgggctccccaagagacgggctccctgataattcaggcttgaaattagaagcagatctcagggacttaggagccagctggagtggggaagtcttggtatttccttttgtagccaaatgacagtgactggtgtgagctgtgtgctgtgttttctttccttaaagtgaaaagcagaggggtgggaaggaaaatgcagtgtctactcattgccctagccaacatttcccccaaatctttgtcaggttctttccgtcccccaagacccatttcccacatgagaaggagcagccaccctttccagtcctcctcactcagccctcctgaggcagctgcctcacactacagcgtgtgtcagggggaaggaggtttcggcactgaggcttactctgtgtgtccttggcaggcgtgaccaacggctttggaaaacacaccgaaagcgggtctgactcagaatgtagtttgggtctcagtggtggactggcatttgaagcttgcaggtaagagcagttgttctcaaagcttggttggcagctccgccacctctccctttattctccattcagctacagatggagcctcctcctgcttatctaagtttctttcttcccccaccctggctatttcctgagacctctggtctgtaactctggtagctcctaggaaatggtgtgacccttgactctcaagcctgatctgactaggaggggaggagtggcgctgatgctttacagggtttgtggagctgaatttggctccagacagcagggacagccaaatttcaattgcccagcaaagttaacatttgagccaatcccccacccaccctgctgggctgctctgataacccagttacagacatggttttgccctttgccttttggtgcatcataaccaagccttctttagaggtgtggtgtgcaaataagaattgaacagataggaagtttggagtagcctgttattcaaaggtcctaactcttttaccctccttgagttgggaaaggatagttttcttttcccattcttttattggaagagaggatttttgagaccagaacattagagtttcttccaagtccaagagtttatgcaatctctactctgtgttatgagtactctgcaagacaccaggaagtgtggaactcttggagatgggagatcctcagtgccacagaggagaaacaagttgtcctgaaggctaactcatgattcccaacatgataatgaatcctgggttctgagtagaggaagaagggtcccagggcagcaccaaaagactctatgtttaaagtgtttccaaggcaggttggcaggttgagcgtgtgttttgttaagtactcactctaccctggctactgggctcaggggaagctttggggggggcgggggcagtgtgggaggacccctgctgtggcatatggttcctttgagattttcctctaccaagcctcaggatcaccctagctttcttcctccatggcctctagagacatagaggcagtgggtagggaagaaacagttattagtcatagaggaggcagagctttcagaatcttacaagatgctttcaccctggtcctgggttggaattcctaactcccttcagatataatggtggctggaaacgcagttcattgggttggggtaggagtaggattatcagactgtcccctcctagctcttgactaaagatggaaggtatgttgggcccttcgctccatgaagagctcttgtacagccatgaattcacaggaaggaagccagaccagcttctgattagcctgctggtcaggccatgtgtttgcattcgtgcagaattccaccaatttctgtgcagccctgttcagtgtgggaacaatgcccttggaaagcatttcctctttaactcagtggatctcaatggaatttcagggtttaaaacaagaggttcaggactccaactagaggatttttctttttctttcttttctcccccccccccccaccctgcacactatggtagtgcctatatagagaaagattttacttaataattaaactggaatcatataattccagagatagaaagaatcttgaaaaaacctgtggtcattaatcccatccccctcccctgtcctggccttatctttcctgaggattttctgagcagactggggctgtgccctctttttatgggtcacttattcagttattaataattgagcacctatttcaagccaggcattgttctaagtactgataaggtgtgtgttctcatggagcttgtcttctagaaggaagagatgaatgttaaaccagtaaacaaaataattatagattggattggctgcttaggtctgcatgacttagaaagagggctgaaatgcaggtcatgttgagtcacttgtgattttccatgaaacaggaatacacggacctagttgaagtgttacgtcttattttattgagctcatccttgtcagagctcatcatctgatagtacaacactagtagtttatggtatttaaagtgacacattaaaatttactgcccttcatataataatatttgttatataactaccatgtgccatttattgagtactgggtatatgctgtactgagtgctttctgtgtattaatccactaaatcctcacagcagcacatggggaacaccggcctcagagagggtaggtcacttgctcaaggttgcagaactcatgaagtgaagaggcaggttctgaacccatgtagtctggctccagagtttctctcttaaccactttgttgtgcccccttttattgtatttgaagatgtctccccagatccaagataggaactttgagaggcctttgagtctctaaacccagtgacagattattatagggtgagtgggaactgaatctgaaatgtaaactggatgttaattttttttctcaaacaggtcctaatttttactagcaggaaaaaagctaccaacctgccagttactgatggattaggattcattgggttctggttatataaggttttctgaataagactgtaataaagtcagctatgatttggtaggacaggagtatgctactcaccaaacagtcctcaccagccttttttgatcccaccaggggtttcccaagcaggggtttcccaagtgtttctattcttctgtggattgttgccccatcttttaagcactttttttagttgaaaaaaattagatagcagtgatagttttcaaagtttggatgggaaaaagccctagccacatcattcttgcccagactctcacaactatggatgtatgttagaattccattgagaggtatttaaaaatgcagatgcttggatgggttccagttatggcattattctggtattactgttctcatttttgctttattaccttctagtctgcctaaaatatatatatattatataacatgtataatatgtatatattaaacatacatacatacctctttgcagtaaccacatggaaaaaaattggtctgcttgtttgttaaaaaattccatctctgtctaagaaaaacttcacacacaaagtgtaagtaagaagtggatttttttttcaattaaaaaatgtcttttctaattacaaaagtaagatatgtcctttataggaaatttaggaaagaggctattttttttttttttaacctcaaaaataaattggtttctaaagaaacagtatgaactgcagagtaaaagaattctggacagatgtaagactggccctcctcctgactaggctgcttagactccagaaggattgacaagtgcctagagtgacctttctctgggtgaagtccaaagtccctgggtagggaagcaggcatctttttctagagtccttccacaaggatgaaatggtccttcaaagcctcatggaacttttatggtcagaagcataacatggattggtgtgagttgtttaggggaaggtgagaagccattttcattgaaaggtttttacacctccacttctctcagagatagaatagcagtgggtgcgttagtcaatgaaattgctcatttcgctccctatgccttcttgctctgtatgcagtggtctgacgccccccaaacgcagccgtgggaagccagccctatctcgcgtccccttcctggaaggtgtaaatggagattctgactacagcagctcaggtgaggagcggtatacaggtggatctagggggcccaggccttccaaagaaccagctctgtgggctgcagccagacccgatagctcctctaagctctaaggcattgggcacagagatggcacccccctctcccaggtcattcatatgcttcttttttttttttttttttttttttttttttttttttaggttcatcttaaatttgaatagtaatatatgcccatggtaacaaaaatcaaaaaggtacagaatggtacataatgaaaagccaggggtctcctccttagaacaaccactgttagcagtttcttttgtgtctctctagatgtagtttatacatatataagccaaaacttgtgcatatattcaggagagtgggtagagaagcctaatatacacgtgttcctctaaatcatgccttttttcaattaatatgtcttggaaatcgtctatgcttttttttggctgcctgatatcccattatctaggagtgccagctctctgcagatagacatttagactgttttcacatattagttataatcagtgttgcagtgagcaaccttatacatagatcattttgtatctctggagagcatagacttcctttttttttttttttttttagattatatttatttattcatgagagacagagagagaggcagagacataggcagagggagaagcagactccacgcagggagcctgatgtgggactcgatcctaggtctccaggaccaggccctgggctgaaggcggcgctaaaccacggggccacccgggctgcccaagcatacacttctatagagaagtagagttgctgtacttgaaagaagtgtgtctttgtagtttctagagacactaccagtctgccttcactggagtggttagcgagagcctggatcactgaatcacacattgccctgtgatttcatgtgatccattgctttctgccttgtcttcaggagacattctactccagctggtccaagaacgagggattcaagaacaggacaaggcagcgccaaaggggtagggctgactggtgctcaggtggagtgggtacaaggcaggctgttctccaagggcacctctgtgcagccctcctgtggagagtgtgtgctctgggtgccctgtctttgaagtttccatctaacacacaggtgtcagggcttctttccttttcccaaccactttactttcctttatcagtttctttctcatatgtgtgttgaggaatgcatgcctgcgtgtttcactgttgtttgtcagtgcccagaaagcagggctcatatctagataaattggaacagcatccagtgcaaaactggcagtggattggcacatacagtgtgattctggtagtgacattttatccttatttttaaaaccacgttcttgtaaaatgatgtcaaaggaaatttaaaaattttgaccctctactcccatcatcaccttaattaacacagttgtcttcatttctctgtgtggccttccgtttatttcaggcacatttttaacaaaatgttaatccagaacatttaattttctgcatttttcagtgttatctcatactttttcatgttgacatgatctttatttatctcatattatggaacaatttattcttcagttagtgtattataatttacttaacccttttgttagacatttggttatttctgacttttcacactatgcataatgtagtaaatgtgtatttttgttcaaaatccttttattcatttttaaagttatttttcttagaataaattcccatggaaggaatgtactgaagcagatgattcatatatttttttaatggctcttgagacataccaccaaattatatatatttttaagatttatttgtttattttgagagaaagtgagaggaagtgagaacctgcaggcagggggagagggagagagagcatctcaagtgaactccctgctcaacatggagcctatgcagggctcaatctcatgatcctgaaatcatgaccagagcagaaatcaagagtcaggtgcttaactgactgaaccacccacacacccctgccaaattacattcttaaggattagactggtctacactttcttcaatagtatatgattgcaccagtttccccacagcctgtgtattggattttatctttttgttgttattggtattgactcgcataaaaaaacaatggttcagttggtttagcatcagccttcagctcagatctagcatctgcttaggcccaggtcatgatcctgggatcctgggatggagccctgcatcaggctccctgctcagtgggaagtctgcttctccctctctctctgccccttcccccctgctcatgtgcacacgtgtgtgctctctctctaataaataaataaaatctttttaaaaaatacctcattattagtagtatatttttaaaaaattatgagggtggtagtatttccttgggaacataatttccactctttgggatttgggcttttttccttggtcaagtgtggtccccttgagttcccagtttatagatgtggggaggagaagagaggaggttcctctttctgttcaggagtatttgtgaagtgtgtccatccatgtgtgctagtgcctcaggtgcagaaaagagtaagctggagagatgtggtgctgctccaggtgggacacccagtgtaaggttctgagaaaagcatgcacatgaaggacctgcagacctgcttggctctgctgagtgctgtgtatccaggtgacctggatggtgaggcgtggccctgtcagaaaagaactcatttagcaagtggttttactggaatgtctgtcgcagggatctttttccgtgaagcctctatcatgaggcctatcatttagggagccccagagagcagtttgtggctttgccaagctgggtggttatttttcttcctagggtcctggtgatggagcagtcacatttttccaaggaataccatcttagggttctagtccagaggtcagcaaactaacatattgcccgtttttgtagggcctacagactaagaatggttttacattttcaaatgattgaaaaaaaaaaacaaaagaagaaagatattttgtgacacatgaaaattacatgaaattcaaatttcagtgactaaaaataaaattttatggggacatagctagccatactcattcctttgcagaatatctgtggctgttttcatgctacaacaatagagttgagtagtttgcaacagagaccatgtggactgtaaaacctaaaatgcttaccgtttggccctttacagaacaagtttgctgacccctgatctagtctaagaactaaggaaagggcagggaagagcaagggcggaggggatgttgctgacttattcctgggttgctccagtcaaatggaggccacaggcaggcctcctgggcaccattccaagtcccctttgggtgctgtctcctcccctcctgacccccaggcagaagcctcctgatgccctttgaagaccgcggagacctggagcccctggagctggtgtgggccaagtgccgaggctatccctcctaccctgccttggtgagtctgccccagacaccaccccccttccttctctgggctgttctcaccccgtcttgccttgggggcttatctgattggatcaagccagcagagtgtggtgggagagtgcctttagctgcagaagagagggaggttttaccccagcctgggtgggtcaaaccatcaaggtccccagcttggagcactcaaaatagagtaaaagtatgaagctagagactagggcttgtaggaatttaatagcatttgtttgtgcataaaagtaatacatgttcattgtaaagaatttatttaaacatttgtcatgctaaattcttgaaatactgagatatggtttttctcattttgtggggaagaaaattgaggagctatctgttgcatgtggtcatctagctattaaatggcagggttggaatttgagcccaagaatcacaatgtgattttcaaagcctgtgttctgagccactaagttcaaaatcacccatagtctcgtctattcggagattacctcttggtatatatctgtttaacttttttttttttcagtgagtaaatatgagaccatactctaacctccctttcatataacagcgttccatgaacacgcatgtcttgtgtcattaaacgttctttatcaacatcactttaacgactgcattatcctcagttgtatgcatgtgtcttttttaactgttccttagttgggtcatttagattgttttgaatttttcactatgataaacagctggcaataaacatcactgtagttttactctgtgcacatcatgattattcctgtatagtgaattcttagggtgccttcttgggacaaggtgtctgcaaaattctgatacaaattgccaagctacccttttagaaaattacttccagttcctactcccaccagtaggagctaaaatttctattttttccaatgtagcagtagctgaaaattccatttttaccaccttgattgctatttcttagaactctctctgcatcggggaggtaatgtccaccgggcactagaagacagtgattctaaacctttgggcatgccagaatcttgggggaattttttaaacaatatagatactgaggtcctatctcagaacaacccaattagactaaggccagactgagctatgaatattttttaaaattttaatttaatttttttgtgtgagagtgtgtgtgtgcacgagagctcaagaggggaaggggcagagggaaaaggagatagagaatcttagacatgcttcacactcagcacaagagcctgacacagggctcagtcccaccaccccaagatcatgacctgaactgaaatcaagagttggatgcttaaccagctgagccacccctaaaaaataagaatatattttttaaagctttacagatgatctatagccagggttgtccactatcctgccaaccacttgcatgcatacaacattctgggcttctctcagctcttttttttttttttttaagagtttatttatttattcattcatgagagagacacagagagagagagaggcacagacaggcagagggagaagcaggctccatgcagggagcctgacacccgacttgatcctgggtctccagaatcagaccctgggccaaaggcagcgctaaaccactgagccaccagggctgcctggctttttcagttctaataacagcctcttaaggacaagagggcaggaactctgaccctttgggattagtgaggaagctacagctctaagaggtcatacagcttgctggggccatactggaagccatgtcacctacctcactccccctttagcagtggcatgtgggggaatccacgctgtgctgctaaggaggttgggcctggggtctgccttcacaaggctctatgcccttttgtcagtgagacagccagtaattgtcaaggaagtgtttaaagctgtacaggtttggtactgtttttttaagtctcacagtgcaaaacaaaactggtctaaaaccagcttttttttccattttaattatctttttaatcatacattttctttcatgattaaataaattcagccaccacctgagaaaacccactgcctgaacataacctgtgttttcattttggtttacactcgcccaattgttctcctatgcatacttaaatatgtacttgtatccataataaatatacagtttaaatttttttttgactctcattttttaaaaaagggtttttgttttttttttctctaaaataatgtatctatattatcgaaattttggaaaaatagagaaaagcagcagggaccctaccattctagcatgtcagctgtgagcattttgcgtcacttgtatttgtttatgtagtgcagccataataattgtgtatacacacatttatcacataatgcgttaaagtgtatcataagccatgctgttttacatctgaataacatttgagtgaatggtccattgtttattattttgggacatatttgcctgtattttctttaaaaggagaggcaaactctccttaaggggcagcttacccactttgctcctgccttggggggacatatttcaccatctatccccttgttccaaggcgggagccagcatggcttagtcaagaggaaacataccagagaggcccactgtctcgttcaattgaggaagttcaggagggcttgtgtggtggttctcgttaggaattttagttagctttaatcccggtggggacagacaggctgggagatagagttttgaccaaattacacagctgggggctgggttggcatggttcttccttagagtaaactcttaaccagaacacctgctttcagctgcttatcttgcgagggaagtagggaagctggcagacacccaaaggtaaatagctagggcagtttattatgagaacaggccccctgggaccgggtatagaaattaagattgttgcatctctggagaaagccacttcctcagtaagtttccaggcctctccagcctcagcacatagagagtattcactgctttgaaacaggggctgtgcagggcagcaggcagcagaggctcaggtcaccgtggccacagcccactctgtcctcctctgtctgggcttggtgctttcctccctcagcaggtagctgtcagcagacttctcggcatcagcaagaagatgaaattttaaaaattaaaaattaaaaaaaaaagatgaaataaaatgatgatatgtgaataactaggggctttggtcactttgtcagtgtttcatagagctagagataactgttgtgttgatgccactgggcgttttgctgagctcctgttctgtggagcttgccgcctcgagcacaaattcttccagtggcccttctttctggccacatcattctcccttctccagcaactcctcaagttcagtcttaccgcttcattctgatcttacatggaagtgacacaaaggtatctcatgcacacaggaggacagttatagtcagataggaaggtagcaggtactcagggctctgttaggtagaaccaaagggatgggttcttctgctgatccagaacctccttcatggccatggtgtctaaggaggcaccagagtttttgaagtgaattataacgattttaaatggcaattgataagggaaaaaatggcttccactccccctaaaggatgttgggaagaaggaatttgccagtttggcctggacatcacagataccccctcatttctgacactcccatactggattcacattgcttctgtttcagctctgggcccccaagggttcatggagtaagctccctcatcagaactggttgggcagggctggaggattaggcaaatgaactgggaaagagagtcaggacttgcatttgggggtcctggaggttcacagaagaggtcatctccctttatcacctggctgtgggcctggccaaggtgctgcatagcttggtaaggggtggttcagcagggagtcctggcgcagcatgctctgctcaccccatccacccgcagctgagtgccttctcctttcctgtctccagatcatcgatcccaagatgccccgggagggcctcctgcacaatggtgtccccatccctgtccccccgctggatgtgctgaagctgggagagcagaaacaggccgaggctggagagaagctcttccttgtcctcttctttgacaacaagcgcacctggtaagtgactgctacttgcaggaggttgcaccagggtgtggactgaggggcccgactgggaggctttgcaaatactgccatgctggggaagtccacagaggggctgtagactccgttaccctgcctccactcaggtagggtgaggcattaccagcagttggcctgcccctcacacgttaatagtaactgaggagagtctcagatcagattccctgagaaacaccgtgagatggaaatttctataatgagacttacagaggagacctgtggggatgagggttgcagtgctagacaggggaacatgttgaactgtggcacgcttgctatgaaggcctccactgatcctcaggggagccctggagctggggttttgttaatgataccaggaattgggcctgcacctttgtaccttcgtgtcaactaatcattgaatgctggctgcccctggagatggaggtcaccttgggtcatgtagctcccttgttggagggtgattcctggagaggaagagagccagctgagagctccccgtggccgtgggcatgtgtgtcttagtcctggagtgggcggatattgagtgggttggttctgggcagtgtgggctccatggcaaagggcttgcttgcccttcaaggtttctcttggcaccagaagacttctttcacctctgcttctatagaatgagaaaatgtaggactagctaacccagataacagtagctaccatttattgttcactccatgcccctgtgcaaatttatttacatacataatctcatttaatccttaaatcttcaccagtcccctcccaatccatttttcagatgagaaagctgaggcttggaaagccaagaccccattgccagaactgggatacgaaccaagatctggctccgaaggctggcttttagccagatgttagactcacctggggatctttaaaaaaaaaaaaaaaaaaaaaaatgaggtgtgggcaccaccaaggaatcattgattcctggtattggccccagttcctagccagagctccctgatgccccaaggtggggtggagctaaccgtaacatggacctctcggctctgggtcatgacagccctcagagttgagtgccatgggttcagggaagggcctggctgcaaacaggtcttttggtggcctcctgcctgggttggcccagtccatctccttctgctctatcccctccactggctttgctagtcttgggcatatgggcccagaggagcccccttgtgtgacccactgcagcccaggcctctcactgtgcttgtattttaggcagtggcttccaagggataaagtgctgcccctgggtgtggaagacaccgtggacaagctcaagatgctagaaggccgcaagaccagcatccgaaagtcggtgcaggtggcttacgaccgtgcaatgatccacttgagccgggtccgggggccccactcctttgtcacctccagctacctgtaagggcagggcctgcctgtgtctgcctgccctgcctctgtcccctgaggcacagaggcctcttcctgccccagccagtcatatggccggcagtttcccctttccacagcaggccagggactggtctgtgtcctccccaagggcaaggccccagttttgaacaactgtgtggttcccctggtgggcctgctgtgtgccaaaaactcccacctgagcttgctcaggggctagtccactaaagaatcagttagaagtagaaatagctgtgaggcttaggcctggccaaggagatgcacctgaacccagaaggcaagaagtcctaggctctttctcaaaggtgtgcctggccccctcctccccactccagctaactacacctcagggcaagtgacgctctgaaattgaccccagaggtgctgtggatacacgagggtcccgcggggaagctcacagagctcaccctctctcccctccatcacccattctcatacctcttccccatcccatctttgcaccagtgctgtttctttttccccatgttcctttcctttcttttgtgccaaatggacagaaactatcaccaaactggtcttttttctttttatgtctcattccctttgaggccagctgctatgctaggtgggtgcctctgcctggctcctcagggcccaggacagaggacagcctaccactcgggtgacccctccaccagcatgccctcccccccccccctcatttgctgcagacacacagctaaggccaggctgtggaagcttgcccccttgaattgaggcaggccccttttgccctctccctgtgtgccgagagacgggctgaggcttggcaggctcctgtcagaccaggctggttgggtgagtgttcatctgtccacttgggtgcggagggctgtggggtgcagctgtgctcttcagccggtctgatccttgccctcctgtcctgtctctgggggcttcactctccgccaccacggatggtggtgcccacagcccagcatctccctgcctgtgctctgccctgcccagcctctgctgctcccactcccgaactccaggggacaccacgcttttatttcacaccctctctccccttccctctcctcctttcaatctccctcctcaccttcaccttctcaaaaacggaagggaaaaaaaaccaaactgtgaaacggggaatgctgactgacaaacacaactttcagaggcttcagtgtctgttctctggatgattcttctcacctcttaagcaccaaagtcgcagggccaggtcgcaggccactgatcgccatgttgatttttaacctgatgttctttttaattgttttaaatttttcataggggagttttggacaaaacagtcactggggagatcactgccatttttacacactcgactttttaaaaatacaaccaaccaaccaaccaccacaacttcttaatatgtttgggacatgagccagagtttaaaagggaaccaacaaaactctcttgttacctaaaggatggggttttggattttgtacaataataaaaatacaatacagcatatggctagggaaggacatggtgtatatataattgtaaaatactgttctaaattattcaggcctatagtttccattcctggagtcctccattgtgtggctgagtattttaaatgcacacagtgtggtttatttaaaggagtcaatgcgtccccccttctccccaggtagtcggtcagctgtggactctgtgacctttgtctcaacctgtgttgtaagatctcggggctttctctctctctctctctctctccccccccccccccgtgtctctccccgcccaacactttctctttcttagtctctttttttttttttttttccaatctccttgactcttaaagtctctctctgagtctcattttaaaactgctcttttagaacgggaagcggctcagatcctgctgtggcatggggcctatgtgtctcagtcgcgtctgctgtgaagcacacgatgctctatttattgtagaaagtgactttatttgctttctagaattgtttataacagatggtataagagaggtaataaacagagaaaaatctatgcttgtaaagaatacaaaagttaattttacctactataatatgactgtctgaaacttattttctctctgagaaataaatgttctaatgggcagcaattgccgtgctgtgttggtgtcctcagtgggggcttgcccctctcttcctaatccccgtagcccaccccctccccagaaggcaggagccattaagaatggggttgtctagctgttgcaggctcccagcaggaaagggctctgtctgtctcttggaatccccaggaggtgtgtgaagatgggctctggcattgtttccctcccaaacagcactgccctctcagttctgtagaatgtccaacccgccttcccatgcctcagctttctggtggccctgtccctttgggagcatctgttcctcatggggtgggagaagtagccctatgtctctggcacctgtttattcgagaatgctcatgtctcctctgtcattgttgccatccccattctatagatagatagctgggacacataggcgtaacatgggcctctctcctttcagagctggaagggatcctagcgcctacctggtcttcattttacagatgacaaaacagcaagattaaaagacttgtccaaagacagccagccaagtaatgacagcagaatcctgggagagagatctggccaagcgtttcctagtgggctccacaacatctcaaggtcatactggccttttctgtaccagcccccctacccattgcctgtggctccagcctttctggaaaggaacattttcaagagcagagtgagcgttcccggggactaagtgccctgttgctgggctggggacagctttttccccatcgcctcccctgttctctttctgctcccgcttggctcctgtacgtggctgggagttatgtgtcacagcagtgtgactaggggaccagggactcctgatcacctcctccacggggccctcgaaattcttagtgaagtcactagagtgtaaaagtgcttaatttgatagaacattgacagtacctctggggcactgattattctggaattacgcattgggagcacagagatacacgcccctggtccacaggatgcaggtgcacaagctgcttaccaccaggttcacgagacatgtcgcgcatagctccacgtgaggccggcgtgaggctcccacggtggggaggagtttggcagagaccacgtttggatagcaaaagctttcagaagaatgaaggaattaattcaagcctgaaaaaatgggcttaaagatccctgttgatacatgtatattttgaattacaaggccaatatttacagcaaaatgagacatgaccctataaaaccattttgtacctaaaggaaaaatgatcagaggggtggggtattattagcaggtgaggatgagaagaaaagatgtggtaaagagaaggttcagggaggtttggcgggtgctccactccagtaactaactgccgccccatctgcctggtggccactgaagatggcaagagggtgtgttgtggttcagagccctgtcactcactgactgcgtgacttcaagtgtggtactcgacttctctgagcctctgtgaggctgacttaaataagagaggaccctgaagccagggcgaggcattagtgcagcattggaggattagaacaagggaagggacaggactggaacgcagcaactgattagctgtccgagtcaaaaagcaggaagttcggagacagggccgctacatggctggaggcatcaatagtgggtttgaaggggcgggaggggggaggagaacctagttctgaggagtttgcattgcccacgggacatctgagaaacaccctcagcaagcagattggactgggcctggagttcaagaggaaggtaggatcacatgaaagaaatgcgggggcactggagcccacccaggcagttaggacagtggccgaccgggaaagagggcctcatgaggaggaagtcaagtcctaagggtcacctaagggtcatttcacagaaagaggcaggtcacatgtgctcagcttcacggagcaggaaagggtagtgctgaaccagagaggacccagaacccagcacttgccactctccatgggcctctgtagtcagagctctccaggtgagatgtatccttaatcaattctgtcaacactgtgatcgaaattcatggaccgatgtctaaaatactatgatactggagcatgcgagggtaggtactgactagaaatacaaaatataattttcctaataagttttaaaatataactaaagccatttgccaaaccctgtcaacgtggcctcttccgttaatgtattaattgtcattaacacttgagtgtgaatttgccttccagatggactccctgaccaggcaaggctgtgagctttggctctgagagaagagggatgagtggtgagactcccaggccctgggaggggtgccgaggggagacagagggtgggctgcccctgggtctgcaagccctcctgcggcatctgcacgacgacgagtgcgaacattctatctgaccctgccagtgagggaaggaggacgacgttgcaggagagatatggttcctccaaaaggtggggcagaggtttctgcctcactgtgtggggggaagtggggccagaggtgtgtgtctgctaggccagagttagaggggtctctgactcaaccttggcacttgggggtgccctcctgcttgccctttcccttcaaggacagcagacggcactagggatgaaaagaaaaaatggatatacatacgtattttctacaaggttaatatccttttttaaaaagattatttatttatttgacagagcacaagcagggggagaggtagagggagaaggagaagcagacacccagctgagcagggagccggacgtggggctcgatcccagggccctgagatcataacccgagccaaaggcagatgcttactgactgagccaccacaaggtaaatattcttgagagggccaggactcaggctatgtccccaaatttcagaagggttgttgcattgttaggtcaaagaatactgtatcctttgcttggcacttggagagtggattggaaatagctggtttcactctaatcgcccttgctcctaagcagtgtgagctcctcctccttcttcctctcagccttgtagcggcttgagagacacagaggcagcattggcaattcagcactgatggctcctgatgggcaagggcactagaggcacgggtaccccaggtttggccccatctcccctagctacacggtccaggagggcacccaagggattttatctgagctagtgatggaaggttataaaatttgctgttcgctagctcattcagaactttgtttttaaaaggagaaaatacgatgacttgtactacccagaaataaccatttctaccattttcatgtaattccctgtagtctcttgttttttgccagatagagcatgtacttccagtttcttgtactgggcagctgggtaatcggctgtcccgagaggctgtgtgttctgacatcagtgcaggagttcttggcatgactggaacatgaggcccaacccctctcctgcctaactttggccttgctgtgtgtcatgaactggcccaagccaactgttgcctgtttttgtttgtttcccctttgttttgctaacatactcgtgggctccagcagtggaaatgaaatgggagttatgtatctctatcccaggaaatttgctacttggtgtgcttttgctactctgtgtgctccatggaaataaatcctagaccaaattctgccctgtgttcaaatatccgtgaataaggacacccccaagggccatgtcatttcttctctagcttgagaagttcccactctgccctcaggttctgccaccagcacctggcagggaaggtcactccaagctacacacaactctgttctgagggcaaagccaacagccaggtagtcaggccaggttgcagaagcagtggagctttagaacttgaattctattattgtcgttgttgtttttaaagattgatttatttgtgagagagaacatgtgggaattggaggaggagcagagggagagggagaatgtgaagcaggctctctgtggagtacagagcctgatgcagggctcgatctcactaccctgagatcacaacctgaatggaaaccaagagtcggtcacttaactgactgagccacccaggcgcccctttactgttgttttacatacaactttacatataataattaaggtacacaccttaggtttaatctatgaatttttacatgtgtatccacccatgaaaccaccgcccacattaaagtccagaacatttccagtgccccagaaagttcctcatactccttcccaggcaatatcccccttctctaagggtaactactgtcaaggcttctatggccatagattagtgttgcctgttcttgcacgtcatatcgtggactcagaatatgggctctttcgagtctggcttatttcattcagtgttatgtctctgaactccatccctgttttacatgtggccacagtttgcttgaatagtattctgttgtgcaaatacactgcagcgtgtttgtccgttctcctgctgctggtgttgggttgtttccggtctggggccctcatgcatgggtaacactgctgtgaacattcttgtatgtgccattttgtcaacacagcacccatttctcttcagaatatccccaggagtgctaggtcacggagtttggctttaagcatttagttttagcataaagcttatgtgtttagctttaggagtctctaccagttttctgttggttatatggtttgccttcccacagcgttatatgggtgtccaggtgctcagcgtccttgccaacacttagcactgtcagcccatggctttgcttcaggcaggcttgttgaccagcttccattaagctctgtatacagcgaggtttctcctcttccatgcaacactacctggtcaaggtgcttttccgttggggaacccatttctcggtgccacccagatgcctgtactggctctttgtgaaataagctacctcttagttcagagtaacacaactctccttatccctggctgttggactaggggtgggggagcactgagcccagcttcagggctcaagcttcagacccaagctgccagcacaccagtcctcaaggagggcagaaggcatctcctgaacactgtgtccaaaatcttcccttgctgctggctgatgccattgttttgtgcctttacctctcaggctgtggtcattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgtttctctgtcttcaaatgttattattattagttggtttatgtgactcaaaattttaaaaattcagggagatttccctccttgtccccagtctcccagttcccctaccagaggcagccagtttggccaatcacacatgtaaccttccagagataatgtgaataccagcatgtgtgcacgtgcttgtgcatgtcccttttttatacaaatggtagcatactgttcacactggtctaggccttattttaaaaattgtttttattaaatattgagcagatacaaaaatagcagttttacagtaacatataaatttaaaacaaaaacaccacaatacaataagccatctggtctctgctacctgtcccaggcaacgaagcagagcttttaaaatctgtgtggccctcccttgccacccccacctctttccccaaatactatcccgaatgttatacttatcatgccccctttttttttatagtcctgccatatgtttaaatcagcacacaataaatgtgtggtgtctcatctttttggattttgaagagatggaagtgtatccacgcagtcttacacaacttgcttttatcccactcatgattacagtcccaagattcagttttgctgagatgtgtggctgtgcttggttcattttcactctgtatggaattccattgtattaagataacaccattaatttttcattgtactatttaaggacattttgggttgcttccaatatttggcttctaggaacagtactgctgtgaatgttcttaaccgtttctttcctggtatggatgtcttgggtgcgttggtggggacttggatcagatctccttcgggtgtttgcagggtctcagggaatacacatcgtcaactccagtagctaaggccaaacggttttccagagtgcttgtgtcaattcacacatttgccagtgtgcttgagtgttccctttgccccacttccttgccaatacttggaattaacagtttttaaaaattttccagactgatatgtgtgaaatcacaactcaccatgctttaaaattttatgtccctgtttatgcacattgcatttacttaaaatatattttggtgactgttgcatatcagagcaatgaggacttcctcctcctttcttgggctgaagagtgttttatcatatgaaaatctgatctatcgcaccagttgcttattgctagacatcgagttggccccagtgctccccagacaattcttcaatgaatagctttgtgcatcggtggcaaagtgcatctgtatgtggaggagcctatatgcagctttcttacataggaacctcctaaactgttgagatggaaatagaagaccattttgctcccctctaggactgtgcctggctatttccagcaaattcccttaattccctgagttccccgaggtaggaaccacatctgccctatcttgtgtcatcacactgtcttttccctcggaggatgaggttcatcacctcccttctccctccgccccaacccagaaccatgctgttggtctctacattaccacccccacctccacacagattcctcagggatgatccctgcccccagcatctccttcttatgaccatccccatctcagaactagtattccctgaggagccggactttgcctggtcctgatggaaaggaaaaaaactgccgaccacccttagagtgtccaagagggtggggcagtacatacatagaaacaaccagaaaggctaggatggatcgcagcccagcacctatcagctgtgacactcatgtccttgaacctcacttctttttttttttagattttatttatttattcatgaaagagagagagagagaggcagagggagaagcaggctccatgcaggtctccaggatcacgccctgggctgaaggtggcgctaaacggctgagccacccaggctgccctctcacttctttataaaatggggatgctaatatatctctggggctggggacagtgtggggtcaagtacccagagcaccccacactcatgcacttccaagttgtagctttcctcattattgaggacacatccagtttaaggatacccttggtggtattacaatagacacaaattctgagtctgagaatgcctggaggaagggcaaggaaacccaaatcagagggccttcctgtaggaggagatatttatacggcatccatcaaggcaagtggggaaatctctcttgaggaaggaagggagcctagaaatcagaagcgtggagggtgaaagaaaggtttaaatgtgcttgaggtcggctgagtgatttggggagagatgtggagtataaagggtgtgggactgagtgccagagatgtggctggagctccgtcttggaggcctcagtggccgaggtcctaagggggctcaggaatctggcgtgcaccagctattcaggtgcaagctcgtgtccacaaattgctgttttcaacagtaagggcctacaacccagcatgaagggatgtggggctcagtagggctgaaccgggttaccagagggccgagtagccagtctgcagggttttcctcggggaggaagaactgtattgtattgaactcaggacattccttcagctccccgcgcccaccccacaactaccctgcgacctggtaccctggaggcacagggactcccttgggctggggactcatcttgagctcgggtcattttccaagggcattgcatgggaccgggaaagaactgcacgtcccctccaggaactttggaagctgagctgcagagtgggaagcctgggctgcttaaatagccacagcaaccatttcccacctgagtggttttgaactcagcctcggtctcccaagagtccagatgggctttaccaggagccattactgtatgatcatgttccttttgtgcagaaagcctcagagagatcaagtgacttgtgcaaggtcgcacagctgggaagtggcagcgctggggctcgtgctggctacctgctggctacctggttcgagagcccacgcagtgctccttgccccctcacccctcctcccaccggcccccggagatactgcatttacacggcctcaaaatcaacacgttcaaacggatatacggtgaacttcctcttccccccttcctagagacaactaatgggaagagtttcttatacccagttttagcaccttctgtgcctgaataaatacatatattccatagagactctcccctgcagttttggataagaaatgacagcatcctacatactgttttgcacctagtttttttttttttctttacttagtatttctcagctgtctttccgtgtcggtttacaaagagcttctccttaccgtgttttacagcccatgtattcaccctgtttcatttcggtggttgttcggggggcttcagaacggaggctgctataaatcattctgcagcggaccatcttgagctcgggtcattttccaagggcagacacatctgttggacaacgctctggaaggagaactacgggccccactcagcaccgtcacgatactctccccaaatctgctcatcgactcaacaatgaaaacacttcttccgggcagccccggtggcgcagcagtttagcgccgcctgcagctcagggcgtgatcctggagtcccgggatcaagtcccacatcgggctctctgcatggagcctgcttctccctctgcctgtgtctctgcctctctctctctctccctctgcatctctatgaataaataaataaatctaaaaaaaaaaaaaaaacacttcctcctggaaccctaatccacctcgaacttgctcccatagactatggccatcaggatcagggtccacatcctgccttttgaatattcccaattccacaggctggattctggacctcggagcccaggacacaggaggcgggcactcaacccagtgagccacataccctcttccagcgagtcctcatttggtcaaagcagccttttgtgggccagtgggacaatcgcctcccccccgcccctttgcaggtgggcagggtgagcctcagagacaccttgcccttgcactgggcttgggcctcaaggctaaggaggaacgaaacttaaaacccagggctccatggggattcctgggtggcgcagccttttggcgcctgcctttggcccagggcgcgatcctggagacccaggatcaaatcccacatcgggctcccagtgcatggagcctgcttctccctcttcctgtgtctctgcctctctctctctgtgtgtgactatcataaattaaaaaaaaaaaaaaaaaaaaaaaaaaaacccagggctcctgactcccagtggactcagggcccccaggccacactgcctcccagcggcttgggaactgcaattagcggaggacagaccaacatctcagctttgctctgttggttttccacacagagcaagaggaatggcatgggccttccaagtctgtttttgttttttaaagatttcattcattcattcattcattcattcattcgagacacagagagagaggcagagaggcagagggagaagcaggctccctgtggggatgccctgagctgaaggcaaacgttcaaccgttgagccacccaggtgcccctccaagtctgttttcatttgcttgtttatttgccagtggagatgagaaagatcagaatatctagcccacatttttttagtcctcccacactccaggcgagtccctctgcacgtatgctcagaggtggaagggataggtgctgttattacagccctgttgtccaggtgaggtgacatgaggagtagtaaggagtagagctgaggcttaaacccaggcagagcccatattctttttttttttttttcagagcccatattcttaactcctctacaccaaggcctgaaaacaatggctttcaatagatgacatacaaataatctttattatattatttcaagcttctgtagaaataaatggtggctatctccttggtattttgttattgtattattattattattattattattattattattattaagagagcacatgagagtgggggtggagcagagggagagggagagagagaatcccaaacagactccctgctgagcatggaaccccacctggagcttgatctcatgacctgagccgaaaccaagtcagatgcttaaaccggctgagccacccaggtgccccttccttggtatttcagggaaagcgagaagacccttcacccatcaaaaatgaaataccatcccaccagcttagggctgcttttgactgtacacatagagctgtgtctcttaggctgacagtttggatccttgatgaaatgagattctcttgggcacctccctaccctttaatgctccggcctgcctttcatgacagaaacagctctctcccttcctgcagttcttgtaaaaacaagagaagactgccccaaatgtgacattaaattttactgttaaatatgtctttacaggggcctgggtggctcagtggttgagcgtctgccttaggcccagggtgtgatcccgggctcctgggatcaagtcctacatcgggctccctgtggggagcctgcttctccctctgcttctgcctctctctctctctgtgtctctcatgaataaataaataaaaatcttaaaaaaaaaaaaaagtctttacaagctcttccactcaccactgtcagttttgcacacccctgaagatctgagctcccgcttcacagccctctctccactcatcctgacaggatacttgctgctttcgccatccactgaagtcctgatctccccattccctgatctcctctcccgcagtggctcagctactcagtcccaagttcaagccctggaccctctaaagaccccacgttcaaatgtcttcctagctcattccttcaagccttcagccccacaggccccgtgagctccacggtcactgacctcctcaccttttcgtggtccccttcaaggcctgcctcctctcctttccctcaactccacagttagttattagaactcctttcttgtctacatctcttgcacctcaagcttgttagatcctcatcactctgcaaaaccctggcccagttaaagccaactctccacatgctctactatggctcctatttgtttatgttgcttgctcctggctgtcctgctagaatgtcagtcccacaggcaggggctgtgtcatctggctgccctatccacctcccaagcatagtgcccccctgtgcccagtgggtacccattgggtgaatgtgcacatttgttgaaggaatttctttcagaatgtgaaggatctgagagcttattacagtagtatctagagaaaaaaggtcaaggacagaagtcacattgtgtccaagggaggctagaggagggtgggaggccagaataaggaggacaagcccaagtttgcccaaggaggaggctgttcttcctcgttcctaactggcacttcttggtctagtggtagatctcgaaagtttttcaatctcaaacccaaattacaggattctgaacctttactaaactgtagattcctgccagtctttgttatttaaggcttccaagactctcctgaaatggtgtggtatgggcaaggcaggccctgcttgttaggtcagctgcctgctgaccctcggtccaaaggggaaatagcagggaaatagcaggagaggggattgacccctatcgcatgccattttgtgccagaggctttctgcacatcagccccgctggattctcacgatgcattcccacagctagttggtggttgggattcaaaccaggcacattctactccatcaagagggttcccaaggcggtgttatatgggacctaaacactgcaagtaaggcatttctgggccatgagcttggagtctgaagcgatctcagtgagccccagctgaagttctgaccattcattctctcctttctcttaccacttgagaaccggaaaatattgtacagactggagtttccccagagatcggtaaaggagcataaactgactcatcaccaagtttggactcgaaaaaagaaaccgtttgttctgatttgccaaaccttaagtcaactttgttttgaaaattgaaccttctatgggatctcaagtttggcattttgtctttttaaaggtcagtgaatctgtgagattccttttttaaaaagatttacttatttgagagagagagagcacaagtggtggggaggggcagagggagagagggaatcttaagcagacaccccactgaacacagttcatggagctcggtttcatgaccctgagttcatgacctgaaccaaaattaagagtcggctgcttaactgactgccacccaggcaccccagatctgtgagattcctaactagaggtagcccagtgggatagaaatagcctgggagtcaggactcgggcttgctgtgtgaccttgagcaggttacggcccatctctgggcctttgtatcatgaaaataaagggcttggttctagtcagctctccattcccctctagacctaaagttctaggatcagaatatgggctctgactcagacacctgagtttaagccctgtttcatcatttattagctggtaagtgagcaggttggacaggttgcttaactactgtgggattcaatttcttcacatgtaaaacagagattgagagtaactttgtcataaggtggcaaagcctgaattagaagattcatataacttgtttggcatagggagccagcatgaacagaagatgcgctcaagttggcttggcacaccgaagaggaagtttctttctacgttattggaaatctataaagaaccagatcataaaaatctgaactccaccaataatgtttattgagcacatacttacatttgtggagaacacttttggttggccccacccaaaccattcccaatcccatgtttgccatgtccaaccaaagagactggaaatgcagatactctctttctcagcctcccttgcagcttggggtggccacatgatccatgttttgctgtgagacataagctactggtggcttctaggaaaggttttgttccctgtgataaaggacagccaccagaggagatccccctgccactgtccttttgatttttgctcactgtaaatatgaatacattatgtggagcaatggcagtagtcttgtgaccatgaagcacaactacaaggagaaaaggccaataagccaagcatatcatactgtaaggctggaaagaacttgggtccagagagaccaaccacagcatctgctggttgttagactcgtcacagggtgacaatacaagccctgtttgtttaggcagctgtcagctggacttcctgttccttatagctgaggccatcctatctcatatatcattcaacaaacatttgttaaatttctactagtgctaggcctcattctaggtattaggtttacagggatagagaaggtatctttaaagttttacagcctattcaaacagagtcttttttttttttttttaagattttgtttgtttattccagagagagagagtatgagcagggaaggagcagaaaaagagggagacaaccagactcctcactaagcctggagcccgaggcaggcctcgattccaggacttgagctgaaaccaagagttggctgcttaaccaactttttgtttgcttttaatacaatgaaaatgtaagaggtggtacagttgatgttagcatgagggcataaaggaaggactttcttcctttctagactgtaaatgctatcagaacagattctttgtttttcttaccaatacacctccagctccttgcctagcatttagtcaatgctcaataagtatttgttgaatgtggtaactgtgagtgcagcttaccctgtacaagcgatgatctcacttttatgcccttttaaagttaggtgtggctgtgtgacttgctttagccaataaaatatgaacggaattgataatatgtttgtagtaggcggaagcagatgaaagctggtatggatctctctattctttatctccctgctgcagccatggccattgaaaattaacctgattcatcaatggatgaatcactaaatgaatgaatgaatgaatgaattaattaattaattaattaataatggcagtgttggaaatggattagaggggtgggaagacccagacagggacttggacgtggacactattgtgtccctactctatgttgaaggtagaaaccgcccctttggccttccctccttccctctggcagagcctgcatcccactgtggagattgaaaatgccaaatggtggccttctcagcctcccctgcagcaaaggcatgggtgtgtgagcgagtgctggccagtggaccctgagggagagtcttctggatggatttctggacatggtttcccccccacaagttaaagaatagactttcctcattattgaagccactctgcttaaataaacttattgagttttctgtttcttgcagccaagagcaacctaactaatatatgagtccatgggagagataaggaggccctcaatgcaggccttagatgaaggacttgagagaaaggcacagagctgaaggaagctaagaagtagaatcaataggacttggtgactgagtgcagtggttgagctgtgggctgtgcaaaataaaaggagtctgaaaccctggtctcaaatattaaggatcccagtggaagagacacgcagtgtgtcctgagggggttgtgaggagctgggaggaccaagcagtcaggatggctggcctttggttgcaatggagagagccagtgatagtaatctgggaagggtcttcctaatatattttagaccaaattttatagctacaaccttacaaataatctttgccttacaacttacacaattttcattttgcttcaaccattttgacctgttgaatggaaaggcaatagtgggactatccaatttaatgatgaatatgctttaaatgtaagcattatttaaaatagggctacttgacatgccattagggtgatatacagtaggtcatttaacctatgcttgaacatttaaaatagtgctgtggtaagctcttctggccagaagttttcctatgacttagattattaggataagtttccagaaatggaataactcattcaaagcaatattggaagcaatgaacctcacccaagacacactgctattatttttttttaagattttatttattcatgagagatacagagagaggcggagacataggcagagggagaagcaggctcccagtggggagcccgatgtgggacttgatcccgggaacctgggatcacgacttgagtcaaaggcagatgctcaaccactgagccacccagatgcccccagatgctatgatttcttttaaaaaatattatattttaaaataatctctacacccaatgtgggactctaacccacaacccagagatagtcacatgctgcactgacagagctagccaagcacccctataattttggataaatagccaacttgcttttgcagactggtagaaccaaaacggttctgtcattgcaccagagaattttgtttaacatcatacatacgagactggatctcctgacacagaaagaacttagtatgggctgtggctattctcttatggaagctgaactctcaggactgttttttcatcgtaagttcctcatagtcaggttatgctgttctggttctgagcacatatggcctgaatacggggcttaagctgtagatattaagtgagctagaagacaaaatatttcctctaaaatacaaaatcatggggtgcctgggtggctcagtcagttaagcatctgtctttgactcaggtcatgacccagattctgggactgagccccttgcgcaggggggctgaactccctgtgcgcagggagtctgcttctccctctccctctgccactcccccagctcatgctctctctttctctctctttcaaataaataaataaaatcttataaaaaaaattgcaaccctttatcaaacagctaaacagagtaaccatttaacagccaagccaagtaaataatccaacatcatgaattgttttttttaaatctcttaggtttaaataataaggtttcttgagaaagaaatgtaatgttctcttcttactaatcctgaattattttcaatcacagccaaatattaacctcgccttgatcctctgattgattagaatggaccactccaactggagtggagcttaaaagtccttgttaggggatccctgggtggctcagcagtttggcgcctgcctttggcccagggcacgatcctggagccccgggatcgagtcccgcatcaggctcccggcatggagcctgcttttccctctgcctgtgtctctgcctctctctctctctctcatatgtcatgtctatcataaataaataaaaataaatctttaaaaaaaaaaaagtccttgttaggctggcgtaaggacccgtctggctttctagacttggaatctgttaaactgactattcatccttgggctcagaacccctcaggggcttgagacctctctgagccctgactaagcagacaggaggggctagctgtgtgaactggattgtcatattttcctcctgagggacaggacagccctgggcattgagagaggagcacagtcccagcagagactagagaggatgttcaaaggggtgtcagggactgacttcccagtttggttagacatcaaatgtctgcaccatcaaagaccatgatagcatctgaacaatgaattggccaccttttaacctactataggactagagaaacttaatataataaatgtcactttattactctgaacctcaatttcttttctgcaaacggggttaataaaacctctaactcagtattgttgtgaaagccaaatgagatgattatctgaaggtctctgaaaacagattaagaaattaactaaggggcaccaggtggctcagtcggttaagggtctgagtcttgatttcacttcaggtcatgatctcagggttgggatcaggccccaaaatgggctctgtgctcagctgggagtctgctccctctccttctgctcctcctctgcttgcatgctctctgtctcaaatgaataaataaatcttttttaaaaagaaatgaattgttatgctttgttttcattaataatacagctaacatctctactgcagcatacagtatagtagttcttcttagactccaatgtgtgtatgaatcatctgggagtcttgattaaatgcatatttagattcagtgggtccagggtataagacactgcttctggttcatgcacacactttgagtaacaaggatgtacagcaatttgcaagcatgacattttctaatagtagattccaggcagacttcaaaattatcagtttggacagtcgttatgcattccatgttgtcatatgatcaaaacagtctgtggcctttaatatcctacaggtgaaataattgaatggcacagctttcgaaggtagaaactagagtctacacaggactttcctaagtgtgcttgacatttccttagatactagttaaaaaaaagatgtggtcacatacattgggtaaaccttgggtcaaatgaaattaagccaagttttttttttaaagatttatttatttatgatagacacagagagagagagacagaggcggaggcagagacacaggcagagagagaagcaggctccacgcagggagcccgatgcaggactcgatcccgggactccaggatcgcgccctgggccaaaggcaggtgccaaaccgctgagccacccagggatcccctaagccaagttttttattgtaatgttgtaacttatgatgccttctttctcaagtgagtaacataaaacccaaatagaaattgcttaagtaaggcctttctatttttcttccaatacaagaagactggctgcagggaagtttctaggctggctaatccagtagctggctgatatcattaaggacccaggtcctgtctatcttcttgctttgccatgtatggtgcatgggccccatccttgggctagctatcctcatgaccagaagatggtggaggctgtctttttcttctgagtatttttcagttctaggatttccactatggtctttctgtagtttctgattcttttctgagattccctatgttttcattccttttcttttccatattttcctttatgttcttgaatgtagttataatggctcctttaaaatctgtgtctgctaattcttccatcttggtcatcttgagtttggtctccactgattgagcatcctttgtcagctgggccacattttactgttattctaaatgttgagtatcctgaacattgcaagccatatgctgtagagactctggattcctgttgttcttctcaagagtgttgctttctgtgtttgtttcagcaggcagttggcttggctgaacccccaaactgcagacactgtctcctcactggtggatgcaagcagccttatctatcctacataagtggtcttcagagatgcatgcagtctacacacagagctcagggtgattattttgtggctccttcccctttccaggattttgctcctcactttccagccatgtgtttaccagaactctgtcctctggtgtttcttttttttttttttttcctttaagattttatttacttatttgagagagagagatagagagagagagagagcacaagcacagggaggggcagaggaaaaagcggactcccagctgagcagagtctgacccagcgttcaattccagaatgctggaattatgacctgagccaaaggcagacgcttaaccaattgagccactcaggcaccctatcttcttcttattttaagattttatttttaagtaatctctacatctagcatgggcttgaactcacaatcctgagatcaagagtttcatgctctaccaactaagccagccaggcaccccttaggatcttctattataatactgtgtcatcctgtatgcagaattttttagtctctctttaaaaaatgaagagagctttctcagaattcctcagcaaatttcttctgtctccttggctggaattatattcatctgttctttcttaattgccctcgttcttagatttgcttgccctgaagggacatggttgccctgaagagggtaaatagaattagggtttgattagccaggaagaagctgagaatctcccagctgagtgtggagcctgacctggggctcaatctcatgaccctgagatcataacccaaaccaagagtcagacatttaagcaactgagccaccctggtgcccccaggcactgggtttcatcagtgttttccactcaacaattgttggtgaactatgcagtggcttggaccaaaacttgagatctgaagcgattgctgaaataaacaagaaagtgttgtctcagtttttgatgaactgttcctggaaggtgggtatctcaagaaaaatccaaggaaaatgaatctttccttatacctgcacctaaatagagggctcagggctttgctctgataattattcaaactaagctgaggaagtggtgacttccctggattttctgctttgcaggtaggttagctagaccctggtgctggggaatgcctccctctaaaagcaccaattatcctaaaaacagtttaaaatatgtttttaaaaaactattgaaaaggtgatgtatttttacatcatttttacatgtaaaaatactagtaaggaccatttaaaagtagaaagatccccacagggcagcctgggtggctcagcgatttagccctgccatcagcccagggcgtgatcctggagacccaggatcgagtcccacgtcaggctccctgcatggagcctgcttctccctctgcctgtgtctctgcctctctctctctgtgtgtgtctctcatgaataagtaaataaaatcttaaaaaaaaaaaaaaagatcctcacaatcccaccacacaatggttttcattgttacaatccctttccatgtgccacatttttgtgtactgtttttccttgattctaaaaccatcaattttaagactcagcatcaatttactaaaagctttttagggagaagaagaaactgccacaagaacctattaagaatgcccattgattgtaagatacgttctgataccagaaactttaaaatgtaggggaaaaacccatgcctcagaattgaggaaaaaagtaggaaaaaaaaccaaaccattgatctattttactttgctatgtagcagcaagtgttttattttacttttctctctttctctttttttttgggggggggggaagtaatctctatgcccaaagtggggcttgaactcatgacctcgagatcaagagtcacatgctctgctgactgagccagccaagcaccccctaaactttttctttttcttttcatagcaagtgttttaaattatttgagttttgaattggaaacattctcacatggtgcaacattcagaaggtacaaaagaactgtcagtgacctatccgccactgctcacctctctgtctccttcctacgggcccccagtgatttcagtctcttgtgtgtcattcagaggtattctgtgcttatagctgctgcgagtgaaaccttatattccctgcccccctttaacatagatggtaggttattagactcccttttctgaacattgctttttcacttaaaatatcatcaagcttgatcaacatcatgtccagaccatattgatttcttttgtttttctaagactgtgtcacaagcttatctctgtctttttatataattgccataattatccttttcgatgactggttttgtggggtgactggaccccacttaataacaactccccgttgttgagcatttatataatttccagtgttgctctgacaggagcatgctatgaccatttactcattcaacaagtatttatttgacaaccataaattgagctcctcctctgtaccaaagtgttttcccctaaggggctgacaggcaagccgctggagccgccagggaaataaataagcatagaagtgtttgcactcttccaaggagcctctgagtacagtcagggctcccacatgggtagtggaaggaagggcgatgagggactcacccactgtgctggcctgtgtaaaggtacaagctgggtggcagcttattctgcaggcttgagagtgggttactgtgcacacagggcagacacggatctcgcctcccagggcctgggctgcggtgggatttacaaaggaggtaaataaagaccatattaaccatgtaagcacttcctatgcatttaccatttgccaggtgaacccccggtggggtaaatattacgttcccattttttattttattttttattatttatttatttatttatgatagtcacacacacacagaaagagagagagagagagaggcagagacacaggcagagggagaagcaggctccatgcaccgggagcccgacgtgggattcgatcccgggtctccaggatcgcgccctgggccaaaggcaggcgccaaaccgctgcgcaacccagggatcccacgttcccattttatagataagaaaactaagtcaccaaggtgttaagtaacttgccagtggcgcaaatgaacgtggctgtgattttggtccctgcagcccggcccggccagctgccacgatactgtcctgagagcacctgccgggtttaaccctggcagcacttggggtcttggttctgtaaccactgacccaattccttcccttctgaaatctcaacacaggtgaactcaagtgcctttaattctcgcttaaaggatgagtgtttccctcctgggagcctggcttttcctcctccccagagaactgcctcccagaagccttgagatgggggctctcctcccccactggggaagaggatgcagagcgttttcttaccctgcagccagacagcacaaggagactcagagcctgggcgggaggtggggacccagaccaggggactcagacagctggccttggtaccacagggaccctggcaggtccacttggctcagacctgcccccaccttcagctgtctttcctctgcccgcttcccccacacacacacacactcccattccacaggcagtttcccatcccccacttctctcagttcccctctcccttgttctgcagaaccccccccccgcccccccacccccgttccctggacaatgggaatctcatcacccggctggagctgctgggagcgctgcccttctgacccagctccggaacatatgtaatgaaactgtcccgctgacgcccagtctcctgtcccacttctaataattcaattgcttctcagctattggaacgaaggccctcttcaccttggaatatttcaaatgccaaaacaaatagcaacttatagcaaaaatgggaccatccacagccattattctttgtttacagtcatggaaataaaagggaaacagcacaaaagatgggcagtgaacatggggtttccttcctaccctcaaatcctggtcctgtccttacaagttaccaccctcaatagttttatttctggagttttataagcacacacatagaggatcttttttttttcttctcctcctccttttcaacataaatgagagcatattgtttggatcttgggttttttttttaattttcatttttcctacttatcaatatatcttagaaaaatacatttcatttatttattcatgagagacacacagagagaggcagagacacaggcagagagagaagcaggatccctgcacggagcctgctgtgggacttgatcccaggtcctgagccgaaggtggttgtcaaccactgagccacccaggcgtccctttaccaatatatcttggagaactttccctatgagcacatccggatctcccttattctttgctatagctgaggagagttatattatatgaccatgccataattcatttaatgagttttccactgatagatatttaggtcgcttctagatttttgctgttacaattgttgcttgtatgaacaaccccatacatatatctctggggacttctgtgagtatgtctgtaggataaatttctacacgcattttattttaaaatggatggtaccaaactgtcccccagactctagtttttcaatggagacggaaccaatagcttaggcttgatggttaaatcatttaaagtaatcaagactctattttacatgggagagctttttttttatgacttcaagccacaaaagcgcaaattgtaaaggaaaaagaacgacacattttaaacttctataccacggagacatcattaaaaacgtaaaagacaagccacaaatagggaagtgatgtttgcaacgcatttaacactagctcgtgttagtaccaaatgtacatgttctcgacaaaagacaaacactgcccccaccctaaagggaagaggctaagaacaaggatttcagagaagaggaaactggattggccaacggatggatgaaatgatgcacagcctcacaaataaccagaaaaatatcaattgaacaatgcgatagccttttacatcactcagattggcaacaatttttattctggcaataccaagagaagcaaagtaattagatttcttataaatgctcagtggatcgtaacttggcatgaccactgtcaatggcatgaccacttgccactgaccactgttgacagcaacagtcaaattgaagaagtgacctctgcattaactacattttcttattttgtatattctttttcaaaaagattttatttatttatttgacacagagagggagaaagagagagagagagaataagcatgtagagggagaaacaggttaccaccaagcagggagcccaatgtgatgctcaatcccaggaccctgggatcatgacctgagtcaaaggcagaagctcaaccagtgagccactcaggggcccccttattttgtatattgatgctctggcctgtgtgacttccctgactagggagagactgccctcccatctcacccttcaccctagggctggccaattctgagaaagtgcaaagggttgggagcacacctttcttatgcaaacacgcaatctgagctgaactaccagactctgaactacctcctctaattgggctcctacaccccaggaggcgctattccctgccctaatcacccaggatccggtactagatagctagagaccacccctctagttcacagccctggctggcatgccccctggtctctggaaatgttaagtgtggtagtcccccccttaaccagtggttcactttccgtggtttcagttaccagtagtcaaccatggttctgatgcagacgatcctccttctgacgtagtgccagaaagtcagtggtagccgattctgtgtcccacgcctgcgtcattcacttcgtgtcatcttgtcacatgggcatcttctcatcttgcgtcggcacaagaaggagggtgaacatagtacagtaagatattttgagagagagagagagagatggagagagagagagagaaaccacattcacacaatttttattacagaattttgttataattgtgttgttattcattattgttgttaaccttttatgtacgtactgtaccaaatttataaattagactttattataggtatgtatgtataggaaaaaatagagtataatagggctcagtactatccatgttttcggggatccactgggagtcctagagtccttttcaggagatggggggaccaccgtaacagaaatcttctttcaatggtattagcctctcccatcatctctcagttcccttccatatattcagattttgtgggtgcagttgataacacccatatcgtgacctgaaaatccccataccctgcaaagggagatgtaaatcagggttgctcactgcagcattattggttatagtgaaatggtggaaacaaccagaatgtctgtcagtaggagaatgataaatatgttgtcccatggtcccgtaacgggtcacccaaaaggagagaaatggaaaagacgagagccgtgtatatcacaacattgaatgaaaatgcaaactgcataataaatcaatgtgtgcccttatgtaaaatttagaaatatgtataaaacaatactatacattgcgtagaaatcatattcatgtaataaaagtgtaaaaacatgaaagagacagattttatccaatctgggacctggtttcctgtgggaaggagagtggggggtaagactagaaaaggattccagggaagtctcatctccatccgtggtgtttcgcttctttaaagccaaacaaatatttgaccaagatgtggtgaaatgttaaggttgttgaatatgtctggtaggtacttggatgtttgctgttctatttttggtactttactgtatgtgggagctacttcatgagaagatatgatttaggttgcattagttatctcaaggtcatataaaggacaacatgacaggatgccagcaagctctgttgccacctctgttgtgtcacattttctcctctctccctaagccttattttaaaaaattgctgacttttttagaaaaggtgtaaacacttgcaccacatagagaatatacctatagtcgatggagtattcttttgctcattcagtgtggaggttagccgccaaatcagcccttaacaatttctaccttttggtattcacacccttcctacattttaccagggccagcctgtgtggccaatagaatagggcagaggggatggtatcgctttcgggatgaggttataaaacggttacaatttccatcttgggttcacagtatttctggttttatttttttctctctctttatctctcttctgctctctcactttctggcatccctcactctgaggaaagcaaactgtcatcctgggagcaaccccttggagaggtccatgtgatgaggcatcagagctttctattaatagccagctaagaactgatgcccaccaacaaccatgagagtgttgagccactcagataagccatttctggcttcctaatgctcagaaactgtgtgagatcataaatatatatttttaagattttatttatttatttagagagtgaaatgcatgagtgaggggaaagggcatcggggttggatggacgtggggctcaatcccaggaccccaggaccacaacctgagccagatgcttaaccaactgagccacccaagcatccccataaatgttattttaagctattaagttgtgaggtagtctgtgacacagcagtagataaccaatacactccctgggtccaccatgtttccctcattaggtgtaagatgactgccatagctccaaacatcacattctcacaaggcagcatctcaggcaggaagaataggggatggaaaaaatggggctcgctctccccatgtacctttctctttccatcaaggaggaaagtcttccttagaagcctccagtggatttccctttgcttctcattgaccacaactggatcttctgattgcttctagatgcaaggggttggggcggagggcgtggctgggaaatcaagtatcaggtttttcagctgctttatagggatgtgggcaaagaacaagtggataggaaatgggtgccatgacagcaaagccagtaactacctgcccttcccacaatttcagtttgtcaggttatttccatctggcactcttaagtttttccttcatactctgtattcactgtgaactggaaagtaagtcttaattagattcaggttaaacattattggcaagattattcatgggcaatgctgtgaccttcatactctctcaccccaagaaattaccagtttcttcaccaaataaacatttcacaacatttaagcagaggatggcgcgccatcagtgaagagctaacccagaatctagatggtgtctttctccctgagacttgtcctgggtagcttcacatattttatacttatgggaactccaggttctcctgtaaattcatttttggttgtctcgttgtgatggtgggcggtgagcagtctcattttcctgccagtgactgcctttgtgtgtggggggggaggggcggggggctaatgagtcacatgggcagtgctaccttagttcaaaacccctaacagggttatgagctgactttaaaaatcaaacgcagaaatactggaacatgatcctttcttgatgtcatccatttgaggttctcagggctttcagtgtaacatcaggaacgtgggacaatgagatgaatcttctccattgatcaactccggggcccctgaccatcgaggcctgcggcccacttgccctcatcagatgcgcaggcactttgccagggtcagcgcttggtgaacaccaaggttggcggctcctctggggccttctcgtgtgctactgtgagattctggtttgcttgatggcagccgggctgtcctgcacctgctggggcctgcgccatccctgtgggatacgtgccctcaagagagactgcagcctagtccaacagccaggcctgggccatgtcaggacaaggcaccaccgtccatgaaagggtgatgggcccccgccttcttgagccagggcagcctgtgtagagcaagagtcttgcttcctatttcagggatagcgaggtgaacctggaaggagaatatttgttcaagattgtctttcttcagcataaccctgtgccaatctcctccagctatttacccttcttggctgcctcgatggcagggatctctgacacctctctggggccttcccacacccctgcctccagttccgacatcttttttttaagattttatgtattttttcatgagagacacagagagagagacagagacacaggcagagggagaagcaggctccatgcaccaggagcccgaagtgggactcagtcccaggaccccgggatcatgctctgggccggaggcggacattcaaccactgagccacccaggtgctccaagctccaatgtcttcttatcttctcagatatgtcctctatccagtttcctcagctcagccccagtttccttaagtcagccaaaggcttccctacccatccagacccccctccccctgccccaggctgaatataaggcatcagcagtgactcattcccgtccaaccagtcccctggccgggagagtctctctgcgtcagtggcatcactaacttgtcttccttcagctgctgctccggcctggcctccaatctctaggaggatccgatgctattctccttctcatcttccagtcctggtctccttgcccggtgtgagccgcctgccagctcctcctgcacgtcacaagcagatcatgccttcctcttcccaccccacctttctattccgctgtatctcccaggtccgtcttttcccgaagccttgaccctcactaccctttaatcataacagatgttccacatgccaggcattttacagccacatctgtatagctacagcataggtgttattgtccctttcacagatgaggaaaaccgagtccaggagaggctacacaggtcctgctgcctataaacagctgggattcaacccattgttggtgtgatccaaaacccttcatcctgcgtaaccgcccgccatcacacccgtcccctcctctgcaggagcttgtgctgttccctaccactctacgctccctcttccttctagcttcttcatatcccccaacccacgactccactgcttagcttctctcgtggttcctgcccacgctactcacccttgattcttcacttcactggcaggaatctcagcctgcacagtttggtccttaattatagactgccttgtgtggttctctgcgtatttcacatttgcctgtctcattcccagaaagctgtgagtgtctgagttcggggatggtgcgtccaccactcctatcccctgggcccccgttacagagccgggtaatcaaatactcagtggaactgacctagtgtcccaggaaggaggcgggtctcgatgttccaaaagctgactgagctccaccctgtcacatcccaccttctagtccagcggtaagcctcatacctctctctgaatgcgtgcgtgtgtacacacagatgcacacgttttccctgtcactcacacatttaatccaaagggctcttcccagatggaggatcaaattatgtatctggaactatccacccaagagagaaaactccttcctaactgaaccctgggcgtggccctcattgtggattccaggggggaccagtgaggctaagagttgatgggagttccctgtgtcaggtgaggcattgacatcatatcctaacagtgtggagctggactgagcaccaagtgggggacttggtggctcgattccgatgctggaatggttttggggagaggggagagatgtgatcttgccagctttgtaatgacatcctaggcagaggaatctgtgggccgaggaggggccctcctctccagaaccacattgcactgctccagagggggcatgtagccagccttggtccccaagcaccacctccttgccttctgggctccaaatgcctcacagtcctgaccccaatgcccccatacctgccctcccaagctgctcattcttggggttaaatattgccatctccaatttatcattagaagagcatgcagtatgaaggtccaaacacttagaatgatctagatttcaaactgattttttttcctggatgctgagaagaccacatgagagtctgggacttggtgagaggatgctacagctgagtgtgtcagtgttgggccaggagaaaagctggagagcgatggagaggcagtggagggtggggctctgaggcctgacttctctttaaaattttgccgtggccagtcctgacatgtgaacaaacacacacattcttatgtaagaacaaataaaaacaattgtgtaacacaccacacccgcccccagagagcctggggaaggagtccagggaggagtgatgttgtcagggggcatgggtaggagggagtgtgtcccccctcagaaatcatagcccacatgctggctttgcccctgccggggaggggacaccttcctcctgggagagaggccagcatataactccttggctgccacagcatgtcagagacagaggcatcctctgataaccatcagtgaagggttttgcaactctgtgtgtgaagcctcctgggctgagggctgagcagcgctgcctctttgggatggccccagtggcggctgccaacgctgctaggtttacgcagcctcctgggccaagggctgaggagcctgtgccagagatgaatctagccacgcaatgacgccaggggggactcgcagacccgagacgctgctcatacattcagggtgccttctgcaccttgacctgggcctgaggcctttgatcagcatttgggactgcctcctggaggagctggatgggcccaggcagtggctgctgagccgtccgtgggtgtcccagccgacccaggagagacggcccctttccaggtgccgggctagcaggagagtgcggccctgacttgcagcaggagcgcagcccaggaggcaagccttgcccaggggccaaggagatggaagagcaggtgttcaagggggacccagacactccccattccatctccttctccggcagtggatttctctccttctaccaggccggggctgtggatgcccttcgagacttggccccccggatgctggaaacggcccaccgctttgccgggacatcagcaggtgcagtggtggcggctctggtcatctgtgggattgaaatgggtaaggcgtttgttctggattccctgggggagccttgggggtggggggactccccaaagtggggatgctttgggaaacagagccaggccttctggctggtgggaagggaaggttgagagggatggcaagaagctgggacatttgaggttggggtcagccaggtcccagtctctgagccactgggtgagtgtggacccatccctccttctcggtctccctcaacatttctgtgacaccctgtctgccagggcctgggagggacaaaggcagtatctccctcaaacattctggtcttggagtcacaccatgacacagtcagacactgggatggagtgtcattccggtttggcctcttttgtagtgcacccatccttgggtggggcagcactttatacctttattaccttggcagggtagcttccaggtggctggagaagtggaagccttgtggccacagggaacagccagactgggaaagaatcgggaaggtgtcccttcaccctctttcctgctgtcccgggtcccactgctgacccggaggccagaagcgccatccggtgcaggaccacctggccgccccacatggcaggcctagcccagcgtcctcacagctgcctcggatggcagtcaatcctgcactgtgctactgctcaaaggccgtgccccgggaagcagaaattctagagaggggagacagaaaaaaaacattcagacaggcaaccttgtgatgtcacatcaggacaccataagatctatgaataagattatagcaggaaaggggcagagaaaagagaagctattttttttctttttttttttttaatcaacccaaccttttatctatttatttataatgtatgtatgcatgtatttagtctattacccagttaccccttccctcatcctcctcctcccccagcaaccctcagtttgtttcctatgattaagagtctcttatggtttatctccctctctgatttcgtcttgttttattttttcctctcttgctctatgatcctctgttttcttttttcttttttttttaagattttatttattcatgagagagagaaagagagagagagagaggcatagacacaggcagagggagaagcaggctccatgcagggagcccaatgtgggactcgatcccaggactccaggatcacgcccttggccaaaggcgggcatttacctgctgagccacccaggcgtccctatcctctgttttctttcttaaattccacacatggtggacctcacatatggtgagatcatatgataattgtctttctctgactgacttatttcccttagcataatatcctctcattccatccatgtcattgcaaatggtgagttccatttttttgatggctgagtagtattccattacatatatataccacttctgtatccattcatctgtcagtggacatctgggctctttcctcagttttgctattgtggacattgctgctataaacgttggggtgcatcagatcaccacatttgtatctttgaagtcaatacccggttgtacgattgctggattgcaggggaactctattttcaactttttgaggaacctccatactgttttccagagtggatgcaccaggttgcattccagtgggggctattttagaaagagtggtcagggaagcccttttgaaggagacaacattcaaacagagacccaagtgctgtgagagaacaagccatttgaagtgagggaaagaattttccagctggaggagcatccagggagccagggagtgggggcaagaagaaaggagtgggggcaaagggtggaggggcaggcgggggtcagatgacacccacatgatgccttgtagccagagcagcaagctctgagtcaccctgatagctaaggagcgcaggcaggctgtaagggggcgaagtggggaggcagtgaagagcacgtgatccaggtggattggaccccagctctgctgtttcaccatgtggacgtgaggcagactattgaatgctctgtgcctctgtttctgcatctgtaaagtgggaattctactcgtacccaattccaagagttgttaaagggttaactgagctagagtgaccagtttatcacagtgcctggcacagggcaactgcgtgggatgtgtcaactccctggttagggtttgtaaggaaccccaacagctgggcaaagtgccttaggaggagaagggcagcaacaaggagcttagcgggagaccacagcgtgtccaggcaggggtgagcacagcaggtgtctgggtcttgaggggcagtaagaagccagtgggtttaggatgtactttgaaggtggagccagtgagacctgccaaagggccagctgcagtgtgcgaggaagcggtgccagcaggctgccttcctgcctgggggcctctgtgctgggtgagaagtctttcttcatcataaagaatattagtgatgcccattcactgagtacctcttatgaaccaggtaatttttttacttctaatatttcacaagtaacaaattccttctcactgtacaaaattcaaacaatgcaaaagtatatgtccttaatcccactcttcctcctgtagctagtctaagagatcatttttttccaattaaaagcattttaaaattccagtatagttaacaaagcgttgtattattttcagttcaatacagcgattccacaattctacacattgctcagtgcttatcatcttaagtgtactcttaatccccttcacctgttccacccattccccacccacctcccctctggttgctaccagtttgttctccatcgttaagagtccgttttggagtttgtctctttttctccttgttcatttgttttgtttcctaaagtgaaatcgcggtatttatcttttccctgcctgacctacttcacttaatatgctatcctcaaggtccatccatgtcgttgcaaatggcaagatttcgtttttttatggctgagtaattatctattcatctctcaatggactcctgggctgctattataaataatcctgcaataaacatagaggtgcatatatcctttcaaattagtgtttttgtattctttgggtaaatacccaggagtggaattgctggatcatatggtaactcactttttaattttttgaggaacatccatacttttttccacagtggctgtaccagtttgcattcccaccaacaatgcacgagggttccctttttcccacatactcaccgacacttgtttcttgtgtttttgactttagccattctggcaggtgtgaagtgatatctccttgtggttttgatttgcatttccctgatgatgagtgatgtggagcatcttttcatgtgtgttttggcccttctacatcttctttaatgcacagagtcctctttgaatgtagcagttcacttcagtcacacagtagaccctagaacaagccttcagaaaggggctgggtgaaagcccacactctcttgtctgggagtcacagaattcctgtccttggagacatcctgtctctgggattctctccctttctgggtatgtgtgtcactcacatgctccatcactcccactctcttcgtgtctttattgcgacttcttaaaagacactgtctgagagagtctgtggtgtttccaccctctggcattcaaggatttgccataattcattcatttcaatcagttccaccagtactaccaaaaacggactcggccaggctgcgagaggcatggacagcaagtgagaggcactaaagcctaggaggacacttaactgtaggtgcaaccaaggccctgaccatgcacactgccggtgatcaggacagtagttcaaggaggagtgagatgcacgtgggacttgcccttgtcattcagcagcatgtttatgagatttatccacgtcattccagccaccttcattcaggttaactgccacataattcactgttaactagcacttccttataccaggcactgttctaagtctttggtatattaactcatccagtcctcacagcaagcccctgaggtgaaaactcttattgcctccatttacagaggaggcaactgagtcacagaaggcctaactaacttgcctacagtaataaaaagaagcatgcggtaaagctggggttagaacccagtctggcctcaccttttatttacatatttatatttatttttattaaaaaaatttttttaagatttatttattttagaaaaagagagtgtgcacaagtgggaggagggacagagagagagaggcggggggcggggaaggagactctgtgctgagcacagcacccaacgtggggctcaatctcataatcctgagatcatgacctgagccaaaaccgagaactggacacttaaccgactgagccacccaggcgcccctggcctcaccttttaaactactctgcttcttgacagagcagggtcagggagtgcagatgctggttgtatggctcctggggtcaggaagtctctctgaacagatggaatttgcacagggacctggagggggtgagggagtgagccacgagaatatctggggagatcattctacaaagagggacaagtgacttgtgtaacgtcctgttatcagccagaagcagagcaagaagcaggaccagatttcctgacttttattaaggatctttacctctttcagtatatattccattaggactatatcatggctcatccagccattctgttgatgcaacagccttgtttttgttataaacaactctgccatgaacatccttgtttgtatttcatgcccacatgaatgtttccctaggatatgcattcacattagcattaccagactaaagtattctctgaagtggttgtaccaatttaaccactagcagcgtgtacaagttctaattttcccacaatgtcaccagctcttggtactgtcagacctcaaagttctaagtcaatctaatgaatgtgatactatatctcactttactttgcttatttaatcttcctaccctgattggtagtaagcaatgttaggcatctccgtgtatttattgcctgtttgcgtgccctcttctgtgacttacctgtctgcttgtgaacttctcctgccttttttctctaccattatcttgttctctttaacttgtagatgttcttgatatagtctgtgcatgaattatgtcagttttaagcattgcagctacactattccacttcgtggcttgtcttcttatttaaggatgtctgtttttcactcagaaaattttagttttaatatagtcaaatgtatgaatcttttccttttaacaacttctgtgttttaatatcttcactttgttacaatgagtcctatattttgttttaaaagttctaaggtgggacacctgggtggctgagtggttgagcatctgcctttggcccacagcatgatcctggggtcccgggatggagtcccacattgggctccccacagggagcctgcttctccctctgcctgtgtctctgcctctctctgtgtctctcatgaataatttttttaaaaaagttctaagatttcttgctcttccattaatctagctggaatttattttgtggctagtttgaggtcaaaatcaaaaattttcattgttttgccacatgataaccaatttccccacaccatttataggcaactgttttcacactggtcagctccctctagtttcattcaaggtcctggattctcaagggtccatccctggagtctctcttctctcccactggcaaatttgtagatttctgcaccacatctcgctgttttaatcactgtagcctattgtgtatggcaatccctctctcctctgctccttttctaatttcatcttcaactattgcctctgttattcatgctctttctttcccccttatgaaagaacttgggattttaattgaaattatgtcttcccatttataaatatagtctatttcttctggccttttatgtcatttaataaggattctgtgtcttttattggatttattagtttttgttgctatgaagaatgggttcttttttccaatggcattttctaatctaatcgattattgttgatataaaggagtgttgattgtttttgcacatcgatcttgttttgagcaaacctgtgaatgttcttaatagttccaaaagtttattgatagattatttcatattttatgtgtaaacaatcaccgtatctccatataatcagaggttcatttcttttctagaaaatctttgaagtgcctgggtggctcaggtggttaagcctctgattgttgattttggctcagatcatgatcttagggttgcaagatcaagccccacgctgggctctgtgctgggcatggggcctgcttaagattctctttctgtctccctctgcccctccccaccatcatgtgcacatgttctctctttctccctctctcttaaaaaaaaaaaaagaattctccaacacatggcatgcagggcttctctcctcccggtcacagccctcctcttgttccagtatgggctttctgccctgggagagcatgtttatttccctcaaatgctaaggcagcagtgggtccaccttctggaaagtgtgccaagctctgtgataggaccaatttggggtatatgaaaatgtttgtaaaaacacttagcacagtgcctggttttcattagtaatgcagtaaaggtttctgttcattcattcatttacttaaagatagatggtcttagtgacaactggtgggggattcaggatttccaagctggacaaaactgggcctgggaacttgtccccagttgcataattttgaaaaataaaatttcttcttattcaagaatggggatttggtggacttaaaaccccatccccgctttagctacttagcaccttttcccccataaaaactatataagcaagcccttccttccttccttccttccttccttccttccttccttccttccacaagtgttttctgagcatatgcttggctctgcagaggacacagagaacacaaaatgaaactctgtcttcgccctcacggaacttacagtctactcaaactcaaaggcagctgctgagtaggtacaacacaagagagttccaactgaatgttgaacaattcaaaggcttaggagagcagaggaagggaacaacacctccaatggtaggaagcctcgcggaagtggcatctgagctggcacttcaaagatgaggagaagctccacagggagggataggtagggcaggagcctagccttctaatgaggaccaggcattacagcacaacagtaacacaacgggggaaacgtgatgcctccaggaggtggtgaactgagcaggttggctgatgtcggggccttgtgcgagagtcacagaagcagctttgtctcagcaagagttgcccaagacgggaaagaactggtcctgaagaaaggagcatctgccctcggagaggcccacacagaacctggaagccacctgtctggttgctgctcccatgggtccccttcatttggtgcagtcactgagatgacccataaacccgaggactccagattccaagacctaaaggaacagggaaaaatattatttatcttgtgactcatcgtaaacataattctaaaaacaagaaaagtttccatgataggatactatccatacatgccataattttattttattttattttattttattttaaagactttatttatttgagagagagagtgtgtgagagagcacaagccaggtggggaggggcaaagggagggggagaagcagactcctcattgagcagggagccccaacacagggctcgatcccaggaccctgagatcatgacctgagctgaaggcagatgcttaaccgactgagccactcaggctcgcctcaaatgccataattttaatattctcttcctgtcattaaaacgacttccattaaatcagtggtcctctcagctgcatattcgaatcaccggggtgctttcaaaatgtccactgcccaggcttctcaccaagtgaattaatcacattcccccaggatagaacccaggctctagtgtttattcaacccccagcagattccactgtgcagccacggtggtgacccagtacgcgttgaaaacctacgtgtaccacttccctaagactctatgaatgtctgaccaggcagtgggaatgggttgggcatttcatatgcaaacctgcaaaacgcccatcacagtcctggactaatggcatttctctgtctgattattaatggggaatggcttttcccaggataaagagaaactgttgccttaggttggattagattctgtgaattcctctggctgggccataaatgaggaagactgattttgtgaaggggttggtccatccctttctcttggaccatccccaggttgaaaccacttttcagagaagccagtggacacccctggcccagagcctcccctggctgtctttatttttctcctttacaaccccctcctggcctttaacttgcaaaaaacagctttattgagatataattcacatactgtacaattcacccatttaaatcatgcaacagaatggcttttagtatattcacaaagtggtacatccattatcgcaatcaattatagaacattttaattacctccaaaagaaagcctagataccttagctgtgtcacctctcaattcctatattccccccaagcatctgacagtcgataatctactttctgtctctgtagatttgtttaatctggacatttcatatcaatggcatcacacaatatatggtcttttgtgttcaatttcttttatttatttatgcattctaaaatattttttccttagattttatttatttatttgagagagcgagtgagaacaagcccgggggtgagtaggggggcagagggtgagggagaagcagactccttgctgagcagggagctctatcccaggatcccgggatcatgacctaagctaaaggcggatgcttaactgacccaaccaccctaggtgtccctcagttaatttagcagaatgttttcaaatgcatcgtattatagcctgtgctagtgtttcattcctttttattgttgaataatattctattgtgtggatatgacattttatttatttattcatcgggtgatttacattcgggttgtctttgctttgggctattatgaataatgctgctataaaccttcatgtacatttttaacacttattaataacttttttaatgaaaaaatttcaaacatgttggagagggcaatacctcgacccccaaggacccatgttataactttagtagttaattaccagcatttaccaactggatttcaaccacagactccccgccccactttgttttgttttgttttttatattttttgttttgtaatgattttaagctcagatggaagttgcatggagcctcgccaggctctgttttctgtgccagtgttccagagcatgtatctctgtgcagataaggactgtgagcctgaggaaacccaagggaatgggacaggttgatctgcttgcagcacagagagtgtgtgtgtgtggggtggggggtaggcacctgcttggtagaggggactgttctccagctcttcccccctgggtgaggggagggaccaggagacagagctgcctttcaactgagatcatcaaatgactttgttttgttctctaaaagtaattatcttccaatattgtcacactgccttctcaaaaatgccaaccctggcctctactctcaccacctccaaacacccaaaccactaaataaaatattaaaagggtggggcccaggatccgggctgggtttgggagcttttcttttcacttccacagtaggcagtctcaggagatgtcagttctctacctctttggtcgagctgtttcctctctgaggaatgccatctctgcttctctccctgtggatcagctctccatcctccaagtgaatcctgattcccttcaggcactgaatccctggtgttcccacagccggctctaggataggcttgtctcaaaggccggaatcgccaggggaaagggcacctgactaggaataaggctctcgggactctgagaactggaatgtcccacagtcagattatgagcctagcttgccacatgcattattttcacatggtctttcacagtagagtttagtagggagggaggtgctacagggcctgggcagggcaccacggcaccgttacatcctccacgtaaaatgaccttctggttttctctcgagagatgttaccctcccaagacaccttcccattttaccctactggatctctttccatgatctctagtttacccacagaatctatccacctgtcctagcacttgatatacaatcttatttcagatgctgcatcttatttcatcagctagattggttgagcaatctgagatcttatgggtcccaaggcttcacagactgcttgtcaaacaagaaatcttgataaactcctcacgattgctggccatgggcaggcatgaccttgaatgggttttcgcatttctattttggggttcacctgactcttagataactttgtacatttatggatatgactttacttataatactagaatttcatagaaggaaggtcaaggagtccaactttttcattttaaaggtaattgtatttagactttgtgaaaggaagtaactggctgaaggcagaccttgcttaagccagtgatttccaagctgtgttctgaaaaaaaaccaaagtcctatgggaatgagggaggttgaggggtgggggagggagccagggaacagggagagaacacacactgaagctctgggaccttcctcagcttcaaaaagtatagtcctgctattgtccattctttttaaaatttcatttagaggaagttttccaagtgatttttttttttaagtttcaaaaaccactgtttgagtataatccacttaatgtgcagacaaagaaattgagggccagattctggctgaattacagtgagttcccgcagtgaacaaaacactgtctgccctcataaagctgacattgtcttggtgaaatcaagccataaataaccaaacacataaaaaaacatcagcatgcatgctccaaggagaaaataaagcagaggaagggtgtggtgaatgattaaagggtgaagtttcaggtgtgcaggtcaggggaggcctctctcaggcagaaggaagggaggaggagccacatgagctcagagagaagaatgtgagacctatggcacaggctgagagacctatggcccaaatgcaggctgagagacctatggcacaaatgcagttgaactcagctgtccttctggacagaaaatggtctttaaaaggacctcgcaaagcataggagagggccggcagagcagtaggggccctgccccacatccatgggcacagcaggacccagcaagaccctcccatggagaaggagtccaccacagctgtttggtctgcctcccacatgtgggccagtgctgcctcaggcagctcctcctaccccagaaccaaaggcctcctggggcacttggagccaagggtggctgaagttattgtcactggcaggtggctcaggtgtattctccgcactgggcccagtgcggtctcaggggcatgtgctgggaggacaagactactttgcaagaaccttgactctggtaactcctttctttttttttatttatttaatattttgtttatttattcatgagacacacagagagaggcagagacacaggcagagggagaagcaggctccacgcagggagcccgacgtgggactcgatccctggacccgggatcacaacctgagccaaaggcagacagacgctcaaccgctgagccacccggactgcctttttttttttttaagattttattttattttattttattttattttattttatttattttattttattttattttatttaaagattttattttattcatgagagacacagagagagagagagagaggcagagacacaggcagagggagaagcatctccccaattcttcaagccaggaaggagagcctccatttcccctgtgcgtgcgtgcgtgcgtgcgtgggtccgtgtccctgtgtgcctacgcgccggcacgcatgcgcatatgtgtgtgcgcgtccctgcgaaaccctgggtgggccctggctgccgcgtgcgcctccagaggccgagtgtcttcatcagccgtcatccccagttacctacctgcccggaacggccgcgtttcctgtacagtcactccgctctgagtcctgccttgatgtcgtgctattaacagctatttatcaagccctgagagtgtgcccggcactgtgctcagcgcctcgcacgaatcacttgctctaattctctcgcaaccccacgaggcagacactgtgtttagacccattttggaaaggaggagacaggtgtttagagcggttggataacctgcccgggtctatacagcagagccaagagtgagctctctcttttgcttctaccttctccgtcctccaatcacgagttcacatgttgctttgcgagcagcgggacagctttcctgccaaactctgcccaagcaattatttgcacgttgcctaagaaagtgagatcacatgacataatcaatgcaaaaaatgactttttataacatgctatagaagtgacatcactgcatggtgatggttgtaactcactacggtgttgacatcagtaccttttaaatcactcaaagcaatttgtgttttgcatgtttaacatttccagccaagtggataaaggttaatttcccccaaacaatcctctcgactcttaagttgaagagaattgaatggcaaatctggtcaaactctgtgctggttacacagtagaaacatctaacgatttggaaaacaactcagtgatgtcctgcaacccgtttcccccaacgtccgcaggcgtgagctgagcccctgctgagtggcaggctctgtgtgtctgacagccctgtcatccgtggtggtttgtttgtttgtttgtttttaatttcaattatgataaacttttaattctggaatattgctagaattacagaaaggttgctgagatcatacagagagtttgatatgttcttcacccaattcccctccctaatgtgagcatcttcataactatggtacacttgtcagcagtaagacatcaacgttggtacattactgttaataatagatttcaccagtttttctactgatgtcctttttttttctgtcctaggatctaatctgggatccctcactgcatttcatggatccatttctttttttttttttaaatcactctgatttggtgactttttttttaaagattttatttatttattcatagagacacacaccgagagagaggcagagacacaggcagagggagaagcaggcaccatacagagagcctgatgtgggactcgatcccgggcctccaggatcacgccctgggtgcaggcggcgctaaaccgctgcgccactggggctgccccatttctattttttaaaaagatttttaatctattcattcgtgagagacacagagagagaggagaggcagagacacaggcagagggagaagcaggctccatgcagggagcccgatgtgggacccgatcccggaagaccaggatcacaccctgggccagaaggcaggtgctaaacagctgagacacccagggatcccctatagatccatttctaaaccaactcaactcagtattaagatagcattgtctttcttgcttcactttgggattaacttcagcaaagatagcaagctccatttccaattctatagggaaaacaggcaaacaacggataaacaaacctccagaccagcttgactcccatttgagtcaagagttgacccattgctccaactctgaccttgtgaaaccaccacattaggaagaatctcctcctctgctccagctcagggctttgtgcacattgatcgatgtgggggcagcagccaagaccaggcttgacagagaaaactgctctgtggtttactttctcacaacccccagtctggctgagtcactgaagtttctaccttccttatcagccgttggaaagatccttaacagcccagtagaaaagatattctctctctctctcctttttttttttttttttcatttttatttatttcttagaggcgggggagagcatgagtgggagaagggcagaggcagagggtgaagctgactctccactgagcagggagcctgatgcggcgctcggtcccaggaccctgggatcatgatctgagccgaaggcagatgcttaactgacggagccacccaggcacccctagaaaagacattctttgatctcctttttcagctcattctttcactcattttgttaaacatttattattaatttattaaattgggcatcacgggtggctgggcggtttggtgctgcctttggccccgggtgtgatcctggagacccaggatcagatcccacgtcgggctccctgcatggagcctgcttctccctctgcctctccctctctctccaatctgtgtttctcatgaataaataaataaaatctttaaaaaaataaaaaaaattattaaattaataaacatatattaagttcctacagtgtgccaggtactgaattaagtgctggggcgtaatggggaacaaaacagaaatagtctctgcttgtgaaacattaaatagtttatttattcttgaatactgaccaagtgatcaactctgagctaggcaatgatgggagagaagggtattcttttttttttaatttttatttatttattcatgagagagagacagacagacagagacacaggcagagggagaagcaggttccatgcagggaaccctatgcaggactcgatcccaggaccctgggatcacaccctgagccaaagagacgctcaactgctgagctacccaggcatcccaagagaagggtattcttaatataggccctgccctgtcttcaaaggatgcagctagccagagagacaggacaggccactcaaaacagactgagctaaattgtgtggatggtaaggggagacagagagtgactcctatggcatgaatggagagagatggaggtaacagaccggaccatccgaagtgtcggacagcgggggtagtgaatgtctccaatcaacagaaataaacttttgttatcatggtgtttgaaagagggaggcatgggtgttcctctgcggtggcaccctaaattgagcatatctggaatgaagagatgttcagagatggctttctgtctgtagagcagaggctcacatgaaggtctcttgactacccaccccctcatacacaaaacaaaacaaaaccagcttttaagactaaagggtgactagttcacagctctcacattatcccaggagccccctcagtagtgcagggagaatctggagggtaggacaggccacagcctagaaaggagacaatgttggtttctaccttggggcaggatcccaaagagacttctagatccaccaaagaaaacagagagaaaagagcaggggcaatggccctcagaacattctgaggttccagaaaaccttctggatacattccctgactgcttgttttatctcaaggtgatgggtagatccttcagtggaaagctggggagagtgtgcccaggttctgggggagaggcacacaggcagagtgaggccccaagtgcttggaaagagccccaggggcaccttgataggaacctaggtgaggaaccagtgggaggcactgctgtttccatggcaacctgaaatttaaaaaacagatatgaacttttaaagccaattctctagcaaactcttagggttagaaaaaggtctgtgtgaaagattgttattatccgtaggacagtattggtttggggttttgttttttataagtgcttactaggtcagacttgttttgcctttggctgaagcctataatgcattctgaacagggtagaaaaatgtgagttttgtcatacattctacttccagcttttgttaacataggctgtgacccagggtatatccacccttttcatttctctgtgcatccagccacccagccatccggctgtatttattgagcttaatcttcatttgggctcaatttcttacctgcaaaataagagaaatagtctggtttcgcattttgacctaggctcctagcaccttaggagtttcaaggtggtgctttcagcagtcaccttcctagggtgggatggggcggcaggcagggtctgacaccccacttggcttcaactgttatggccctgttataagccgttatatgtattggatttccacttgagatttctttggaacaaaggctccctgactgaaaaatcgctgccccagaagatctccatggatcttccctgtggcaatactgtcgcttcaagccaaactgttttccagtcaatgcccctgcagtgcagggtatggaaatagaatggtgaaggaaccagggtcactacccctcgggggctcgcgtcactgtgaggatagactgagattgtaagcgtgaaaacccgctcgggtgaaatgactgttgttaagataataatttttattactatagtgcagtcgcgcagtggaaatatacccatggggaaaggcagccgataattcagcctgcagttagggaccaggtaggagcagcagactcccaggggctccacacagggcctcggagaattgcagggctttcctgggaacgcagctctgctcgccgccgcctcccctggggctccccgcgcccgctgctgcagggggcggcccggggcgatggggggggggtgttcgctgtgattggctgagccggaggttgttgctaggctaccagtccgcgggagactgggccacgcggtcccatcctccaccgcagatctgtcccccactgccgaccccaatcggccaccccgtgaaggagattccccagcagtttaaagtggcagctgccaagtgcccatctttctaggattttttcacttagcttgaggtctggtggaggaggggaagagaagctgttttattctccgatcgccttgaataagctgcttgcctttctggccctcagtgtcctccttcgattcctgaggtcccttcatttattcattatgcatgcatgcattcatgtttattaagtgcctcccatgctcccggcaccagatcaggcgctagagacaaaaggataaataagatagagaccatccttgctctcaggaagccgggatggggatggaggtgggtgaagcggtggaagacattagacatttaagcaaataaataagataataaaataaacatttatttaatccctttccttcctcttcagtgatatttctaagccctgtcccttttccctgctaaatctgtagggttccccaagttgacaatggagggagtgcagatgccaacagtgcctttactgcattacagctgacctacctatcaccttactgtgctctgaaacagagggacactctcatccccacagtgcttgctcttttgcatcccaaaggaagcctgagcttacctcagcaaagatatgaggcagcaatcatcatggtcctctgttcagatgagaaagctgaaagccagaaacatcaagaagacttctacatggtcacaagaattactagcataacctaactgatagtgagcacttattatgcacagagacttaaataaaacaatctgcctcataacataacaagtcagttaagttattattattcctattttataggtggcaaaattgagactggaagaagttatttgacttgcctgtgatagtatgtggtgaagcctgagcctttctgagaaatggagctggtcctagaaaagagtaaaagactgtctgagtggctgagacctggcttccagatgccctttaaaatctcctagtccccagatcttgtttatttattttcctattgaaattcttggcacaagagactcataaaatttgatgaattggccacagttaccaatacagttgaccttgttgtcgctccatctatctgggatgatcctgccttcaagcttttactgagtaatgatgttgagtagctcttccctgtgagcatctccatcgcttgcttctcctccctaccaggttttcatgtttctttgttcacatactgaacaaacattgggcacccaccaaacgtcaggagaggcttgatagtggatggatactcagaaaggtgagtatccatccttgaggagttcccagcttacagcaaaggtttctgaagggccttccataggcaaagcgcagtgataggccttagagaggaaaggaccataaggatcttcccccaaagaatcttcttcttggcttgggagacagaccgaacttagataataaaaggtgtgaaaagaggtgggaggaagcagaagtgaatgtagcaagtgtgggttgggggtgggagagccaaccttgagtctcctgtggtgctgcttttaaatcccatcttgccgtggtcagtgtgggaaagtgtgtcttagagcccagcagcatgcagcttggaaggaggcctttaaatgggagaaggtgctggaaagtacagagatgcataaagaagcaagctaaatttatcccttctcccagcacccagcaatcgctatgcttaacacttgactttctaccaacagagacttgtttaaccagaagattagtcgcttctccctcggctgggaaaagagagaaaaaagagagagacacatttaagcatcggccttcggcttgggtcataatatccgggtcctaagtttgagccctgcgttgggctctctgcttgacagggagtctgcttctccctctccctctgtactgtctctctctcaaataaataaataaataaataaataaataaataaataaatctaagaaagaaagggaaaaaaaggagagacagtcaaaaagagacagaagaagggatggtcagagactctaaagacagagacacagagagacctgaaaagaagtaggagaggcagggatagaggcggcctctgctacagagtaccagggagcagcaggaaagaatttgacactgggcgcctgagtggaagaaatcagacaatctcctgccccctccctccctgactacatgatcctggctagagcactgctaatttctagaaagcacaattttcagatgtgagtatcctggagatgtctgtactattcctattgtcttggtcactgatttgtctctgtcacccatcaccactcctgaatagctgagaatggactgtaaatgggtgatacacaaaagccacgattaaaataagcaatacaagatgaaatatgcatgcctttgacctagcatttccacctctaggaatttatcctaaggacaataattaaggacataggttaaataaagggggggggggcatgagattattccctgcagcattgttcagaaaagcaaagagcaaactacatagctaacccctaccaggcacctgctcagcaaataatggtgtaacctgacaatagctttccatgccgcttgtaaattgggttataaatagacacttattgatgtggaaagatgttatttattaggttaaaaaacccaaccaagttacaaaataatgtatatagtatgactccatgtaagtattattattagtaagaatacatataaaacctatagtctaggaagacataaactagatgtaatctctggttggagagatgcccagacactttattttttttttcttttggcatttctgtattttaaaaaattatttttgccacaaggaacatgtgtttcttgtgcaatgggaacaaatttccttccatcaatcccagtgagcatctcctgcggggagtccaggtgtgtaggggcaagctgaaccagttgttcctggctcagaggcattgtgggaaaggccaaccaacccatgcaaggccatttgagctgctcattaagaattccacaaacagcatgtccccagcctggtttgactcccgtcctgactggtctggtgggcaagaactcagtgacgtagccactcggtatccacatgcagttgcttcgtaactaccggtgagttggccatagctctcccttgagggaaaacgctgttggtacaagttggcacatggtaaagctaatcttgctaaaaccctaggtccttcccacctcccggggacaccttcccctgtaacaggatgacggccagcatgttctgttgctctggtcagtctctactacacagatgcagtttgattctgaacgttgggaggcgggaggccgtcactatggcaacccaggcttgctcggcctctgggatcagtccaacacccgggaaagaaggtggggtctagagtcagaacaaacattgcggggctatctgacctcacgcgaggcacttagcttttctctgcctcagtttctacacccataaaatgatgctgaagctctttatcctacccacctccaggataaactgtaaaacatggaaggagtagcgcagtcctagctttcatttgtcttcaaattgctgtgtgtgagtttgagagaatcacttaacctctccatggctcagccactctatttgtaaataggaatataacatccactgtgatgacttcccagatatattgtcaggcatctgtaagaatccagaatccacatgttggaaggaatcttagcactcacgcaggaatccctttgataaaccctctggctgaggtgcctgtccctcctttgcttgattacctccagtggcagagagctcatgactgcccaacttcccaaataaccattgctaccatgacactaattgtaagaaagttcttctgtataggatttcttacagttaaatatttattttaaaacattggcaatccttttccgagctattgctgcttctgattttgccagagggcttgcacagggtagaaattagcagcaactggcaaggagcaggtccaggcccagctctagaagcctgtggtttagtgtaaagggaaggagtgtgggttctggtgtcacacaccccaggttaaaatcccactttgttcaattgccaggcagctggtcttgggccagttatagtatctctctgagctgcagtctcctgatcagtgaaatgaggctagaaatgcctacctcatagtgttgccaggagaatctggcatgataacagttctcatcgaaattacacccttaacttccgcaggaaattctagggattgggaggacaggtaacaccttctctgtgatcccctgaacaacacatctgcccgccaagccccatctggcacatgtagactcttatgtgacctgactgtgctcctctcagaaagagggagaaagttcctctccaggcccttgggacacctgcagcctggcctggcgcagtttgtgctccatattttacggccttctctctctcaggcctgtaccaggggtcctaaagggaagatgcatgcaatggtttcaagacacaattcactttccctataattcacctgcctcagggccagcaccccctccctgcccacagatattgtgggcactaagctaagtgtcacagggtgtcacttgatgaaggctttcaactgtatcagtgtgtttatttaatttttttcaaagattttatttatttgacagagcaagagagagagcacaagcaggggagtggcaggcagatggagagggtgaggcaggctcccactgagcaaggagcccgatgcaggactcgatcccagaaccctgggatcatgacctgagctgaagacagacgctcagctgactgagccacccaggtgcccctgtatcagtgttttaataggaatctcatatagggcaaaaagtctctaagactccaaaagaatgtagtctggtggtagatttccatgcaagttggggtaggcatggggtcctttgccctcaatatgaaaggggtcaggatgcctgcatcaagtttggccatcgactagctgcaggctccctggagccagtgacttaattcttctgtgccttgctttcctcatgtgtaaaacgacaggttgattccagagaccaacactgcctcagaattctagggtttcccgtgttggctgcagcctgattgccactgacctctcttgtccacaagcagctgacctgccccctcctttctgcttcctccacagatgagtacctgagagtcctcaatgtaggtgtggctgaggtgaagaaatccttcctggggcccttgtcgccatcgtgcaagatggtgcagctgatgcggcagtttctgtatagggtcctgcccgaggactcctacaaggtcgccacagggaagctccacgtgtccctcactcggctcacggacggagagagtgtcgtggtttcagagtatacatccaaggaagagctcatcgaggcaaggggcagggcctggaccaaggggtggggcccagtttggggaaacagtcccccattcttggaaggagtgaaatatcaccaaatgggttatcacttaggaaagggcactctgggagcttattctatactcattaatataaatcttagttatgaattattattgttggaaagtgctgtggatatgcccagttttcttttgggacaaaaaggtcaagtggcatgaccctctgtcccttatctcccctcccctctcctctctggaatacaaggcccttgccatgcagactcacagccccatgctggcatggccatgatcttgggggtgaagaatgaatggcagtaggcatggacacctccttcacctacctcacgtcctcctggatttattagcactcagctcttcaagacttctctctcctggccacctaccagctcccactcttgctcctgccaacgagagtgaaccatatacaaagcagacctctgtacctttgcacctgctgtgccatctgcctaggatgcctttcccccctcccagcttgcttcacctgcttaacaagacactagtcactctgccttggaacttaccttcatcatctgtctgccccgcactcccctgggctgggcactcctccttaggggccgcaatgcccatgctcacttccttcacagcccctgtcacccttgtactgtcacctacttgcttactctccctcattgagcattctcaagggtgagcatcttaccctcctttgattccagagcctggcccaggacacacacacattaatggttgctgaattccattgaattcatggagatatggggctagaaggaaccctggaggtcactgaggctgccctgtctctttaaaaccggaatcttggggatccctgggtggctcagcagtttggtgcctgcctttggcccagggtgcgatcctggagtcccgggatcgagccccacgacaggctcccggcatggagcctgcttctccttctgcctgtgtctctgcctctctcaatctctcatgaataaataaataaatacatcttaaaaagaaagaaagaagaaagaaagaaagaaagaaagaaagaaagaaagaaagaaagaaagaaagaaagaaagaaagaaagaaagaaagaaaaagatacctttaaaaaaaaaaggggggggggatcttgggaccagactaccaagcacgttcacagggacgcagctctttggggccaggccaggaattgaacctggggctctggtccccataacagtgcctctgtcttggatttaagaagggccaggctgctgaggaggcctccccatccagccgccagagcctcaggcatctctgctggttctctccccacaggcactgtactgcagctgctttgtccccgtgtactgtggactcatccccccaacttaccgtggtgtggtgagtgcttcggcgtgggagaggatgagccaggacccaggagtgctctggggcccataactgggagattagaggggtggtctcagaattcagtgggaagaccaagagttggaaagattcttgtgtttttctacttctaattcccagtgtggatggatttctggggctttgaggtgaactttccctccatacattgggcttcactctggacccaccaacccattactgagcctggctagtcaagactccataggcttgctggattttctcacacttgacagagggtgtagaataagaccctgtgacattggtaccggaactgtgattgacaaggacctttaaagtcatctaggctagagtacatgaatcacctggggtcagagggagtcatgtaaactaatgcaaattctaattccctaggcctgggccagggccagagactctgcccctcagaccagccacggctaacgccagtgctgctggtccacggaccatgctttgagtaggaggatctaacccatgtctcttcttcattttatatggaaagaaaatgagatccagaaatcaggattcagctaagagatggagcacatattgcacatgtcagccgtgtacttctcaggcaccccagagaagtatttgtggtcctttgttcaagattgaggcaacagaagccccatgagggaagggatatgtggcggccagtggccaggccagggtcattctggagagtgccagggatacctgacctcaacagagggaggcagtgtagacacacagcagtctggagaggggatatttcccagcctgctcagacccactatgtgttcacattttcaaaaggccatgggaacaggctccattccctggccctgcccttagcagttgactggctcaggaggggtagcctgggagagggagctgtgactggggagcatttgttcatgctttatccagattataaatgtccctctccctgcagaggcctggaagccccagtctcaggaccatagagatggctgaggacagacagtgagggacagagcactgggctgggggttcaaggatcacgtggacacaccacttacccacctggaccttggtctcaaggcttgtcccaagggactcatttcctgggggtactccttgatgggggaaaaggaactctgatcccatgagcatttattactctgcctgccccccccatagcgctacattgacgggggcttcacgggcatgcagccctgctccttctggaccgactccattaccatctccaccttcagcgggcagcaagacatctgtccccgggactgccccgccatcttccacgacttccgcatgttcaactgctccttccagttctccctggaaaacatcgccaggatgacccatgccctgttcccgccagacctattggtgagaggaggggcccagaagggagggagaaggtgacagggcctgggggtagggttggggagccaatggggtccatgcatttccatttgtgtctccttaaacttcctcctaaacctgtatcctcgctttgctgctacctagctatgtgaccttgaatgaggcccctatgtgctctcagcctcaattttctcccttgtaaaatgagatgatatcagaactgctgataggaatcttacctgaacttttccactctgacatacaatgtaggcaacagcagccatggcccatgagccaaatccagccagtggcttgtgttttgttttcaattttcaatttccaaaactgctcttaaaaaaataaagtctacatgtctttccaaatgtatgtctttctccaacacagaagggtgaacctgggaacaggcaccacgtttaactcactttttttactacactcaccatgtctgcagaaggcattgcttatagaaggttctcagtaattgttgtttgaatgattaactcctctgagccagttttgtgacttgcactctaattattgtttacaaaactcataatcaaaacactattacacttagtcaggctatggatacacaaggtattttattcatctgattgactttgtcctccaacagttgcgttaggaattccagcatctgccttaaactaattctttggtaaagattatgtctatttactttcttaaaagcaatccacaaataggcagttcaagaaagatagaacacaaataggcagttcaagaaagatagaacaaatgcattgtattcgtcagagcctctagaacttgagtttctgctcacaatcagtgcctgacttccattctcaaggtggcttatttttatatagcctgtgagctgagaatgggctttccattttcagagggttgtagaagtagaagaaagagaaggagaaggggaagaaagaaaaagaggagaagaaagaggaggaagaagaggacaagaacaagaagagataatctgtggctttcaaagcccaagttattgaccatctggccctttatggaaatgctttgtgagcaatgataacccatgtaatcctccagaatcctttgcaatagatactatcatattcccattttacaggtgaagaaatcgaggttgtgagaggctacagccacacagcaccaggatttgaacccagtctccaaattctgctcttcttatggcccaaatgcaccttctctggctctgctataaatatctctcctgcccaggggaagctgatgatcagctagaaatggtttaacacattaatgcactgtcactatggacccataatctgcaactgctccccacttctcagcagatagtgaggaatggaacactggatgggtacattctgaaaaatccatcaaataaagctcaagggccatgaggtgaggggacctcggctctctccattgctgcagccttagtcactttcctgctgtcccctccttgcagatcctgcacaactactactaccgagggtatgaagatgctgtttcatacttgaggcggctgagtaagtacggggtagggcccccaaaggggtgggttggggggtggggtaagacaggaagtagaagggctgagtccaggagcattgtcctaaaaagagaacccgagatgcccttccccaggagggctgggaatgggtgcaaggacctggcagcttgcgttgtccaggacacaccactgtggccaaacattaggatctccatggaaaagtggtctttagggtcactgctgggacagtcgatatgttttcatacaaatatatttctggatttaaggactgtgtttaggaaacaccatagcttgtatcttcccggaacattccattttcaggtcatttcacttcattctctttccaagacaattgcattgttaatgcagaactagacatgatgagtttatatttgggtaagactccaagagacattgatcaacaaaggagagggtctgtgtccaacaaatgttggtttagcaaatatggtcccctacacctgcaaatggctccgtgcatccttgcctggaagattccaaaggcatgtattttacacgctaactccacgaagaccatggcaaacgtccctgacaaaaggaaagaaaaaaatcttttgcatatttagaattgtttccatagaacatatttccagggggaagaaaggattccgggattggatggtgtttacctaatgctgttgaagtgggggtttttgtttcccaggttgtcatgtggtctttgtgactgtcttttttggcaatcctgtgatattccatgacagttgaacagaaactttgatcattcctttgaatttccaaatgttcactattataagcaatactgtggtgaactttttgtgtacatagtttaaaaaaatattttaggagtgagttaagggattgaatgtgggtttttccctaggatgtgttggctatttttccttcaaagctgcttcctgctttcccaagctccctttgtcttgactctttcctttctcctagggccattctccgaacaaggggtggggagaaaaggatggagggactgtgagttctggaggcaagtaggtctgggccaggattctcatcccccctggctgtgtgaactcaaggaaatcacttgccccctctgtcttgattcctaacctgtaaaaaggattaaattgttgttcctgacacctactaactgtgtgatcttgaacaggtaattcatcttctgggacctcagttttctcatctgtataagggggctgaccatggaacttacctcagaattatattcctagacacagtcattccagcccactgaccctgtgacataggagtcagggccatcctctcacctccctgggggagagactcctcctcaccccgactctgcttggacaactctcctcttctccacatttacatgagtgacatctctgaaaactatgccaagcgtccaaaagctggaccacctgaggggtgttagtggagggttaagatggagtctcacctatggagcctccggaataggaggggctggtgagggcctggggtcctttccaccaccagctgggaaaccccttcactctttcctcagtgatggtgtgtactggggatgtggtgttgggggatcccctgatttgggaccaattccctatgtcaggagacccctctacctctcaggttccagcctggctgcctggctaccaccatacctgtctttcccctaaaacttctttctcttcctctcagggcaagcctaaggagagttacaaagtgctttgctttagcatctctggtgtccctcactcctcaatagcctctggaaggaacccagtgccatctcatgcccccacactcttctacccttaggtgatatgaacaccatggtctaaatggcagtcttaaaccgaaggatgctctaataggagcattttgggtatccatgaaagaatcagggcagagtatggaggctggtgggctttcccaggggccatggaatcactccaagtaggaactgacacactgtgtaaggaaaaaatgtctcttgctggctactgactattttttattcctcttccaatttgccagtgtttgcatggctttctcagtgcaggtttcttcagctccaccctagatcctcttaggtttggtagggctggattttcctcccagcaccagatgcgagcaggaggtatgacgcatcttgagaaattgtggccagtgcccagagccacactcttaattcccacctcccatctgggaacagaaaaaaacgagagtccgccccagcctcccacccaccctactgctttctggatgggggtcagctccagcagaaggctacacctgcaaagtgtcaccctcaattcctccactcacatcctggcatctccctctgctgccctccttagggctcaaatccacctaattattcctgctgccaggcgagcttccctctccacccttggcctcccctggcagcagccttctgccaaagggaagggcactgcttgctggcatgcttgaaaatccacattccccacacagacatgtggacgtgggtgctgagtgaggttggagctcagaggatgccatgtctaaaataatccagctggcatccaggcgtgcctggccagaccaacccatccatccttctttcctccttccctctccctccctcccttcttggcattcttccttctctcacaatttgttaagttctctctctctctctctctctcacacacacacacacacacacacacctacctatgaaactaataccacaatcaagagagtgaaccattatccatcatgccccaagttttccttacgttcttttgtgacccttcccaccttcccccagagtccccaatctactttctatcattagagaaatttcctactggacttacagtatgggctctattttgtctgcattctttcactcagtataattattctgagattcatcatgttattgcatgtataaatagttcattcctttttaatttccaatccatttatgaaaatcccacagttcatttctccattcaccaattaatggacatttaggctgtatccagtttgggctattatgaataaaactgctgtgaatactcatggagtctttctatgaacatatgctttcatttccttagggtaaatacctaggagtggaatgtctacatggtatggtaaatgtacatttaatctataaccgtatttacgtaacatacaatattatatgtgtataattaaggtaaatgcataacacaaaatctatcatcttaactattttttagattttttttattttttaaaaatatctctacactcaatgtaagttgaactcacaaccccgagatcaaaagttgcacgcttttcccactgagccagccaggtgccccactatcttaaccattttaagtgtacggtttggtagtattatgtatagtcacattgtacaaccaatgtccagaactttttcttactgcaaaactgaaactctatacccattgatcagcaactcctcatttctccctctcctaggccatggctaccaccattctattttctacttctaggagattgactactttagatacctcatatcaatggaatcatacagtacttgtctttttgtgactggtgtatttcgctatcataatttcctccaggtttatccattttgtagcatgtaacataccacattttctttatcaatgaacaatttgaattgcttcttcctcttggctattgtgaataatgatgcaatgaacatgggtatgcaaatatccttgtttcaattctttgggatatagagtaaggacatatatccagaatgtatgtttaactttttaagaaactgtcaaattatttatcgaagtagtcgtatcattttacattctcaccaccagtgcagaagagtaccagtttctctgtattatcaccaacacttgaaatggtcagtcttgttaatcttagctatgtgaatagttgtgtggtggtatcttactgtgattttaatttgtatttccttaatgactaatgatgccgagcatcttttcaggtgctaatttgccatctatattatatatcttctttattgaagtgtttaactcttttggtcatttcccacctagacttacaataagctttatttttaaaaatacttttagatttccaggaaaaaatatgaaaatagcatggagagcttccatatactttacattccctattattatgtcttacatttgttatatgttatagtatggtatatataaaatttggtacatagtatagcatcgtgtttacaattaatatgctaataatggttattattaactgaagtctgtatgttcagatttccttacttttcaacctaatgtcctttttctgatccaggatcccattcaggataccacatcacattttaccatgatgtctctttaggttcctcttatctgtgacagtttcccagactccttgtttttaatgaacttggtagaatggagtactggaatattccttagttggggtttgaggttgcctgatgtttttctcaggattaggctggagttctcagttctgggaagggagatcacaaaggcaaagtaccattctcatcacattatatccaggtgcatgctatctacatggcttattattcatgatgttgggcttggccatttgtctgcagtggtatttattgggtttctccctgtgaagttgctctttctccccctttctctttgaaaagaagtaactatgcaccacctgcttaagggatggggagttaagcttcacttccttaaggacagggtaatctacaaaaattatttggaattcttctggttgggagatttgtctcttctcccctatttgtatacttcttcaattccttgtttgtttcagtatggactcctggatactcattttatactttgggctattattcaggtttcctttatttattttgctactcaaattggttcagctttggccattggaagctctttcagtgggctcttttgcccatcttaaaaattgaattgtttgttttcttatttaagaacttttatgtagttcagataaatgctctttatcagaaatatgatttgtaaatattttctctcagtctgtaatttctcttttcaagttgttaagtcttctgaaaaggtatttttaattttgatagggcccatattattaatttgcttcttttatggattatgcttttggtgtttaatttgcttcttttatggattatgtttttggcgtcttatctaagaaatctttgccttcctcaagatcacaaaaaggttttctcctatgtttctttctagaagctttatagttttttggtttttcatttgtgtctatattccattttgagttaatttctgactatggttcaagataaaaaacaaagttctttttttttgcatatggatatccagttgctccagcactatttgttgaaaaggctatgcttttgggtggctcagggtttagcgtctgctttgggctcagggcatgatcccggggtcctgggatcaagtcctacatcaggctccccaaaggaagcttgcttctccctctacctatgtctctgtctctctctctgtttctcatgaataaataaataaataaaatcttaaaaaaaaagactatgctttctctgttgagtagccagttgtctctatatgtcatgggtctatttctaggctttctgttctgtgccattcatttatttctctgtctttatgtcagtatcatactgttttgatcactgcagctttatcataagtcttgataccaggtagtcttggttttccatctttgtttcttttttttttctttcaaagttgtttaggctattccaggttctttctaattccatataaattttagaattagcttgtggatttctacacaatgtagtcgtgctgtatttgtcttggcaacctattctctcctcctctgctatcaccaccctaacacttccctactccctgaccttgcctccaaacaactttacaaaagaaagcaaaagccaacagagagttctctcaactttgtgctaccaaatatacaaactcaccttgctttgtttccctccttcctagaacattaaaggaaacaaccatcttcttgcctaaagcccacttcctacctgtgctcagacccttcctcaactcaactcttgaattatccattattccatctctcttttacatatccaccctccacctctcaactggatccttatcagcaacttgtaggtctaccccaatcttgcctattttagaaacttggcctaggttcctctctccccctctctttgctcagtcctggcttcctcctcttctcactctgcttttcctccctcagcaatctcctccatggacaccatcacagcttcagtgaccatccatagatgggactcccaaatgtacatctctaaccctcatgtcttctctgagatccaaattcatgtatccaattgtccacttgtcatctctccttggacatttctaaggccccctaaaatccacatatccccaaactataacctttgccctcctcactgcttccctgacccatccccttcatggtcaccctgccagcaccagcatgcatctggttgtgcaagccagctacttcctctctttcccccaatcaatccattgccagttctcatttattttacctcctaaacagaatcttctatttctgtctctctccttccaagcacaagtcctaaacacctctccacagcagccttacaggtttcctggggcctctctgcccttttcagtgagtttccacacagcagccacagtgatcttcttaaagccagtggcagtgcagcattcccccctacctataagtctttcaaggtttccatgaaaaccaaagaccctcaatgatgtctataagcatggtctggcccctgtagcctcctcagccccatctcccaccaaagtacccctctccaaccacactgacctttagcccctcctcatgctccctcaaacctgtggcatttgtgtgtgccgttcccactgtctgaaatgcttctcatcccaccctgaccaccctctggaacctcacttgcccttcagatctcagttcaaatgttgctccctcagggaagcccccctccccccccgaggaaatcctccctgctatcatggtcctttcttgcctaggacttatcttggttaaaatgagattatttacatagtcaatgcctgcccccatgccagactgtaagctccaagaggccaagaaccatcacatctgtttttgtccacttcactcctcagcgcctgctataatgcgtggcacatacagatgcacaataactatccgttgaataagtgaatcaatacacaatataaatttgagcacattctgcttctgaaaataatttgggaatttttgcaaatttggcatttttgcaaatgccagactgatgtcaggggttagtaaagccaccagtgaccccaggctgttgttttcctagatgctgcttacatcaattctccctccaagagagtgatattcccccgtgtagaagtgtactgcaatatagaacttgcccttggcaacgagtgccacgaatgcagtcagtcaagcctccaaacacagcagcaagaatccatacaacttcacacacagagggctcctgaaggagaaggaaagggcagccacggttcacttccgtcctcacctgtgcagacacccggagccacatgtgagtggcctgtagagtcacctgtttcaccacctgtcccttcacttgagcagtcacctgcaactccactggcttcatcaccatcacattctgcagctgacctgccccctgcttcgctcccagctgtacccttaccactcagctcaacacttgagctgtcacgtgtatcaccacagcagcaggtacaaactactggatcgccaccaagatccccaccttcccagtcatctctgtcacacaggccacccttggggccttcatctgtaggggcatctcaaacactgccccaacgttcttcttcagcatcacctgcacagccacctgtggaggaactaggcccagaacagtcccaaggtacagacccttctggcttctcacagcttccttacgtctggagcctctcaacaagtgtgcaacaacatggtagctgataaccattgcttcggaggggtgcactggtaaagttagcagtcagctttagcagctctacctattttgaggataggccaccacaagggaacagtgttcttgacatttgttcatgtctttagtccagtgattttcaaaggttggtctctgaccaacagcgaactcatcacctgggaatttgttagaaacgaaaattctcaagccctactgtagacctactaactcagggggtgggacccagctacctatcttttttatatgccctccaggggattcttttgagaaccatgtttgggaaccactgtaatggaaggtttttattttgtgataaccaccgtgccagggcagtgctactcaaagagtgctctgtggaccagtgctggtccctaaactatttgttactaatttacaatgaaatgagcacagaagttaaaagtaagcatttagaaatgtttatagccatgacatccaagagtttggtcattttcttaccagttcattgtattgtatttcacaaaagtactagtccattatggattacaaaaaaaaaaaaaaaaagatttttaaaaagctggttcttcataactggtttcttccacagatagtttgagaagcattattctagaggcttcaaagccacacaattctcagctcctcactctcagaaaatctcccctccagcaaaggggatgacagagataccaacctcaaaaatacaagcaagagtcattaagtacaacattactaaaaagagtattggaaatatgcatagagattaagattacttctctctggggaattaaggaaggcttcttgcagctgacaggtgagttgaaatgagcaagattttgaccatcatggtttgtgagacaggatgaggcaaagtagaatgagaagtttaggctttgtttatcctagaggctcaggtacggagagggaacgtgcaaggtacgttcaggatgaagaggatacctgtttagctactgaggatggtccgggtgggggcaacaggagaggagcccaaatgatggactgaagccaggtcatagggtctttatgatccatccaccaaattcccatagttattagggtaaacattagcaccaattagcacgatggtttccttcttggcagatctgccccaggcaggggcacattttctctagaatagatttgactcttttaatcacggtgggacaaaaatatcaggacattaaaagtaaggaaattggcccaagtgtttcacatgctttcttatttgctgttaagcgaaatgcatttctcttatgttattcacacctgtgcctaaagtcctcttcaggtagcctgagcaatcctgggccctgagctggcattccgtgctcagattggggatagagggaacagattgtccagtgggtctcaactaggagtgattttgtctcccagaagacatttggcatcaaagacatttttggttttcacctagtgggtaatatctagttgattgtagatcaacgctgctgaacactgtacaatgcacagcctcacaacaaagagccatctggatcctacattcagtagctctgagatggaggaaccttgttacagtcttcaactgagccttagtaaggacagcctaggccatctgtgggagctgagcagaagggagcctcttcagaggctagtgtcatctgtcatttagtgatggccatgttgttgttgggggtggaaggggttgcaaaaaagtttcaggaaaacccataagcaagggagcttcaaatagatttgggagtgccagagatatccaatgtgacccccaaatgaaagaacttcaaatagaactaatatgttttatattatttttatctacacatattacaaaattacataccaacctttatatattatatacccccatatttacataaaatatgaaaagcacttacttaagaacaatagtcatgggtgcagcacctgggtggctccattggttaagcattctactctggatctcagctcaggtcttgatctcagggtcatgagttcaagctccacattgagctctatgctggatgtggagcctacttgaaaaaaaaaaagaacaatggtcatgaaactagtaatgttttctattctgttaaaaaggaagaaagcattatatacagataaagcaggcgatggaaagttcaggccccttagggggacttttcctgaaaactcacactaaagggctgttttttgtgagggaattgttgataacattgcattaattgataaattacatcgattattgataacattacatcaaagatcagcatctgtcctgccacagatgccactgccctgggtctcagtcaaatccaacaacgtggttctggtcctaaacatgagactttgagattaagagagctgtttattgtttctggacactctcacttacttcctatttttatttcaaaaatgactaagtcctcttccctgaccttacctcactcgtgtctcttatttttgactgcagctccccttgcctcttcaaagccagaaggtaccacacctttggttaatgtgaaggaagccaccagcaagcctcatgcaatgtaaatttctccttaatcgtgacacattctttcctttggctgagggtgggggaagtaggggggagggtagctaagtgaaaatttccttttctttagttgcgctagaaacactgggatccttttccagtttgtgtgattacattccaagcctttacattctctcttcttcagtgggggcaacgaatgggaaatgagttattcatgctcacagtgtcattctcttcatctccttgctgtgccccctggggaatgtgccttctctgagtgtagtaggagaacatgcaccccctcatgtcttattctctggtagtgtctcagttcaagggagctagcaggcatgctacatactagcctgaggtaggctatttcctgcatggtacgaattgtgagactctatcaaaggcctcctttaatccaaatgattttctatcaacacagtaagagggctgatattgctatgttgtagattgtccccagaaaatcttttttataacacacatcaattgtctggattgtgtaacatgttctccattacttagcttcacagtcattctgagaggcctgaggattagtatattttttaagatttatttttatttatacgagagagagcacacatactgcatttgcaagcacaaggatggggaagggagaggggtgtgtaggagcagagggagagggagagggagacctatgcagactccgcaatgagtacggagccccatgtagggctctatctcatgaccctgagatctcgacctgagccgaaaccaagagtcaaagggccaaccaactatgccacccagtgccccaggattggtatttttaagttccttggggaccacattacccaggctcccttgctggcttcttgttagttgggttagccagtagaaggcaccagcaggagattagaagatgggctaaagaatatctctcccctttcccaacctcatccttcccgccttgggcagttctggcaatgactattccatggccatggctgcagctattgggagagcaggtccttttgatgttccaactccatatcatcaaatatattaaaacatacctgcttctcacattaagtatcactttaattataaaactttttgaggagcagctgggtggctcagttggttaagcatctgccttcagctcaggtcatgatcccagggccctgggattgagccccacatcaggctccctgctcagccaggaacctgctgtgcttgcttgctctctctctctaataaataaataaactctctctcaaaaaaaaaaaagacttttcgtaagagtttgcataaatttaagaattttgtgctcgggcatatactatgcgttttgttcacatggtttaaactttattgcattgacattgaacttataaaagtttaattgagtttcagttgactagttggcatgatgttacttagataaatagtcattggttataaaacgaatatttgctgtggaactctggtgtcagccagggttaaaagccataacattggcttgtctgtctaccttctgagctggagcagggccctgatagtgaaggacacaggacgggtcattaacaaactatttacttcatctattgcccaggggaaaccctactgaagactccagttggatgagcaaggtgttcaagaagaacaaacaaaagacaagtagcaccagaaaaggcttcccaagacacccacgatccaaaaaaacaggcggcaaagtgcagtgagcatgactaatgtttttcgaaatccacggggaggaaaagctccgggaagagtctgcaggaagatcacaaggggcagaggaagaatcagcaggagcaggtgttaggagctggactttggagtcagacccacccaatataaactccctgctctgccataatcttgctcagtgatcatgcttaggacatatggtctttctaagcctctatttcctgatctgtaaaatagggataatattgtgagggtttaatgaggccaacatgtaaatttctttgcagaatgcaagatgtgtaatcagcactcaataacttagtaggtattagggttatatgcagaggttaactacctgcttctcagtttctgaatagaactctatttacaaaccaaactaaacagatgtgtgactgtgtgaccctcagcatatagagatcctaactgttgccaagctacaactaaaagccctaaccaatgtaagcctgcttcttacagcttttttattatattatattgtcattgatccatcaattaactttgattgagcacctaatgagtgccaaccactcttctgggctctagagatagtaaagattaattgaattcaatctctgactttttaaaaaacattttatttatttatttgagagagaagagagagattacagagggagagggagaaacaaagattccctgctgagcagagcctgacacagggctcgattccagcatcctgggatcatgccctgaagccaaaggcagacatttaaccaactgagctacccaggcaccccttgatccttaacttttaaaaggttaccccaaaattgaacttaagaccaaagacaataaccaagttttaattttttattgaaatataacattgttttttaaagggacatgcatatatacatacatacttacaaatgaaaaatgccagcttcaaacaaaccaagccagggatcatctacaactattttattggattgtcaaaatattctctgaatggaacagacccacactgctatctactttgcttcaagcttccattggtcagaaaaatccctagattattctaagcgacaaccttctgtattgttcctttcccaggtggggatcccaggtgagcagagagctgtatcagggagatgagggtcagaagcttgccctagcatctcaagttcactttgaggtctgggcaagtaggtacttggtgggtggtgggaaggagattctcaggaatccactgcaggaagtggggcagatgcatgtgttactttctggattaaaggacaggcagggaaggtgcaggacccagtgggcagttggcagtctccttgggggtcatgaaattagtgaatcctggaattagtttcactctgttccttggtatccagccccaagtcttctttgacttttgagcgtctgtatctctgttgctaggagctcaaggtcaattttggccaagagaccatgggcaggtctgctgtgggggtggggaagcttccttggagctgggagtgccatctggaagccaggctcagagttaagtcccttcattccagagccaggcttcctcctatacatcggagcagggggaactatgtaattcagccatagctaccctggtcgttaaatttctaagaatcaaggtgctttataaagaagaaggctatgataaaaacaaacaaaacaacattcacagctgtgggaaacactgttgtcagtaggtcacacattctgtctgcggcattcctttatagaacagattacgaaactgcctggaagcaatttaccaattgatggtctcaagcaattccatgcaaattcactgctctgagcttcaaagaccagggtaggggtaggggggtagaaaagacaagttgaaaaaggttaggcatagaagaggagtgatccagaaagagagaaatctgctcatttcctcccagagtataatcacaagagagatggtcacatccatgggctagtcctgtgcaactcctggcccccagctgatattcctcccaataaagaggagagaagctagaataaaagctacagagtagatgttccatacattaatctctctctctctctgtttcttaaagattttatttatttatttatttatttatttatttatttatttgagagcagagagaaccagtgggaagggggagtagagggagaaggagagaatctcaactagactccatcctgagcatggagcctgacccagagctcaatgcagagctccatgatacgaccctgagatatgacctgagccaaaatcaagagtctgacacttaggggatccctgggtggcgcagcggtttggcgcctgcctttggcccagggcgcaatcctggagacccgggatcaaatcccacgtcgggctccctgcacggagcctgcttctctctctgcctgtgtccctgcctttctctctctctctctgtgactatcataaataagtaaaaatttaaaaaaatatatccatatttaagagtctgacacttaatcaaccaagcctcccaggtgcccctccttctgtgttttttaagtcagatgttcaagttcatactctgatgctggttattttagtgagtagttgctgttttataatgctacctaacaaacacccctctccatctcaatgggttacaaagcaaatgtttattttgctctttcagagttctgtgacttgtctgggatagctctgcttaggctactggttggggtcgagtttgatccctgtccctttcattccaggaccagcagatgtgccagatatgctctgcctctggatcatggctagatacatgtctcagcctggctttcctctgctagtttgtctctcctccagtcagatttcagcagtcgtctgatccgggttgtgtaactggcctcaaagtggcaagacagattgagaaattcagggactgcctacggctacaaatggaaaaggaggaggtcccacttgctaactgccactcaaatcctctggactgctactgtctgtcagactcctcgaatttctaacatttctacagctagaaagcccctccttttagttactatggaatttccccctattcaaatgagaatgtgatgataatagctaaaacttagagtagttattatgttccaggcattgtggtacagagagggtaagcaacatgcccaaagtcacacagtaggtaatgacagagccaggatccgaatccaagttgtctgtcaccagcatcttggtgtcaagcactaagtgatatagccttccagggtaggagcaccagagtgcatcggaagtcacagggtctagtcctagattgtctgtttggcagggagggtgcacttggaggtgcacagacacggcagggatagcttgggtgccatgctaacaaggttggacctcacctgtggtgctggggagacatcacagggtttaaacagaatgacatggtcagatttgaaaaccatccaagaatgtaccgtgtacagtgcacacgccaacatttctctgaggtggactctgcaggaggcttcctacaatatccttgagagggccaatgactggccagggccacacagcaagtggaagaggccttgaaactcagggcttcccattggcccccttgtctcatttgtcctcacacatgctttcttggcttttcacatccaggtctgctccctgtcccctcgacttcactctgctctccacttccgagacagtttgggtcacctacaggcctcatcccagccagatccaggaacacagctgtcctgaggtatggaactgtccagcatcaccctggaggccacacacgacctgctctgtccccatatgctgcggtgacctctgagcactgttgacccagtttcctttctgaccccacctgcctcttcctggtcacagtcaaggccaaccctagcgcatatagttactcatgtactaagaaaacagtaccctttccgaaagaacttgattgcgagctgctggatgatcttgataatacactgattttgttaaaacagttgactgccacctgctagaaatctgtatgaacgacatataaagctacaaaacggtacacataacatacaaaactgtacaaataacatgtggcataaataggtccatgatatgtggccccgttgcattggcagtttctccttgtacagtgtacagtctgtacaactgcacaactcagcactctggaggccattccacttcttttcccttctcgaaaagccaagtattaaccagacttttgtaaatctaataatgtttcaaacactcttttatctactcctgctctgcaaatggaattctccatttgcaaacaaaaacaaaaacacaacaaacaaacacacacacacaccccacaaaaaaacctcttgtataacagtgggatttgctaactgactttttggtatagattgagatttccaatttacacacatcaagttggctataatggggcctggctacttgcttggggctgcccgaggcataggaagctatgagggatgttctcagcggaaataaggggaggaaagtcctagatgagggacttagaaatgatgcatctctgtcctttttctaggaagctgtgaaccaagagagaacttgagctggaatgaaagagaacctgttgaccgcaaggtagagccttctccccaaggctctcagacacattctcttcacctaggccttttggggatcagatgtcacccacgaccaagcctgttcgtgcagagggtcctgcttctcctggtcaagcacctccttgtctgaacaatctctcagcttctctgcggtcctccagcccttccactactctgctctggacagatagatggacaccaacatggataggctctgaagagcccacagcacatcctgctcccatctggctgggctctgggccttcctcccagcccagcctgagtttgcttcttcgagatggaccacatcaattctggcccacccgggatctagtctacagggccaagctcttgggggttgagcaagactgagcatggatgcactttcctctttcctgtggtgtcaagagactgagctctttggttttgtcttgtttttcattctcaagtgtaccaaaggcttgatttggaaccactggactcggcctcagctgctcagtggaatcacttgtggagcggatctggcgtgaggtctttaagagggcttgtgcagcacggccatgttgagcaggccaccctgggcttccctgagcctggtgtggctgtggaggaaatgggaggccaaatgccccttcccttcccatccccagaagggcggcacgaggacagactctgctgttcacacctcagtgaagacatcccatgacaaagatactctcagcctcagtttttccagcctgtcccccccaaaattagccccacttcttgctggagcatgggtagcttccagcccccagccaggccccataaggaaacccaggctgcccacaggcctcagatgtatttgcttagcaaattccagacgactgagtggaaaacagctttgaacttggttggaacccctggaggaagcatgcaaatgttagccatggagggtggagggctgtggcaagggggcctggtggagcctagtctaatggggccatgtcccggagcaggagtccacacaggcagccttaagaaagttcttccaggaagaacctaactgatgtgggaaacaaaggaaaaagaaaaaattaaatgtccttgctgcctacagcccattgacaaggccttgaaacaggcagagtgactttcctctgggagctcagctgcctccgtgttgacactctcctaagggcaatgttactccgaccccccaggatttcctttaaacctacttttacatataaaactccctttggaaacttcctctatctctaaccccccctcatgatacatgttagcaaccatcctccaggcacatggtccactgatctacatctgaaggggctcttgatggagtttttactaaacgataataaatgaccttttcctaacaatagccagtgccctcttgctccctcaggatcctgaaaagcttgtttctaaaatcgcttggaggcttgcaccgtccctaaccccctccccacttgaaagtatatagacagtcacagctccccagggctgttctttctgcccacaggtcctgtccccctgcttttaatcaaaccacccttttgcaccaaaaatgccttaagaattctttcgcggctgtcagcttcgaaccccaacatttcctacatcactaactgtacctttgagaggctcaaaagggtcaaatctcaggtgttcttgcaccttctgcctacctgatactgataccctgatgctgtggctcagacgggtcaaggggagcacccggggactgtgtagcggggaggagagaggcccctgcagtggcccacctggctgtgtctcctgctcttgtggtttgcaggtggctgcgtgcaggggggccgggagacacgtgaaccgggggagggagggtttcattcccacgcaactctattccctggcgtgcaagggggacttgaacataacaataaattgttccaaccgaaagcctgtatttagagcccaaatgccctgatgttagcgttatgttactgtcagaggttatcgataaaaccccctggatactttccttcattttgcttatttcccttttcccctttacaaggtaattaggagaattgttcttgcattagccccaggcttgccagataaaatacagggcaacttgttcgatttgaatttcagaggaatcattactcagtaagagtatggccccagcatggctattatttgttgtctatctgacattcacagttaactaggccacccatatttttatttgctaaatttagcaactctaattatctcctttctccttataatgctttttttttttaaagccaatactagtagatcgttttttgatgtgccagtcactgtactctgaaattggatgtctcaggctgcggaggccaagggcagaccgctctggtcttccaaacaagcatatctgaatgacctctccagcccaaccctccctgataactcagctaacaccccggaactcaaccaggtcttggctgaccccattatctctgactcactcacttagcctcctgacttctcagggtcagaaatgaggttaattttgtcctgaggttacttacccaccttttcaaagcctttcagagcagcagggtctcccatgcatctcagcgctcttgaaagcctcagcggggtgagttaagggaaccccgccctcacacagtagtgtccctgccaccctatattcttactggcactgaagtcccgtaatgagtaaggtctgtgaacaacctgagggcagaggttgtgccttttgcatttgtgtattccacagagctgggtcagatctggcacgtagtaaatgctcaataaatattggttgagtaaatgaactactgaatgagacagtacccggaggcactaaaacaggggttctgggagctggatcctgtcctggttctgtctgtagggggccgcgggaccttgaacaaggcgtctgcccattctgagcccctgcttcctcgtctatgaagtgatgtgctgccctcttctgccctcctcagatcattacagggagccttcaaggttggggagtggaaaggtggttgggaaagaatctgtacaccagagggccgccttccccaggaagccactggaagaattcatgcattccttgagcaaggggagaggaggtcttcgatgcctttcagcagagaccatattctctggaccaaaacccagacactgtatcctgtccatttttaccctggttctgagtgagagtttgggcaccaaaattagggacttactaaaacagatgatgtagaatcaagactggcccagatattcttggactgtcatcttggcaggcacagagttgtagaatgtcaggtccagaggcaagtctcatgtccctgaggtcctcagcctgcggggagttagactaaaacccaggtctcttgatgctcagggcactccacgactgtcttaccaagttggagcccaaggatgggacccctgggtagcagctggagagggacccccagctggggacagggaggctgaccctcacagccttgcaggcaccagactggcctagatgtggcaggtgccctcacaccctgccaccattgtgaataatccagattagacctttgtgcaaggcaatgtctttatttgcttaaataacacagtacaaaaatgagactcagatgccagcatcaggaactcataccaaatactcctacaactgaaaggacatcatcccaaataagaaattatgtacagaaggttcctgaccttcattacagaactgattctgcccctttacatttaggggttgtgttcttgacactaaaataaatccataaatagctcatctctccccaacttcttaggatcggcaataaaacaagatgacttcagaatatgctttgttgaacttcctaaaactttgcctccggtttgaggccagtcctgtctaagtgcccaaggccgcaccgcccttggttttactccctctccagtcctaccctacagtgatcaccatgggttcaacacgacaatgcagtgtccactataagggtaataagaatgagtctagattttaacactatctcccccatggtcatgtgttctgggcaatgtccaatggctatgtttatagccctgttgggcatgcagggacgtgtgcaaattgcccatctgagccaagctgttcaaactattcagctttgtagaaggcagagcctctaacagcctacacctcacctttgtgcaaaaacaaaagggagtccctttctcaagacttttctgccatgaggcagaaaactattatcataaatctataaatctacaatgtctaggaagtgaatagcatttcctggggtatggtactcttgagcagtgcacacccatgcaaccatccctggcaatccatcttaaagcccttccctatttcctgaaaactacccagttgtatctgtaataagaataacaacatacatgaacatagcaccatgtaattttcagaactctccatattcattttctcactgactcttgacaaaccctcatgagatgggagaagtgcaagacatcagcttcacttctctggacatagaattatagtattacagcactggaaggattctgagagaccgaggatccccaattcacaggtcttctctatctgaggtctgtagacttcctgagaggtgtctgcacatccatgtggatattggtaatcactgttggtgaactgaataaattgcttgttgcacatggatgcacatctagctaaatgcatgtgggtattctggtgggagattaaacaaaaatttagatagaaaactaaggctcacttgaaattgacatctagaaaatgccagccagcttttcacatgatagtaggtattgttttagcccctaagggtcaagaaaatacatgatagtaaaaaataagggtacctaagtccatactagggttggccccagaatgtgaaggccttgaccccagcccccaatttggagatagaactaccggttgcacaatcccagttgaggaccacggccttccaaggaatgcctggtagaagcatctggatctcaggagctctcatactcatttgtctgatcattcattcattcagtgaagacttaaggactgcctccaactcagtggggtgtatttagccactgagtgaaagcctgactcccccacccccaccccatttagggagacttcagcatgatagagtccaaagaggtctgatgggtcacatagtttttgcccagaatccaaggtgtggagaaggtgacaagtccaggatcttgcagcaagtttggggcaggtcaggaggtggagctctggtctcctaactcccagtacaatgcttttctttccccgacatggcctctgcctcctgctaagtggaagagggctttgtgtatctcagtctcagtaagcccacaagggcacatggacacagatggccatccatacttgtcttcgttcatgcctgtgaagcactggattgggatattatgaagcatcttcagagggaccggctaaagcttacagttgctcaggtagttcaaggaaacttgagttaaaagtatagcttttaatctggacttccggtttcaggacttgtgatattctgagaggagaaaaaagaacataggttttagccatagctcagttactcatgtgtcccactctaatagcaacagacaatagacttctaattaacatattaacacaccacactagctgtcacctcgggtctttactcagcagctcttgccttatagtgccctcctggccttttctccccatcaacagcctccccaccctcaaaggccaaaacctatgcttgccacctcctggaaggcctcccagatcaatggtttcactggcctcagttaccactaatttggcattttactgaaacttaattttgtcatcaggaaacattctgtctttccatataacagaaccatacagaggccctccagcatctcacacagctgggcccagtggaggctctcaatacttattggttgaatgaatgaaagagtgagtgaatgaatggttagtaaaaccaaaagctggagctagggctactgaggaagtcagagctgttgtttctataatatctttcacaaagaactcagatgactccataagtttttatctaacccatcttagagggcaaattatccataatatcccccatatctgggcaaagataatgaggctgaggaaagagacatcgaaggtcataaggagttcccaccaggaaaacaagtcaacataaagcagaccatttgaatgacaagaaacgagtattatgagatcagagctttcttgagaaacttatcatatgactttgaaaggtaattccaggaaagactgggtgtttccataatggtgacatcattgtactaaagatctaaggaccgtttggatgtagaagtcctgtttggccaatgccaacagacagaatccttcctccctttatttctttttaagatttatttatttatttattcatgagagacacacacacacacagagaggcagagacagaggcagagggagaagcaggctccatgcagggagcccggcgtcagactggatcccgggtctccaggatcaggccctgggctgcagggggcgctaaaccgctgcgctaccagggctgccctctttttttttttttttttttaagattttatttatttatttatttatttatttatttatttatttatttatgagagagagagagcatgagcaggaggagagataagcagactccctgttgagcggggagcctgacagggggctcaatcccaggaccctaggattttggcctgagccaaaggcagacgcttaaccaactgagccaccgaggcaccctggggaacacttccttcctgtaatgtcaccccttcattcagtagattctgcactaaagatctaggtcaaaaggcctataggcaggttatcttaagtgattttgaaaaaagtggggaacactgtttatcagagtccaccagacaacatgaaaactcagactttaaaaaaatcagtgaggagtattatttctaaaggaaccgcctcagagccgtaggggcaggggcgaggttattaggaaaaacacgaaaccaatcagaagagtgagctcgatgatagggagaagctactatcaatcaaccaagacaaggtcagtgaaggatcactgccccctagaagccttccaaatccaacagccatggatcctcctcatctacctcaaccacttacttcacttgatatggaatcttactctgctttgtcattcgaattttatgacagtcttgaatttgggaagccaaacagcacaacccataaaataataagaagggcaagctaaggtagcaccgggtccaatattccacatccaaatcaaaaagtatggaaatgcacatacaattaggggctggagccaaataaagaagattctaatgatcaaataaagtaaagccagtgagggtttgggggaaaaaaatagatcacgtgggttagaatcatcttacaaggccttagcaagaaggtggcatttgagctagaccccaaaagtcaagaactcagcagaggaggggagaggacagtataccaatcctgttgggatcttgagctgggtgtcgcttgttctcacctgctgggcctcccgacaggggaaatgggagtagctgtgttggctgtagcgcaggcccatgaggctgaggacggcgtggctgttgttgccagcaaatttgttaggcaagccaaaggcaaagtggtagggtcccttaattagcttcctgtctgactccgtagagtgggcctgctgactgtgtagggtggctgccagcttcctgagggaggagtctgagagcctgtataaaaacctcttaaagctggggtgtcgcttgatctggaagcagagatgaagacaggccatcagtgccgctggcgagtagccccctcccaccagctgcccctggccccaactgcgtgcacccaggctggacaccttcctgccccttggatgagctcccgtgttaaatgcttccaccacccccagcctctcagaatctgttccgcaagattcaactccaagcagcagaacaaaagggggggagggtgggaagaacgtgcaggtctttgtataacagatgcttaagtagcatttactagctgtgtgacttctctgagcctcagttcagttgtgggtaaaatggcagtaataatacccccacccacactcagcgttgttcggggaagggaattaagtgagatggtttatgtaaaatgtttcatgcagagtagatgttggatggatttaagttcccactctaagtcgcttcctcttaatacctaaatgtcctaggttgggttcccccagagacaagggcttaagtgcagttggtttatgtggtcagtgatgctgcaaaacaccaacagaggatgaggatccaggacaaagatgggaaggaggtccacagaggttagctactgagcctggtccttgctggccactccaggagtcaacatagagcacattcctcagagttatcccctcaaggggcaagggagctaaagtatgtatacaccagctcccagaagccatgggctgctcctcagaaggtggggggtgatcattctggcttactgtgtggatggtaaaatgattctaggggccagtcctcaggcaaaaggatgcaggtgctggcagtggggagctgggccagtgagcactgtgatggtaaggtgaggcactcacagtgtccctatgctcatgactcatctgtgacctgggctcatatctattgcttcatatgtgatctgtgtttgtttctccaagtagactgtgagattttcaacaagagaactttctgttattggctctttggcaggagaggcaaaatctaaaagcttgagacaactgctgatcataaagatgctgaaatgtgtgccaacagagagtgaaaagaaagctagtagaggacatgatcaatgggactggcaggcccaaggaaagaggcttcaagggaggtgtgaacatgagttgaacttcaagggggatttggatcggggaggtcccggaaggcggggtgagctgcatagacattatattaagctaacatttatctcatctgctatgtgactggcattttctatatatgcactaaactttgtcaagtaggtatataccccccattttgcaaaagagaaaaccaagactcagagagtttaagggacatgcccaaggtcacctggatgtagagatggggattgaattcaggcctgagttgtgggttgatgaggcctccggggccagccttgggggtactgagtagtccttacctgctcccctaactggccatccacttcctggagaaggtccgccagcctctgaatgatcatctcctctacagaaaataaagaacgattcagaggccattgacaagttctgcaacaacacaccctcccactacagacggtattttgtctctaaaacacagtacacagatgagttttgaagggcaaagaaaaatcttctccaaaactagggctggagcatgagagctttatttgagtttgctttataggaattgaaaagactttggccagtcgagcctcacctcagctccatttttacaaatgtggaaactgagatcacccaatgtctcctatccaggctatagagtagcatggtcacgaatgggagttgggaccaggagcagctaattagaaagcagggagggggagacgccacagccatggatgtaacaagatcgcatccatcaggcggggctggaaatggccacatgcgtttgtctgatcctaccaagacccaatggcaaatattctgaatatttgcagacctttcatcatcaacagtaggcagcttgaaatcagccatggtggagacacttacaccacggaaatctgcaaaagctacatatcggggctcccccaccacacccaccctcattctgtttgccagaacaccactggttatgagacccagagcaagccgggaattttatatgaaacattcgagcaaaccagtggagcagggtgggtgaatttacatcccacagaaagacaggtgttctcacctgcaactcggccccaggagccccagttgaaaggccaaggctgcctcctccccagcctgctagagtctcctggggtgtttgtcagtagccctcccagaccctactcgaagtcaccctctgaggcccatgcaaacagaaaccccacagcagccgccccgggagagagtagggtggtactaactagattcgaacacttcatctggctgtggtccctcctctggcttatggcctctggtctgggagggtgcatctgagggcctaacaggtgccccttcggtgggcaaggactcccggaactcgacgccgtccagatctgagggcagaaaggagatggtgtgagcatgttttgcacctgtctcaaatccacaagcatatccaggtccaggttctgacaagaagctgtccaaaggcactggccccagaggggtcctgcttccctgggctcctcagggagcccccagacctccagcgcccacctcaaaggcattcacagagccttctctaccccctccagaaatattcttattttctgccaccagccccctctgcctccctcctcacaatgcaggaggaaacagagcaggcctgtccacagatcccaccagatgagcccacatcccctttgctctgtgaggctttgccaagtcacttcccctgtgtgaacctcactttctccatctgtcaaatggaaataccaagactgacttcaccggttgtaagtggcttaagtgagataacatgtgggacagtagcatgtagtgggccctccatacatgtcaagggaatcactgtatacctcatgcttcggaggagtaaaaaagcagaggccctggtcatatcctacttcatcacacccaggtctctgtggttttctattagctttcgggtgagtcagatgcacccagctgatgaacccatgcactgctctccgactgcatttgattttaagtatttgtgtgtttgtgggtgggggaagggaaggctggcatcgtgggtggtgggtccagctggcaatcagcaccccctctctcgacagccctcccacacctccccacctcattggagcagagagccagagagtggaatcaagcttgaagcagaggtcacacagctggcctagcctgctctgaaggaagcccggggccagaggcagcctctgttgccatggtgatgctggggctgctcaccaaggctgctggaggtggagggctgatggcctcccacacacaggggcagaaagctgggcctcctgtgcggccgggactctgggctggtggcacctgcagccccagctctcttctggtccttggagccatgtttcttatgtgaaaaggcttttctgaagctgctctttttctcatgggatttccttctgtagggtagggacaggttttctacagccacctctggttcctggacttgaagctgctgtgggggagatgagggaaactgagtcagggcccccgaccttgaggagattgcaagcaagctggggaaagagaccagccccccctgaaacacacggagaccccgtgtagaccagagggtgcgggtgcagcctggccagcgcgagtgtggcctgaagccatgggggtcggggaagctggcttcgggaaggcggaaggcttggaggtgggctctggaaagatggagaattgggggaggggcagcgaagttattatggcaggcaggggtgggggtgtccccagcaagggttgggaacgtcggcctcaccttcactccccactgctcctctgcatccgggagtagggcaatgatctcctggatgaattcttctaaaaaagaacaaaacggtggcttgcactcgagggtagagaaaagcttatctatggtctgtcctcacttcctaaggtccaagtggctccctgggtgaatctgaccggtctccaggctgctcatgagcttgcccttgtccggtgtcccaggccgggccctgaggacaccggtagattcctcagaagtggcctgagcagagctggtgccctgggaatatgttcatttcttcgttggtcagtgagcgcctataggtgccacgttacatggtgagcccctgcctccaggagaaggtgcctcgaggccatttggaaaggcctggtcccctcgcccagcaccgccctcctcttctacttagaacaggggccttctcaattccccttcaaggcacattttctgtgaagagcaaacaagcaggaggggtgtgggggggaaggggatctttaaacggtctccagacgcacagaactgacagtgatcgtacgaccccatccttggccctgccaatggcgaggaaacagtaagcatgctggcagccggccacctgttgaactcccccagagcccctgcctctgtccttccctctggacctctgctgaggccctgtcctcaagctgggctccatggccacaccaataacaacaacaaagggcagctaacattaattagctctcggcagcttattaactatgctgagtgccccggacgccacactgcccctgcctgctgtgctcggaggaagtcaaggccccgtcactgtctctctctgggtccgtttctcttctacatgtagaagggtcggatcagataatttccaacaggcctctaagaagaggagagggtactaactgaattccaaggctgtgttggtctgcacatcctcttcgggttcctgacctcctgcttgggaggaaagctggaagggacttggacccccactgtctgtggatgcggcctcttgtatgttatgttcctccaagcctgagaagcaagaagaaagggtgggtgtgtttcatcaatgtgaaggtgttgactcacatgcagaagttagcagaggttccaaagttcactctgtggctagaatgtgcaaaggtcttgatgcagcagaggtgagcggtgggtcagggtcaaggctcccgtgcacgggcccagacctgcctcccttatcccgctgtacttcctaacaaccagttttcctgggctctgccctcctctcctccctcccctgataacctcatccctcctccagcatcttggcttggagaagaaaggcctgattccgtggtgtgaattatcccagcagggccagaaaccccctgcatgaggccacctgcccctgtgacctgaaattctgccactggggctcatatttggtgtgaagcattgcccctcctttttaaaatctaaattcccccagccaggccaagcggctgggctaggctcttcttccccgccacccaggatgatcctttctctctggctcagtttccaacactggtgggccatgtgaccctgaaacacattgttttacctcctcaggcctcagttccctcatctataaaatggggataacaatatggctatgaacactgatcgagtatagacacgcagtacggaagtatcttattttataggtgaggagcctgaggcaggcacagggatggcgaatgatgtagaaagcgtagctcagagttcaggtgccctgcttcccaggccgtggttccttcctgcacatgctaccccctgccagggtagagaagctggatgatggagagatgtgaatggctaagggatccctcaacagtgtctgctgtgggcttagctcgattgcctgggcagtgaggtctcgcgtgtggaggtgatctttctcctcccactgccctccccacactgcttggagcagaacaaaagtcagaactgggatggcagcccttcaaacggccaattccagccctggagaaggttccagaactggaagcagctgcagtgttgctatggtgactctgagtctgctcaccagggctgctagaggtggagggctgatggccccccacacacaggggcagaaagctgggcctcttgagtggccgggactctgggctggaaacctctccaggccccgctctcttaggctcctccgagctatgtttcttgtgagaaaaggctctcttgaagttagactttttctcttgggatttcttcctgacagctggcgctgggttctgcgacaccaacaccagctgaggagcttgaagctgctgtgggagagatgagggaaactgagtcaggccctgaccttgaggagagggaaagctcctcgagaagcaaccaaagagcagccaggtgcttcggggtggccccaggtaagggaggtgagagagcccagagccggggagcactgaagcctggaagggcagacagggtttgagcatggaggaggaggaggagaggggagtagggacaggaggagggggggagggggagtagggacaggaggaggagggttgaggtcaagccgatggaggtttacacaggccctttgctccttacctcttcctcccactggtctcccactctttggagaaattccactatcatcttgatgattgtatcctctggaagaaagtgaatgcacccagttagtctttccatgtgcatagagacccctttctaatgactgtcttggacttctgggatcaacttagtcctgtattaagagacagagctttaaaaaaaacgagagagagagacagagctcttaaaacaggtccatggcccacggacatggggaaaagcaccgtgtcccaggagctaatccttctagagagactctggagagccacaggaaagggcagtaggccaaagcatgcaattttaggcaggcaatctcaggtcaagcttcaacctataccccctatttcctttggcctttacagatttgtaagtacctgctttgggtttggcaagctgtatgaccttgagtaaatctcttaacctctctgggccttcatctctctgtgaagtgtgaatcgtaatcccggtcccaattccctcagttggctatcaggccattaaggaactgtgcttggaaataatttaggagcctaataccaatcttcccacctgcaaagttccagtggggaaaattgtggaggctcagcctaattaaagtagagaacggagagactccagcagatgtaacacagacagcctgacaggtggacacctctagcacaccaagtctttacggagaaaccacaaacaacataaatggttttcattgataccctcatcaaccgacccaaagacggtatgctcagagtagcttctgctagctgtcacctgaccggtttacatgaaagaaggtgtaaacaagactcccccagccccgggctgtctgcacattttgactcagtcaaccagccaatttcctctcatgtgaaaaagccaattcgaggggcacctgggtagctcagtggttgagcgtctgcctttggctcaggtcctgggatcgagtgccacatcaggctccccatggggagcctgcttctccctctgcctatgtctctgcctctctctgtgtctctcatgaatagataaataaaatcttaaaaaaacaaaaacaaaacaatttacgtgtaaaataaacagcctgcagaatagccaactagatgccttttagttattgtttgacaaatgcagagatgttttatatcttttaaaatgtgcccattcattacagggaattagattcatagagcattcactattgattttattaagggcaataacagtattgtggttgtgcatgagactgtactcatttcttggagagacgtgcttaagtatttaaggatgaaggatcattttactgaaaatggctcagcaacaaaattaaacacacacacacatttatgaagcaaatggtggcctacatcaacaattgtgaatatatgagtatctgtagaactcttccactcttccatatatttaacaatgtatatacaatctatactcttctattccacactccttctctaaattgaaaaagactttaaaaagtctcatgctcattaacacataaggcaggaacatttgccagtggccgttctaattcctgagactcccttctgtgaaactctaaaataagtaaatgtgaccagaagccccagaaggaacaagatctgtacatgatcttgagaggaccatccaaggtccaagcagtcatccagaacaatgcattataatcatttggtatcggccacccccactgcagagaaagaggacactgtagattctgactcactgtcagtgtttttgaggtcttctccccaccggtgacctgtggcttgaggagaaatttctgctgctccaggaaccccatcctcaatgcacaaggactggggaagatcagaaccttccccacctggaagaaagatggaaataagtgtatgggttgaggggagatcagggggtgtcagggacgttcttctgactttgctcacgaacacaataaaatgacagaatttgcagagagacagacactgatgtagccagctccaggcttaaccaaaaacaaaaaatgagaaacctgccaaggtttccatttcaacccaggcattccttctccttatgaaaaacatggtgagtttggggtcatctgggtagctcagtcagttgagtgtctgactcttggtttgggctcacgtcatgattggaatcaggtcatgatctcagggtcctgggatcatgggatcgagccctgtgtcaggctgcacgctcagtgggaagtctgcttgagattctctctctctctctctcttcttctgcccctcccttcactcatgtatgctctctaaataaacaaataaataaataaaatctcaaaaaaaacccaaaaaccccatggtgagttttgagtgctctacctccaggtgcctatagtgtattcaactccagacataagagtcagaaaagaaaggcaccttggggaccagcttccttgttttagaaatgaggaatcaaaggtcccagagaagggccgtaacttgcccaaggtcacagagcaagtttattcctgacacagccaagtgtgggactggcactaggcagctggctctttccacgtctctggccgcacccatggtccacacagatggatcgatgtctggggcagggctcccctcctcacctctctccctgccttcccgtttctccctggtctttgctccttcaactagagtactgaacaacaacagccaccatgtgcggaccatgggccagctccgggccacagctatcccagcggagagcaactattacccccattttatggatgaaaagaaaacagtggtggaaatgggccttgaccgcaggctttctgccatggtgctgttctgcctagaagacatttcacagtggagctgtgcctgatggtcgccccaccttccacctcccttctgttgagaggtttgaagagcccgcttagaggaccatagcccttgagggtggggcagggggttaccaggcacggtctgctcacccttgggtgctgggccccggtcagcctccttggagcatggggtagcagccaggttgggcagccctgtttcttggccttcggcctcatgatcttgggcccccttggtttcttcagcagcatgtttcttgtgactgtgtttcttgcggctggccttcttgtcgtgggctttcttcctaggagctgtgtcccctggtgcttccggggtttctgcagacttggggaggccttctttcccctttgccttccggctggccttgtctttgggctcctcagggcctgtcctcagaaagaagtttatgatggtcttcagccacccctgctggccccgcttctgggtcttgtccttcttggtgtcctgcggaggcctctggtcactggagagaaacttcttggtctcctccaggctcagggcaccatggccatgagctgggctctggggacatctggtcccatcactggccgtctggtgaagcaccctcttggaggggggagtggacatgggcagggaatggcccttgcagttccatgactctgagtccttcttggggctgtgtgacctctccagagacctggctctcctccccaacggaggcttcttgggtccccgtggatgatccattgcactacaaacaaaacaaacagctcccttacaggatacctcccagagatgtacaggtgggctaacatgccgacccatgctccgacccaccctgcccattcgtgtgagtgaccatcaacccccaatgctattgtctcatttaaattcctcaaccatctgggaggaagggctatctttgtcctcatgttccagaggagggaactaaaccataggaggtcatgccccagatgtcacagccggtctgcaactaccccagggcctccagaaggacacggccttgccagcaacttgcttttagcccttgagactgcttgtggacttctcactgccagaactggaggatgattaattcacatttcccccaaacctccgagtttgtggtattttgttatagcagcaataggaatctaatataacgagccaggggccacgtcctgccccttgggactttgggcagctcatgtaccactgtcctcatctgaaatatgcctgagacctgcctgtctgtctcacaagacagctcagtaaatggcaactctgctcctccaattgcttgggccaaaagtttgaagtcatcctgactcctggcttcctcttgctccccacatctaatctgatgtggtttaatcccacatcagcaaagactgttggttccataaagcacatctggacccccacccgtctcctctcctcctccaccaccccatgggtaagctaggcccagctctgctcactggggctattgcaatcgcctcccaactggtctccctgcttcttccctcagcagccacgtgtttcattgttattgtctgaatctctcttccttccctctgttttaccaggtcctgtatcctgactgcctagcattcagtaagcactcattcaacaaatgaataaatgtacaacacaaacatttaggagactgtgcaatacataggtatctttggctgcgtagttaacatacaggacacatatttggaccagtcccatcttagagcagctggagcccttcctttctccatccagaaggaagtagctgcccacagaaaagatgatagaatcatctcctcctgggcaccattttaatcaggccagactatgagcagtgcacctaatttgtgtgtctttaatccgaaaatcctgtagcttcccaattcttccaaagctgttcagaaaccttttgccctttgggggaagctaaaataaaatatggtcttgaatcccaaatctgagcccctggagattcctatgtagtttagatacacagactgcctatgctactttgtaattacagctttatcatgcatttactaagtattatttagcatattccttattcaagaattacctatttacatcatgtctcctgcatttaccaactaattcattaaagtgtgccccatcacatgtccagcttagaggcacaaataacaacctataattgcaatttcagatgtgtggggatccatgtgaatatgaggaaaatacataaagagagagaagacaggcatggggaaatacagagagatttggaggtgaccgtagcattcaggatatcttccctgcttcatgcacaggtctggggaggagggacttcgaagggtggccagaggccagcgggaaccagcagcattgctggggatccacatggacaaccttgcaggaaatgataaaacgggctggggaggaagctggcaatttggaagtctttattcggtgtttaatgttccttaaacggaacttctgagttatatgaaaactttagctctccgtgcctgtaccttatgtggaaattaagtaatgttctcaaaagcctcagaggtcgccttctggtcatgcttttgaaatgtggtatggggtgggatgagcagaggaaatcatagaagaaaatattttctttcttttcatttatgcctttcaattaagcatccactaaataccaggaattatgcttggtgctagggatatattgtacaagatgcaggtggtaccctcggagggaatgctctggtcttcttcaaatgggcaccacataagtggtggtgacagtaatgctctattcccctgagagccgttctctctttagtagcacatggtcttaagagaagataaatttaggttgaaggtttatttaacttaagatccaagcaagctgagccagagatatttactgaatggtgtcagggttctctctgcttcttccatatattcctgtggtcagggcacattggatggggctggccgagaagcagttcgctaataaaaccaccgaaccaccgaaccagcgaaccaccgtaacacaacagaacacccttgttcaggagcggggagggggcttaacacagagagagggtgggagcatccttcccagctaatggggaaagaggcgcagtaatccgtttaaaagctgtcattgccatgggaacggtttccaccatcggggatggtcggatggtcgcagtgtcctcctcctgcattcaggggacacgccgagattcctaatcacagcatcggtacaattccactgggcgatggtttccttcttgatgttttctcaagaaaactgcctcgatttggccaccctctctccaaagcagcaatgccctgggcccagagggaggcgatggagcagcttagagcagcacctgaggctgggagaggcctttctgagtgtttacccagagaagagtgactccagtatctcctgaggcctcccaattccaaatccagggacctcatccttccctaaggtgctacagcatttgatacgctcttccctctctaggcggccgtgacccagctcagtccaccctcctcctacctctcagacctctcctcctctttcacactctaaagatcggccaatgccagccccaggagttgagacggtgtggctggccaaggaggccaagtccacccatcccccagggagacaccccagaagagcccccctttggccaaagtgtcctcagacttttaaaatctctcagccctaagaggactgtgttttcacacacactccacattctacatgtgctggaattaaatctttccagacattctgattgtaaagttctgcctatctagaattcatcaaagcaagatgttctctttccttcctcttttttccacgtttcatgcccctgctctgcctgggggtccacccacgttcagcctccgggggaattccactctgtcccggaggtgtgtccagaccagtaaccccaacactgcagccaacccctactgtacagaaacccagctattcttgtaaaccggtttatgaccttggcagaaaagggacttcggaacaaagtccgagcctactcagaaactcccaagcgatgtgcaaatcacaggacttctgataagacgtgatacaggccagtgacgtgttacaaacaaccgccacccaccagagaaagcccacagagctgaccttgacttaccagggagcaggaagtttgccaagttctgagcgtgctgctcttcttgttgcgctgtctaaatgctgcgctgacctcatctctataccattctctaatgtagtcctctggctccatttctctgtaaccgctctggcccagttcacagagatactctggggctgcctttatccacccctgtgctttgcacaatagatattcttttttttaagattttatttctttattcatgagagacaacagagagagagaaagagagaggcagagacacaggcagagggagaagcaggctccatgcagagagcccaatgtgggactcgatcccgggactccaggatcacgccctgggccgcaggggcgccaaaccgccgagccacccgggctgccctgcacaatagatattcaacaaacagctggctactccgagggagtgtgtacggcacccacatcggggccccgcgtcaacacccacagacgctcattgtcatggtctgaatgttagtgtccctctgctgcaagttcatatattaaatcctcacacccaatgagatggcattaggaggtgattaggtcatgagagcaaagccctcctgaaagaaacaggctccctggcccctcctaccatgtaagggaaccacgaagcccccacaagacaccaaatctggggcaccttgttcttggacctccagcatatcagaaccgtaagaagtaaaggtttgtggttgaagccaccaagtccatgggccagaatgggctaacacgttcatgtgtcacagaaacacactctaatgcacataaatctatgtggatttatgacaccgtgttatttttcttaaaccaaaggcaagggaataatgaattaagtgtattcgctgccacactaccaccaccaccacccccaagttaggagagaggacctgaacctgcctggttcccaactgtatccacactgcctgggcggggctctcaggtttgcagaacaaataagcaatacacagatatgcacaaattcaaccagtcacctgtacgcagccacagagtgtccagaatgccctttgaaactggcccagcttcaaagccacagccttatgaatcctacaggctggtggtgggaaattgagtctctgaacagttgagagactcacctgggctcccacagccaggaagcatagagttggggcttgagtccacctcctcgaattctaaatcctttgttctctctctgacaccaggtggccttccataaacataaacacacaccaggacttagtggtgagcaaagctgctattccacactcatgcacataaccacatctatacacatgcacactgtgacctgtacacatggagtcacagatgcacaggtgcttggtatagatgcccatgccccagaggcaagactgtcaacaccaggcagggctcacagacccacagactagaaaccactcaataggctggagggtcaagggcctcactttgaggtcacacttgcttctcactggcagaggcagccccttggacactccaaactcctggagtgagagccatgcctgtccccaggttcaaagccttctacctgggctcccacaatgatgtgggtcccatttgaagctcacatgccaccccccacaacttgcagtatagtgaggagtttctttggggaaggccctccacctccactgaccagactcaaggggatggcgaagctgtcattttctctttcaacactagacccatcctcttcccacgcacacctctcaggtgttagatggtaaaaatccaaggtattacttctcctttctggaattcctaataggttctaggagccagaagtcacctgaaaaggatctagccctacctcttggataggactcctttatgccacattcctggcaggtaggcttgctaaccatgttgaaacacgtcctgcagtgggaactcaccacccttccactgtcagccagtccgtagtttaagaaagtcctccttagactgagctgaagtcaccagcaacagcccagcccagtccatcactctctgtccagtccatcactccaatcattccagcctcaaatcgcatggtttctagacctgtcaccctcctgggcatccttccctcggtattcacctactggtccttgtccacttcaaaatggacagaagctccagccagggcccaagcccaaccacagcagagcctgatcagatctttgcgtgaagcctcaggtcacaggggcatttgagcagccacatggcaccattcggggtgccagctcagtgtaaaggggtggaggagtggactttgaccatctgcctattctttattgccaccaccaaacacacttatacctggtgcctattttccaaaaggctgtgtgcttgcatctcttgaggatcctttaaaactcaaaggaaagagctacctaatggcggaacttcaggcactaggatagagcagtggggcagacttggggcaggggaagtgcaatcatcattcccaaagctgaaaaactcctaagataaccaccactcccctccatccaacactagactgtgctctgctgatgccccattccatcctcaccccatcatgtcctctatcaaagaccacaggcaatgcaatgttataatctgccatcaaatccctgtcagagcagcaggccaccagaattctacatctcttcctagccttggactaacttccaagaactttaaaaggatagacattgaatcaagccatatcataataacaatacctcctgtatgtgaggtctctttactatataccttcacataaagtctatgacttgacctctactatgttcaatggggaaatgagcaggagaggtaggtaatgctgctcccattctatagatgaggaaacagaggcccaaaataaggaacttgctcccccaggcttgctgggctagtaagaggcaagactaggacttgaattcagagcttgtaagcccgagttaattcagagctctttgagcggcactgcccaagattacttcactgacatctgccctttctagaggtgaggaaactgaggcctagggagagcccaacaatccagaagcagaattggggttcaactcagagtctgagtcctgggtctgcacctacttttaggaccccaagatacccaactgctactccagcccccaagaagagagtatcgttcaactaacctcagaccacagaagttactgctgccacaggacacccttggccaggacctccagaccacagaccaggagctctgtgtcgggtacccctgcagtatctgggtacaactcgctgtcggctggaagttgcaccgaggggtagtccccctagctcgcccagggagaagatgctactattgttgctgccaatttccagtgtctcagaagatgctttggtcatggtcatttatatcctaactcccaggagctgagctcatgggcagccaatccagagagccaagtgtcaacctttgcgggttatggcctcaccctgtcctatcacagcactgcttcctgctcctccagcgataggaggcttacctcagctacctgggggaaaaaaacaaaccagtttcattcaacaacttccctattacatccaaacatcagcaagaaaccaacgccagaaaacaacctgagacctggctggaggaaagctggtccgtgaaagagaaaaccagccaagagggaaagatctaaaaagaaaggtcactgaatgcaacatatatactggttgagttggggggcaaactcagaaggaggagtgataaggcgcctgttttccaaatcccgctacccctggattagggtctccgtgaatttcaacaacattctaaaaggtcttaaaaattcacattttcactttctgtaatgcctggatgtttttagagagtttatacatgtttataatccaaaagagaagaactatttttatttaaacacaagcaaaaattgtcagaaatccagtcttggttaacttgacatgggaggtattgcaaagtaaatattgaaagcatcacgctttggaggcacccagacctggaaccatatgccagcaggggacacaatgtgtctgagtttgtttttcattcaaaaactaagtagtctccaaagagggtgagcataaggccaggtgtgataatgttcctaacgaaaagaggaaaatctactgagtgccaagcccttttctcagtactttttcttttttattttattttaatttaatttaattttattttattttattttaattaattaatttatttgaatgagtggagggagaaggctacagacagtgcacatgagctgggtgcgagggggtgagagaggggcagaaagagagggagaagcagactccccgctgagcagggagcccacaacgcaggattcgatcccaggaccccaggatcatgagctgagctgaaggcagttgcttacgtgactgagccacctagatgcccctccatccttcctgtgtattgagagtgcttcgcacctagtaagtgttcaataaagggccagtgttttgctgtgttttcttagccatgtaatctgggccccctgtgcatctatgtgctctttcttattcggaggtgaataagccccacccagccctcacggcttcacagtgtagctggaagagagaagaatcatacaaacaggtggtagggtatggggagtattgttttacgggtacagggtatcagcctggagacatgaaagagatctagagatggatggtaggctggttgtccagcaaagtggatgtacttagtgccactggactgtagatttttaaaatggttaaaacggtaaattttgtgttacatacattttaccacaattgaaaaagaaaaagcagatggaagagcaggggcagagccaagggggagtggtgtccaagcccaccctgtgacgcagtaagtccactcgcaggtacatccaatcccaggttctcataggagggagagccatcctggggccattatggcatttgacaccttctgtagtcagccagaggggaccctcgccctggctctggtgcccggggccagctgcaggatgtgtgaggcttaggccaaatgagaaccaagggccccttgttcaaaaagtgctaagtaggggcacctgggtggctcagtcgattaaaggctgactcttggttttggctcaggtcatgatctcagtcagggtcatgggatcgaactccacccacatcaagccccgcattccacttgctggttggtggggagtctgcttgtccttctccctcttcccctcccctctacttgtgctcaccctgtctctctccaaagtaaataaatagaatcttaaaaaaaaaaaaaaggttggtaattatttcaagacagagacagcagagcatgaaaccatctcaggcctttctgagtgtaagccctgtgcaactgtacaggtcacagggccataggggactctgatgtcaggatggttcccaatcagtgctgtgatgaaagttgacagaggaagggagagggggaaagtaagagagactgctttttgaaactttcgtttaagtatcacgtatagaaaggagcaccaatcataaccatacagaatttttgcaaagagaataaacttctagaaccagcacccagatcaagaaacagaatcccagcatcccggaagcctttctcatgcctctctcacaggtaccccaatcgagacttctaacagcttagattatttttgcctgtttgggggggctttatgtaaatgggaaccagagtgcatgttttctttcgcagctggtttttttctattccatgtctcagccatacagcagcctgtagtggggttgtaaattctctgactgatgtatcaagtgtctgagaggatgtgggggggaccagaactctcctaagctgccaggtgcagccacttaagaaaactgagtgtcgatgtctactaaagttgaacagacaccaaccctctgacccaggactgcattcccagatagaaacacaacagaaacgcatgcacatccccccaaaagcaacatttataagagggcttctattctggcagccactggagggacaggaaaagtcaccgaggcaagggagcatagagggggattgagattcgctgagcactgaaggcatgaaatgtaactccagtcatttttttgggcaaaaaccaaaagaaattctgagactgccttctggccaggagtaatagccccaaactcaaaaacttataatagccccttgcacaggggcacctaggtggctcagtcagttatgcatctgccttcaactcaggtcatgatcctggggtcctgggatcgaggccccaagttgggagcctacttcttcttcttcttcctctccctctccccctacctcttacaccagcttgtgctctctctctttcaaataaatagataaaatattttttaaaaagtggtgattcaaaatggagatttttattcccctgagagtctgtgtatttgtttgtttagaaagaccatttaccctcttctgtggcctatgtaggcaataatatggacactccagaccagaagataaacttggtctcaagggaaaatgaaggtatcgaatgaggaggggtgggtaggagagaatgctccagtttcaggagccagaggaggggcagttctacgtgatatgtttaacagaagaattttcccaacagagattcaaatctgtctgagtttgaaaccccaattcccagaaatctacctgccatcccagtgagagaattgacgttatggaaacgatgggtcccaagagcaaagagcaagcgcctgtacatgccctcctttccagggccacaccctctgcctggaatccaccaatccaaagtccagccccaaccttttttgggctttccacttacccagcttcctggagacatgtcatcttcactctcctcagtgagaggtgcccgaaccctgtgacctcacactttgccaagtcaggttagaaccaaggaccaaaatcccctagccagaaggcagtctcagaatttcttttggtttctgcccacaaaaatgactggatttagatctcatgccttcagtgctcagtgaatctcaatccccgtccatgctcccctgcctcggtgacttttcctgtccctccagcagctgccagaatgtcccctccctcagtcatttctgggtccctgctgcaagtggatgactcaggtgaccatcatgatggcatggctttggctttggacagagctgcactgtaatccaggtcctcgcttgcagtgggcacactggaatagtaatgccagcagcaacagccaagagcttttatgtgtggtatttattttcatccccataataatggctataaagtcaatattgttcttttacaaatctggaaactgacactcgaaaaaataaaatgctgggtgcctgggtggctccgtcagttaagtgtctgccttccactcaggtcatgatcccggggtcctgggatggagcctgcgtcaggctccctgctcagcggggagtctgcttccccctctctctctgcctgccactccctgattgtgctctctctctctgtcaaaaaaataaaaatctttattttaaaaaaaagattagggcagccccggtggcacagcggtttagtgccaccttcagcccagggcgtgaccctggagaccctggatggagtcccatgtcgggttccctgcatggagcctgcttctcctctctctctctctctctctctctgccacgaataaataaataaaatcttttttaaaaaaagattaaatgcttaagtgacactgctaagtgacagaagaaaacctgtcagtaagtctccaaacatgtcattaacgatggcccgccactgctcttctgaacctcagtttgcaaggctgtgcaatgggaatagatgatgctaacctggcttaattgtcaggaaagttcaaggaagcaattcccatgagcattacctggggcacatagtaaggggcttgggcagtggcagtgctggatgtagaggatatctcagccaagggcctggggaccacagctctctcacggaacttgcgacaagcctaacagagctgtgggagtgaagccagctggaataattacctacatgtctctttcccatgtcccatgtcctagacattcgtccgttcaccctcctgtggctctggccagcctttcatattctctgtctcagtaatgaacatacttggtcaataatggcttataccagtctctcaccctggctctattgacattttggaccagataattattatgtggcctctcctgtgtattgtagaatatttagcaacaatcttggcctctacccactagatgccaggagtacccccttccagtagcaaaaaccaaaaattccaaatatctcccagagggcaaaaccaccccaggtaagaaccgctggcttaagcaacaatgacatgtaatgaactcatccgacagggagtccctgaaagttggcagttccaggtttggtgcagcaacttgatgatgctaacaaggaccatcacctcatgatcacaagatggctgccacaaatcccattgtaccaccatcacattcaaattcaaaagtaggcaagaggcacaaagggatagtgtcatgtgtggcttcaccctcaatcttaagttttcccagacactcctcaatagatcttttctatgtctcattgaccaaaactggttgtatgtccatctctagctgcaagggaggctggggaagagactaggtggccagggaggatgaggtaggaaatggtgtggatctcccctgacatggcagtatgggcactccccttacctgtggaaattatttttctatctgctttccttaccagacgagagcaccttgacaacaggggacctcctggggttttcctctgtgtcctcagaatttagccaggtgctcagcactgagaaggtgctcgacaatgctcatgaatgaataagtgagtgaaccaatcaatcgatgatttctcttccttcttctttgctcttatcactacaagccctacataggcagttgtatattcatatgcaaactaaacatggtttaaatacaaataagcccataatgcaaatgatgatgcaaacatctcccagttccttatacaaagcatgatccctctggtcatcagacatgctgttctctttgcccagaacattcttcctgccacctccaaccgcctctcacccatcttcacacggccagctccttctcactctctaggcctctgcttacatgtgaccccctcagagaagctttccctcatctccccagggtggcttagcacctctgctctattcccctcaagccctccatgttgtctcattctagctgttgtcaccctgtgacttccatcaactgttctggagactagaatagcaccttcttcactagtgggttctccataaacttttgttgattaaataacttatattagtgtttggcaaagtttttatgtaaagagacagatggtgaatattttcagctttgtgggccacatgacctctgttgcaactattcaactctgaacagaatgagtgagaaagcagccatagataacatgtaaacaaatgagcggggctctgttccaataaaactttatttatggccgctgaatttgaatttcatataagttttacatgccatgaaatattattcttctaaaaaatctcttttcaaccatcctagactgtaaaaatcattctcaaaggctctttggccatacaaaaacaggtgacaagccctagtttattaactctgattgatactaagagtcacatgctttgggatttccaggtcactctcaggaatacaccagaaccacttaaagcagtaatatagcaatatttcttttttccctcttttttaaaaatttatttatttatttattttaaatttaaattcaatttgccaacatatagtataatacccagtgctcatcccatcaagtgccctccttagtgcccatcactcagtcacctcttccccctaccctcctcccttccctcaactctttgtttgtataacagtatttcttaattccaagcaacaaattaaacttgaaagtacattaaatgactttcccataacattcagtaggctgtattttaagaaatcaaagatgatttgagattaagaaacagttactgtcaggaagccatgtcaacaggttttaataaaattgtttgacaatttcttcttttttttttaatattttacttatttgagagagagcacagagggagagtaagagggaaaagcagactacccactgagcaaagaacccaatatgggggctcaatcccaggaccccgagatcatgacctgagccaaaggcagacacttaaccgactgagccacccagcacccctgttcgacaatttctacacgcagaacttgaatttttttgaactagacctaggaaggtatttctttctcttgataaaaattatttatcttaaataatatccaaaatatgacttatcaatggaagtaaccagtgaaaaaaaacaggggctttttaaaactgagtttcatgtattagaggactatgaagtgctgaatggtagtgaagctgtgggggacacaggagcttccacactctgctggggggaggggggcatatgcgctggtgtctgtatttccagtatgtaacaattccacccctaggaattttccctcgacttcttaaggggacgtgaacaaggcattcaccacagcactattcatgataatggagatcctgggagatggacaaataaaatatagaggaggtacagcctgaagagttatttacacattagaggcatctggttggatgaacacgtggcaatgtggaagtatcctaaaaatacagtgtttggtgaaaaaaaagtgggaaacagaatgagatataccaaatagcattatgaaaattaacaagataaacaggcaggggcgcctgagttgcttagtcagttaagcatcagactcttgataccagctcaggtcatgatctcagggtcatgagatcaagcccctgttgggctctgtgctgggcatggaggctggttaagattctctttcttactctccctctgctcacctcccccactccggcacatgtatgcattcactctctctctcaaaaaaaaaaaaaagataaacaggcaaagtgacaaatctggatttataagaatatatagaaaaagatacacatccaacatattggcagggtcagtttgggagacaaaggcacacctgggataaatacatacataacacgtgctagaggagaccttctaccagcaaatgatgtaccatgagctgtacctgaggtctagtaaaaaacaaaataaacgaagaaaacaaaaataaacaagaagaatataaatctctcttttttttttaagaagaatataaatctcttaaatctgcacacatcattacacaatagtgaaatatcaggtcttccagtttatcctctacaggaataaaaggtaaagtagttaattatctcataattggtgaacattgttccaggtatttcagaccaacccattaaaactcaagttcgaaataaaggttgtacattaaaggtgaataggtagggagatggatagacagatatacagatacagatatacacatacacacagatatagatttttttttttttttttaggagagagcagcagagacatgggcagagggagaagcaggctccctgtgggaagcccgatgcaggactcgatcccaggactacaggatcatgacctgagccgaaggcagacactcaaccactgagcctcccagttgcccccatagatgcacagcttccactttagccaacttctgaccacagagcttcctaaaaaaaaaaaaatcctttcaagtatcttgtcaggtttcagctgggacaaacagtaaatatccctagcagtattaaacaatgccatggagggatccctgggtggctcagtggtttggcacctgcctttggcccagggcacaatcctggagtcccgggatcaagtcccacgtcgagctcccggcatggagcctgcttctccctcctcctgtgtctctgcctctctctctatgtctatcacaaataaataaatctttttttaaaaataaataaacaatgccatggatctgagaggcatccccctaaagactgcaaaagatgatacctgccaaagatccaaagccactcccaaagatacctaaatgagagaaagacttagacaagttccccaggagctctgcctgcaaatgggctgcaacccacatttgtgttcagcctgaggcctgaggcctctaacctaatggttgccacgccaagttcttagggcacaacacaagacaaacaagatagtaacagctacccaggggtaggaaaggatccataaccaatggatttggatttggatttgaaaaggaagagacaatgtgagattttaccttcctctctcacttgagccctacagacagagattcaggggagctggccctggtgagaattcttgtcctttgctggtggctgctagctttcctaggatcccatctgcaggatccaaagcaagtagagtttaaagtactgagtgtagctctggtatctacgagaaattggcaagattttccatgcattttcaatttcccttgactgtttaaggtcacagtttatcagaaaacccctcagatccagtcaaccctggaagggacccatgggggtggggatggtctccttcaaggatagacatggggccacctgtaagaccaccaatagctgacttttgtttacagtcaggtagtctctttagagtagaaagatccatcagataaaggactagcagaatgagtacctaagcaaaggagggtaggtagacggggccataggagtgacatcagtctcatgctcttttgttttacgtacatttatgcctttaaattatcattagcctttgcagtgaatatttaaatgaaactattttggaaatttgaagcctttgggaggcttctgcattgccaattgaaaggtgtcccccccccccaaaaaaaagatgtcccattttgtttgatttgagaacccttgctttcaagtgcatctttttttttttttttaatattttatttatttattcatgaaagacatgagagagagaggcagagacacaggccaagggagaagcaggctccatgcagggtgcccaacatgggactggatcccaggtctccaggatcacgccctgggctgaaggtggcactaaaccgctgagccacctgagctgcccaagtgcatcttttaaatgaatgagcttgtctgattggaacgttcctcataacggtcattgttttaggctgtcttcagtaagatttgtccatgcacatgaagaaagatcataatttttttaaagattttatttatttatttgagagagagagagtacaagctgaggagaggatcagagggagagagagaagcaaattccctgctgaacagggagccccatgtggggttcgatcccaagaccccaggttcatgacccaagctgaaggtagaccaactgggccacccaagcatcctgagaccataacttttttttaaacataaaaccagtcattattgctaaggagggggccattcttaaagcatttagatgactaggatcccatttttggagttttcctgagaacaaagaaaaaaaaaatcttaggtagcctaggggcatgcttggggttgagatgtcagttttgtttgacagtacacctctcacaggatacttctttctcctggcagacaacttctgccctatttatctgacctgtgaccaggtgtccctcattacaccaaattttcttgctggtagcaagtaccctaacatgaaacttcctcatctgtgatcaccttatccttacacagtagtcttgcgcttcagagatggttgtctctcatagaaaggtggcaagtgccgtgtccattggttttggttttagtcttgctctcaggaaaattcacaagtttaaatctaaaccaaacacattctaattcataaaccaagtacattctaaattcagaaaccaagtgcattctaaattcagaaaccaagagagtactaaccagaaggacaatctgtccttatccaaatcccaaaaaaagtcagagctcaaccaaaaggaggaagcttgaaatccgagaggagactcccaaaaccagaagcagaaggccacttgtgaaagcagtcaaggagcgcatagaggggaagtccagccagagtcctgtgtgcaatataaataccacaaaaagatcaagtttttctatttactgttattttcaatattttctatttactatttatttttatatagccaggaaggtgtgatggcaggaattatggcagacacaatagcaatttgagaatactctgttccaaagaagaaatgtaagatctataagccgtataaaagatttgagaaaatacagaaacatccacattcttgaaaggaaagcatatgcaaaaaaattacagttctctgctggtaattcatagttcattatagttaagattaaaattcaaaagaatttgacagaatctgaatttagaaactgacaaattttccctggctatatgtccctggaaaattaacaggtaaggccactataaaatttttggaagataaaaataattgagataaaaaagggatgttgtctctgccggataatataatataatataatataatataatataatataacaaatgtactataaagctaaagaggtaaagcaaggctgtatcagcaagaatcaatgaacaaatctcccagaaaaaaatagctctgaaaccattgccaataatatatgaattttctgtatgaaaaagaaagctcacaaaccaacaagaagaggtgggttgtacagcaaatgatattggagaaggaggtggggagtacctgtttagatccacattttatactgtaatataaaataatttgcagatgcattaaaatattacatgtaaaaataacatcgctttaaaaacttaaaaaaaatagctacataactaagtttgggtgaaggactttgtaataatagaaaccataatgaggggcacctagctggctcagacagtagagtacccaacccttgatctcaagggtcatgagttcaaaatccacgttggccttagggcttactttaaaaaaaaaaggaaaaaagaaaaacaaaacacaacataatgagaatgtcacataagaaaaaaattacagatctgacagtcaaaatcataaacttctacaaatcaaaaacactaccaaaggttaaaaggcaaacaaccaaagtagaaagaattatttgcaacaaataatacaggcaaagggttactctctttattttataaaggatgcaaaaataaatacaaatttaaaagtaattgataggggcacctggggggctcagtcggttaagtgtctgcctttggctcaggttatgatcccaggatccttggatcaagccctacatcgggctccctgctcagcaggaagtctgcctctctttctgcctctgtgcactctctcaatctctctctctctctctcaaataaataaataaataaataaataaataaataaaatcttaaaaaaaaaaaaaaaagacatggctactccctttggtaaagaaggtgtgtgtgggggattcctggagtatcttgctcagtgacagcatccaagttgctgtgccccacggaagctccttcttgtccacatggagtctcagatacgtcaccctgggtctctccgtttcaccaaaagactcaagctacaggccaaactttctctatcatgatcctgctcccaaggaagatgccatgcagtggctccagctctccatacactgaacaaattcaaatcaagccttcctatctgggagggttgttgcggggaggtccccaccaacacaaggccagggagtgacaacaagcagaggggaagaggagtttccagaaggccctggctcctcaggagctgatcacctgccctaaagtgctcatgtatttcctcttctattgagcacccagggtcttctgcaaaagggccccattatgcccatcttccagccaggtctgaactggctgaaaggctgtgatttaggctccaggaactggaagctgctttgcaaatatgagatcatgcaaattattaggcagagagagatttgcatctgccatgaccaactgcagtatcccaaagggcagtgaaagcagcagtgtcttcactctcattgggcccttctctgtagtgggttgaataatgacccccaagaggctatgaccaagtcctaaccctttgaaacaggggaatgtgaccttatttggaaagactttttttgcagttgtaattaagttaaagacctcaagatgaagggtgcttgggtggttcagtgggttaagtgtctgcctttggctcagggtcctgggatggagccccacatccagctccctgctcagcagagagtctactcctccctctccctctgcctctccccaagcttatgcgcgcgctctctctctctctcccattctctctctgtcaaataaataaataaaatcttaaaaaaaaaagaaaagacctcaaaatgagatcctcctggatttagagcaggccctaaatccaatggcagatgtccttagaaagacggagatttgagactcacagaggcacacacaggaagagatgggagtgacgcatctcttgactgatgaatgccaacggttgctagtgaccaccagaatctaggagaaaagcatggaactgattgtccctcagagccctcagagggaaccaaacctgctgaaaccttgattctcaatctctggccttttagaaaagaataaatttctgctgagtcaagcccccaagtttgtagtcatttgttacagcagctacaggagactaatacactctctttcacacccagctgttcagcagtctgggtctccaggttctggcacccccacccagctaactctcacccagactcatggttcagctgcccaccaatctcctccaagtcaggaacctgctgcaatactccctttcctgctagaacaagaagcattcagaagcaccccaagtcatccagcagaagggtgcataccaggcagatgacagtgtcatcctgccacttccaaagtgtcccttcacagccctaaaaataaagcaaagaaaatgaattataagagaaaataatgaatgttgaaatcttaaaaactgtgaaaccggtatcatagatactgaagccaaggcaaagcattgctcacaggtctttctgtcctgagggacagaaggttcttagtcatctctgacattcccattaaattcaaggtaacactaggttttcacttgcagatatcatccaaaggtgacacctgagggtcaggcctttctgatcactctggaattccctggggaatgtgatcagctatcagaatcctgggtactaggctccagctggaaagagccatgtttcagggaagaggcaggcctttgaactagcaggtgactgactgtcttgtagttgataagtaagatctctccactcccaccagggcaccagaaaacaagcagtccaggatagactttgaaggtcttatcttatcaaaaccagagcctactgacaggcaggcaagcctgtgggccaacttggctgggaacagagcagcttccttcaagaataatacatgtctgtgggatccctgggtggtgcagcagtttggcgcctgcctttgacccagggcgcgatcctggagacccgggatcgagtcccacatcgggctcccagcatggagcctgcttctccctctgcctgtctctctttctgtccctctctctgtgactatcataaataaataaaaaattaaaaaaaaaagaataatacatgtctgtgtgtgacttaaaacaccagaggccacccaacgcccccacacttggagatagccattgctttgagtaagcctttctgggatttttttcttttaatagaaaatagcatagcattacatattattattatgttcccatttggggaacttttagtatatactgttgcataacacaccctttcttgtttagggtcctctggtcgtgggattccacaattaacagtgtgttttaagggagtttggcaccaaagagtggaggaaattcccttcttccttccaagccccaaataattttttttctcttttttttaactgagtgagtgaaagggtttgcaactccaagagacagtcaatattcaggaagtgaattcaacaacatcccccatacttcccatgcattttagactatttagaagaatcttgcatttttcccacactggcttctcagccttctgctgatgactttttctccttggaacatacaaaagcttcgggtgcctgggtggctcagtcattggttaagcatctgcctttggctcaggtcttgatctcagggtcctgggattgagtcccatgtggggctccctgctcagtgggggagtttgcttctccctctctctctgcctctgccttcggctcagatcatgattgatcaggtcaggttctggaatcgagtcccacatcaggctccccgcagggagcctgcttctccctctgcctgtgtctcttatgaataaataaataaaatctttttaaaaattaaattaaatttataaaaagacaggaaaaaattttggaaagctggagtagaagtcacttgcccccttcccacccaacccagataggcagggatgtggaaaggtgacaaggaaacggaccaaaatcagccttgggcagctaggtcactgggcttttgggcttttcccaaattcctgtaactacagccccatgtttcaaagactgtttctataaatatatttttgtttgtatgtgaggacatttctgaaagccattttctcagaaacagaatggctggatcataagggagatactcaattttttggtaggccctgttgaatttcatttccaatctttgcatctctttatcccaccagctagggtcactgagagtggctgcatctccgcacccacactcatagtggacatgggtctagggagcttcaaccatcaacatctttgccatagacctctctactgcaagtgttttcactgattaactaattgactgaaggcaattttgccataagagctgaaataatgcaatataagagagacattaaaaaaaaaaaacaaaaaaaaacacggggcacctgggtggctcagtcagttgagcatctgcctttggctcgggtcatactcctggggtactggggtcaagccgtgcatcaggctctctgctctccttctccctctccttctgcctgccaatctgcctagttgtgctctctctctctgtcaaatcaatcaatcaatcaagcctttaaaaaaaataatgaagggcagccccgctggcccagcggtttagcaccactttcggcctggggtgtgatcctggaaaccccggatcaagtcccacattgggctccctgcatggagcctgcttctccctctgcctgtgtctctgcctctctctctctctctctctgtgtctttcatgaataaataaataaaatctttaaaaataaataaataaataaataaaaatgtaaaaataatgaaatatggaaaaattattagaatcaccataaggcaatttgtcataaaaaataaaatcacaaaaaaataaaagaggaacattcatttaaaagcacataatgaaatatgaaaattgaacaatggaattaaaaatattgggaaatgcaaaatatttgaacacattcaagatgcatagtgtagattcattggaaaatatttgaatacattcaagatgtgtagtgtagattcatacaatgtgtagtataacaacactgcacaaataattgattttattttgtggattgtccctaagcatgtgtcttcaaagtctttcattcatagcaatacagtgatctccctttacccataaggggtatgttctaagacccccagcggatgcctgaaaccacaccgacccctatatatgctgtgttttttcccgtatgtacatgactgtgacaaaatttgatttataaattagatgcagaaagagattcatagcgacagctaataataaaacataatatattgtaataaaagttatgtaaacacaattcctttctttcaaaatatcttattgtgctattatcacctttccttttgtcatgaccatgatgatgtaagaggagaatcatctgcttttgccagtgttgatggactagggtaaatgaaactggtgggggcagcaccaaaactccagataagggggaactactgtatgctttttaaaaaaatttttgcttgttgaatcatctcctccttctgtattacacttttttttttttgcatgaaaatttattttcagggacacctgggtggctcagtaagttaagcatctgactctttgttggcttcagtcatgatctcagggtggggctgcaatgctcagtgcagagtccgcctgtccctctcccttcccttctgctcctccccttgctggctctccttctctcaaataaataaataaataaaattaaaattaattcaaaaataacaaaataaaatttcttctcactaaaagaggtatcagtttccaaagagtgggatgtatatttgtaactgagatttgtgttgccttgtgaaagccttccattccacattgttgtttgttcttggcatattggcacctgtggaagaaatgccagtgtgattactgtacctgataagatatcatcttctggcacagtgtggcatgcggtctgcgctacacactatgtcacgctgctgataaacttggccaccgaactttctatcaagtaagataaacttagctgttatcatccactgttttaagaccaccacccctactcaacattgtctagaccattatgagggctagcgaagatttatataacatagaaacaggaactttgtcagaggagaaatgaaacccaacatcaaccagttattttagcttgtatggcaaaatcgccttatggccaattagtcatgtgacaaaaacatttgcagcaaaggtgtgtacagcaaagatgcttagagcaaaaatatcagaggcgaatagacactcctgagcctgttcattgctgttgatgtgacaagccactctcatttttttatttgcttttaattattcatgaagtgaagcatcttctcaaatgcttcttacctctgagtttgttcttaagtagttggttctttattggaaaaaaattcaatttattacattatattgtttcctccaggaagggctcattattctcaagagaatacgtggaagctcttacttcctataacacacaggagtttcgcacttcctgtaggaaaagtggctattcatttcagcagcagccaaatacagagcacttgaagtcagatacaaggagtcatcgcaggaaaccacttctcctggtttcaagggcttcggaggtaaatttatagactcctcacacaggaagaagtcatttcacactgcaaatataaattttccacagccaaaaggatacagagagagagagagagagagagagagagagagagaaatcattagttgtttaaccaagtaagtttgagtcaaaagaaatgtcaaaatcttgatataaggaggctggtcttgatggatggatgccattcatgtccatcccagcctcctgccagagtcctttcctttactgcataggctgaaaaacagaaaagtatacttcccaccctcctttgccactagagttttagaagtgaattgggatctgacaattagatgctgtggcccaagattggagaggagcaggtgagacagggtgtcttcctgtgaggacaagcaaggccaaaagaaactgtactttccaggagcattccagcctcgtgggcacctcttcatgtaaaaagagtcctcgatgtccggatcagaggtaacatggtggtttcctaacattttagtcagaaaacttcatccctgtagaaaatttgagaagtacggaaaaggccaaagaacaaaataaaaattatctgttattgcacaagaatcaactattgatgagaagaaaagatttaactccacgaagatatagtcctaatgggccagctgttgctgttcatttgtacgcagaatcactggctcagccaaggggagcctgggctgattttggtgctcacgcttaatacctacagtgagactgcagagcagctcccagccccttcccaagagtaagggagaaaagttgaagcactagaatgtgccaaaatacccaatctgcctcctagttctaacctacttggccatagtactgggaggctgagtatctgtactctttccctctccaatcacccccctggagagggttctccatatccctctagccctggctgcaacctaaaatctatttgtctaattatttcatctgggcctcttcttcccaccttttatccaagaccagtttccttccagagaccccttccctctctgtccaagaaaataataatagtaataataataataataataataataataagcagctatcatttattgaccactctaagctaccaagcaggtaatcctcctaagaaccctacaaagtaagaattattttcatgttacagatgagaggctcagaaaaaccatttcccaacactctacaactcatgagaggtggaagcagtgttcaagtacacaaccatcaggactcaaaacctgagttttgatccttactctctctcccgctcttagagccctgggaaagtgcctctgacctgctgttgtctttggggaagctgccactccacatggaggcctgtttgcacataaacactttttttcttcaatcacgtctttattgcgatctaattcacatgccataaaattcacatgccatagtttgtagaaaaccggagttatgcatcagtcaccactatcagattccagaacattttcaacattgtgagaagaaatcccattcccattagcagtcattcccactcccccatccttctagtccccagaaatcactcatctgtttatctctattgttttgcctatccagacattgcatgtaaatgggatcatacaatctgaactttattcctttttatgaataatattacactgtatatctatacagatatactactattatttatacattcatgtcagttgatggacatttgggttgtttctactttttggctattatgaatcatgctacaatgaacatttatgtatgaatttttgtgtggatctatattttcaattctcttgggtatgtacctaggaattgaatcgctggatcatacagtaaatttattttatctttttgagaaactgctaaactgttctccataccagtcacaccatttcacattcccaccagaaatgtatgagggttccaatttttccccatgcttgttactgtccatcttttccaagatggccattctaataggcatgagatagtatttcactgtggtttggtctgtattcccctaatgattgatgatgttgagcatcttctcatgtgcttattggttgttcacataccttttttgttcattgtctcttcaagtcttttccctattttcagtttggttacttgtctttttattattggttttaagagttcatcatatttcctgggtataagccccttgtcagatacatgatttgaaaatatcttctcccactttatttttttttaatctttttaaaaaagattttatttatttattcatgagagacagagagagagagagagagagagagagagaggcagagacaaaggccaagggagaagcaggctccatgcagggagcccaacgtgggactcgatcccagatctccaggatcacgccctgggctgaaggtggcgctaaaccactgagccacccgggctgccctcttctcccattttctgtgctgtcttttcaacttcttattttgatgaactctagtttatgtatttttttcttttgttgctgtgtttttggggtctcatttaagaaactgttgcctaatccaagtcatgaagatttaattctgttttcttctaaaggttttttagttttagctcttatatgtatgtttttgattcattttgagttaatttttgtattaagctgaattttctattgagctaaattttgtatattggtgtgaggttagggtacagtctcacttttttgaatgtggatacccagttgtctcaacaccatttgttgaggatattattatttacccattgaatagtcttggtacctttatcaaaaatcaattgccattgatatgtggatttattttgggattctcaatcctatttcactgatctacatgtctatcctatgcacgtaccacactattctgtttactgtagctttgcagtgtgttttgaaattgggaaacatgggtcttccaacattgttttccttttcacgattactttggctattgtttttggccattcatggtcacagttccatataagtattagtattagcttacctatttctgtaaaaaaaaaaaaaaaagttggaattttgatagggattgcacgggatctgtaggtcaatttgtggagtaccaccatcttaacaatagtaagtcttccgacccatgaacatgggatgtctgcttatgtatttaggtcctctttaatttctttcaataatgatttgtagttttgagaatatatttcttattctttattttttgttcctaagtattttattctttctgatactattgtaaatgggattgtttttacatttcattttcagactgttcattgttagtgtatagaaatacaactgacttttatagattgatcttgtatcctgcaactttgttctaatagattttttcctttggcatttttatatacaatatcatattatatatgaacagacatagttttacttctccgtttccaatatgaatgcctttttttttttcttgcttaatttctttggctagaatctcctgacattagggggaaagcatctcatcttttaccactaagtgtgatgtagctgtaagtttttcatagacgacctttaccaggttgggagaggttcaattctgttcccagatatgagtatgtttatcatgaatgaatgttggattttgtcaaatgattcttctgtgtctgttgggatgatgacataggtttcatctttcattttattaataaagtgtattatattgatgttcataaactctccaagtatgggttcaagagaaaagtagagctgtgttcaaatagtaggcctacctaatctctggcaggaagagtctgtacacaatggaatcggtgacaattactgagaatatttgatgccacacagttaaatatcctgagctccaaagcagcaattctctctgattcatcccaaaggacaccccctctctgctcaaaaacctctggtgataaggaactcaccttctaggatggagagaagtggcaggcctggaaacaaacttgaagagtgccaaacaatttatggcaagaactgtatctcctctaaatagagtccaagcattcttaattatataagacagaaaccccagctcaaaccaacttaagtgaaagaagatttattagaaagctagcagggttgtcaaagaattgaaggaagatcttcagggatcagaacagctcagagctcccaaggattggcactggacagccgaccctgtcaggacttccctcaccttcctgcttctctgtcacactgtcatggctgagggtgtcaccaccaccagcttgggggtaacctccctgccagctccagttagaaaaatgcctgggaaggattttcattggcctgcctgggtcacatgccttctctgggacaatcactgtggtcaggggaatgagcgtctctcaatggccctgcttgagttgtacggacttttcccaattgccaaagggcaggagactgtgatggagcaggagagaagctgctcccagaggcaaaatcaattattaccgggaggatgacaagaggggtgctgcgatgacaccagcattatctcattgccaatctctttggggcatagtcttaagaagattcatgcttcaagtagagacatgttattgaggggaatttgaaggactctcttacctccactgaaacatcgtcacaggttatcagagtactgagcagtaacccagagaagccttcaagggctaaaacccaagatgggacatgtatcagttttctagagctgccatcaccaagtaccacagagtggatggcttaaacaacacagatttactttcttaaacttccggaggctggaagactaagatgaaagtggcagtggggcttggtttcttctgggcctctttccatggcttgcagatggctgccttctcactgtgtcctcagagggtctcctcccttgtgcacacatattccgggtgtctctgtatgtgtcctaatctcctcttcttgtaaagacaccagtcagattgaattagagcccaccataatagcctcgttttattttaattacctctttaaaagctctatctccccaatgtagtcacattctgaggtactggagttaggccttcaagagatgaatttggcacaatttaatctataagaggaagttaagagaagatatgtaccaggtgatatattatgagaatacttttattttggaaccagagagaaaacctgcattgagttcacaggtaaggcaccacgtagctcgggacaaccaagatacaatttgcatttggagggactaaccaaatgtcagttgaatagatcccctgctcagtccattcattttacaggtgaagaagctggggtgcaggaaagaggcattaccctctactagcctacacagaaaagccaaaaagcatagaggtcagagcggatggggcaaagacagctgtccatcaaagagtcccttccagatggtgaaatgaggcactcaggttgggccaccattccccagaccctctgcatctatgcgtgtccacatgaagcagttgggatcacagcaggaaaggcacactctaccagacaattgtggaaagtttaataacaagaccatgtacaaggttgagcgcagggtgtagggaaagcagcaaatgatggtgcggtttcctggggctgccaacagtgggcagtggttaccacccttcagtctaaaacggcaagtgaaaagaacaggaacagaacttggaaggagtgactgtatggagagggcagagacagaaacatggcctttagtagaagaacacagccaaactatgcacctggctggcaccggatggaaagtctcccagtcaaggagggaactaggagaaatgcataccttggccacattctccagttttcctgccagtggcttccttgaccaaactccaagcagaggacaaaggagccccttggcgcaagccatacaggtcagcctcctggccatgaagcaggagaaagaaggctggagagtggaagaaagaagggtggaaagtcattcagaaggagcaagaaacatatatatctgtatgccatcggcctgagttctggcaatggaatgtgggcagaaatgatgggtgcctccctcaccccaatcgaacccataaaaaccaccctcacagtcctctgggcctctcccttccccaccagctgcctggaggtcaagcccccacggaaaccatatgaagaagataacagtagcgcctccagcagcctagaacccaaatgacttcgggagagagccccacaatcaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcttctgcttgtcaaaggtctttttttctttttgtggctgattgagacccaagttgttaaattattcacccttcagccaggaaaacataacattctttattgcaaatcacattagagtttgtaagaggctggagttgggatgatctgttccaaagcttggaaaggagcctggatgaaagccaggatcccagacccttgggctccccttgacatctctgatcttccattgtcccatccctaaaacgggaccagatcatgatcctcatacaagatggtaagaagaaaagtgctttgtcagatgcttcagaatctctctggggggcaccccaggtgactcagcggtttggtgctgccatcagcctggggcgtgattctggagacccgggattgagtcccacatcaggctccctgcatggatcctgcttctccctctgcctgtgtctctgcctttctctctgtgtttctctgtgtctctcatgaataaataaataaaatcttaaaaaaaaaaatctctctggagatttactcaccaggtctagccacccccaggcatctgctccctgataatctgatatgcaccctccatcccagatcacaggttgaaaacctgagcatgtcactagctggagtgcatgactgaagggaaatcccttcctgataagaatttctgggatttcaagggtcatatttagaagtctgggctttctagtcagagtgcttccaacaatgcacagcgctttcttgagttgtggaaatgggcctggcctggagagttcaagcctgttcagaagaatttattatctcattggccttagtttgtggttcccccacggggaaaagaggggactggagaggattagctctgtgtcagtttggtcttctcctcccagcctttccatctgcattgttcatatccatgaggattgcgtctgattgcacataacaggaactaacgacagtgtctatctcaaaaacgctcagaaacagtacccgtctcactttcacggcgtgaatcacaggccaaagagaagggggatgatcacactatggggaatcattcctgctttcacatgcttgtcacctctctgatagctcaatttagatctccctcctcacttgaccccattgcatcttccttcctggcacttaccacaccactcaatatcagatgcactctttcttgtttacttatgtcttctctagtttctagaattgtgcctaccttatagtaggtgctcaagaaatactcgttaagggacacctgggtggctcagtggttgagcgtctgccttctgctcaggttgtgatcctggggtcctgggatcaagtcctgcattgggctccctgcagggagcctgcttctctctgcctgtgtctctgcctctctctctctctctctctgtctctcatgaataaataaataaaatttaaaaaaagaaatactcattaaataattaaatgcatcattgcattggcaatttcttaacaactgaatgcggcaagcagggtaaaggatgctgttaatccctttacagatagggaaactgaggcccagaaggttgacttcagtaaagccaccagggaactcaggtagcctcagtcctttgattcctaatcaaggcccagggggtaggaggttaggagatagagaggctttccgacatgcccctggcctgtgtcccagatctgtgaaagatctctttggggctgctgttcagaaacttgacaaattactcagggataaggtaatttaaaagaaaaggagataataaattatttccaacaaagaacctggtactagggattttagaaaccagttgcctgggacgcctgggtaccttagcggttgagcgtctgcctttggctcaggtggtgatcctgggatggagtcccacattgggctccctgcatggagcctgcttctccctctgcctgtgtctctgcctctctctgtgtgtctctcatgaataaataaataaaatcttaaaaaaggaaagaagaagaaagaaagaaagaaagaaagaaagaaagaaagaaagaaagaaagaaagaaagaaagaagaaaaagaaagaaagaaagaaagaaagaaagaaagagaaagaaagaaaaagaagaaagaaagaaagaaagaaagaagaaagaaagaagaaagaaagaaagaaaggaaagaaagaaagaaagaaagaaagaaagaaagaaagaaagaaagaaagaaagaaagaaagaaagaaagaaaccagtggcctgagtgttggacaaggaagggtgacattatcacccaacaggtggcttttggatggcctcaatttcacccctacccctacctccactacttaccctgcccccataggtggtgagctccccgtccccggaggtgtttaagcagaggctggatgtctgcttacggggtatgccagaattggggttttgtattcccgtcctggtaggagagggcaggccgtcccagacacagaacaggtggtgtaggcagtgggtccagcacccgcaaggaaaggaggctttgcgccacctggtggacctatctttgaactgcaggcctttccagggggagaagcccagctcctgagtgtccccagagtcctgggcagtgaagacagattaggcctctgacggcctcaaagggacccgagttagtgtgtgagagctcggcggagcctcagcgtagatccaggcaccagtaggctcccgaggggccactgttacagggaggatttattaacagaactcaaggcttgctaaggcatgtgcctgggattggaggggacacagcccccctaaactcaatccagattcctgggaggacaaaccgagaagtcacctggcaggaggaggctcatttcttcattctgcttgcctctgtatctgggagtgaccctggactctctttgcccagaagtaaaacttcccagttcagctccacatgagcctccgtaaaaccacccataaaaaagcaacacctcgggatgcccgggtggctcagtggttcagggcctgcctttggctcagggtgtaatcccggggtcccaggattgggtcggcatcaggctccctgcctggagcctgcttctccctctgcctgtgtctctgcctctctctgtgtgtctctcatgaatgaataaataaaatcttaaaaaaaaaaaaaaacctctaaaagtgttttgcctggtggatgtcacgtccaaagagtgtgtaccaaagtgcatattttcattatgtttgttattggattgcatcattcattatcatcaaaggccctttacaactgctagtagaagccacgacaggccttgcccatcaccaggaccacatggcatgcctttaattgagcaaaagcgtagacgtttgaaagatcagtgagtccatgcagccccctgtgaggtaagtgttggattatgctcagcccccctaaaacactgaaatgggctccagctcccagcccagccttccttctgctctgggcagtgaagctcagggctcagttactccctaagagacatgtactccctgcccagcgctgggccctggccagctgcccttctcaccacttctcctttcattttcacttcagttctgagaagagggcatagttttaaccaacagttcatcccaagcctggtcctgggtgacagaggcccatcaggatcctgcaaagtggggcagggaaccccggtccaggacctggggttttctcctgagtgaacacttgaaggccccctgtgtgaactggctctaaatcatgtctttccccagcatcagctggcccatgaagtggggtatgtgcagttggtgctgttggggttgacacaggacagcccctgcctgttcccaaaggctctctcctcccccttgtgatgatctcagccccagtcctggtctattttcccgccttgtgaacaaggctgacccaaggatgtaactcggggacccctttgccctggcccaggaacgggcctctgtggtcagcccctgacctaccctcactcacagtgatcaagaagcccacagccccaccacacctccaggttctccaaaaaaagggaaaaacagagcagaagcctataggatcctcctaaggggcactctctctggcacctcccaagcagaattcaccagtgttttgtcctcactgtctccagtgggcatggactgtgacaaggtctaatgtgtgaacttccccaaaggcagggccacatcatccttcctatgccacccctatatcagcaatgaacttacaaggatttgggaattttaaaaaattaagttcatgattaaaatatttttaaaatatgcacattctgattttcagaacagcatactcaaaactccctgcccaaatcttggagccatcccagggcagcttagttcaatagtccctccgggtagccaagtcagcacacaggaagggacctggcattccacagactccttctgagccaggatcaccttcgtatttaccgccagaagctggatagtttggaggtattaagacctcgctctataaatggatgtgtcttctgagcatctctataaaacttcggaaaagaacgcttgagtagaaaatgtggatttacaccataatgagggaccagaggaagaagccaaggagagttgtcactactaggctcctccaggagagagacgataggtcaccagcatcagcccaggcttcccataggagctcgagaggtggcagggccaccaggattgaaggaagtgctagatgttgtcacctcaagtttacaccatgttatacgtcaatcatatcttggggaaagccagggagaagtggaacttccttgcaagagaaaaagactgttggcaagaatccatgtagcagagatagagaatcacggagcccatgctttgggttcatgctgtaagtggcttgacaagatggtgacagtgacttgtgtcatttatttcattaatgaacttctttacacactcagtttttaaataaattatttatttactgttgactttaatattatctgtgaaaaaaaaaaaaagaaaaaccgacatggctggctcttctttcaaactatgagaatgtatctcttgcttttgaaaattatgtgaggaaatccgttttgacatgttttcagtgacccatcacttttcgggaatctgtgccaaaaatggttgtaaacccagagcttcacctagttccaggtacacagcaagtgctcagttaatgttggtggagggaagggctgaatggatctttttattcctggcacccaagtatacatcccagacccaggcctaacatgcatggggaggtggggaaaaggtggactttcccctggggctgagtggggaggctaaggatctgggctctggggtggaagagtctgtcctagcccaggcccctgtggccccagcactgggtgagattcatcgccttgggtagagacatattccctgggacacacagctgttgacaaccattaacgaacgccaggcaaatgccaacatcgtacctggaagaagtgacttatggggcaacgttaggagtcagtcaggctgagctgtttgtccttgagcaagttacccaccctgccaccaccatctctggcctcagttgccttatcaataaaaggaggggctggacaagggaggtttcaacagtctttccccgtccaattgtggagttctgggttagagatgctgagaaacgctatggagcacaggttcatcctggtccaaagcggaggagatggaaccgtctcaaggaagaggaaagaggccaaggattttcatactgagcctttatgccaaggccaccttgctgtggcccggccacttctggtgtggaacagtcgaggcccgggacgggactaacccaggacagaagccctgctcctgagtgatcaagctctgagtgccaaagtccaggaatccttctcagcttctgtgtggtgactcaaagccagctcaggctggggatttcctgacctgcccagggggtgagaggcagaggtttcctcctaccaagaaagaagatgtgaatccaagaagttctgttttcggtgaagtgaaaacatcccttccctttctcccccaaatcttactggaggaggtcacagggcagaggttctgaccccctcccaagcctccagccactcctaggggcgttggggagaagagaagaaaagctgaacccatagcgcagaggcattttcaagcttcagagtggtttgggatttgtggagtcaccaatgttgtcaccaatgttgtcgtatggagatttctggcaatcctgtgaggtcagctcagaatagcacctgcattttatgggtgagaagcctgaggttccagggaggggaaaccacctgcccaaggtcacatggcaggtgcaggtccaggagcaggagcacaggaaaccacagatactagggggcagtggcaatctccactgggccatagtcatagtgtcaccagaggactgaaacctcaggaaagaaggttgggccaagtgagatgaaccactcaacagagaccctgagggcagagaggcagggccatggcttctgcttaagtaaagtgccccatacacgcagagtcactaaaacaaatgcacaagccaagtaacagtactgccttctggagagacttcccagctctgtaagcctctgcctctgtttccccatctttaagccttggaggtttggagggtgaattgaatgagataaaatgtgggtaggaaccgtagcacaaggcctggcatgtagtgagtgcttacatgtcagttagcattattatgttgctattactaagactgatgaagccgtgtccctttctcccaggccagcatcagccccctgagggcaggtcttcaagagcatgtcccttttacaaactaaggctcagtgaggggcctctgcttccttcttctgtaagttgatggagctgggccggatgccctctcagtgccccgctacctctcccaagctgggcaggtaacaaggggtagggcagagagggttcacacccggtgccccactgagctccagggctgcctacccaaggacgatgcccaccatgatgccctgaatgtaaggctccccctccccccccagttctcagcctcccgggtgggcaggcagctttgaggtctgggacaatagctgggatctcatgagtgcaaaaccccgtcagggatccctgctgctccgggaggaaggcggagaccaccatacagctagctgccttcaagggagactcagtttctggcctgtcactgcttggtgcccagaatccacctgcccctcacggagagacttccagcatctcctccttgaaatccatcctgtcctgctcctggctctccggctgttccaggtggctgcccttgtcctggctgaccttcctgggtgtcttcagaaatctggaatattcaggccccagctgcaagtcagcccctgccccagccgctgggggtttccagcccacccaaccactgcttcccctttcctcctcagcccctaggctactcacctgaatagcagtttttgcccaggttctttcttaatgatgttcagcttatagtagtggcgcaaggcacgtgacatcttctcataggtcatgttcacccggttctagaaggcaaagcagtcccacatcatcctccgctccccaccccattccctccgggcctcagtttccacacctggaatggagcaggttgggggcacctgggtggctcagtaggttaagcatccgacttttgattttggctcaggtcatgctttcagggcagtgagattggcctcaggctccatgctcagcggaaagtctgcttgagattcttcctccctccctgtgtccctccccctgctcacattctctctctcaaaaaaaaaaaaaaatgtctgtctctgtctccttgcctccatcctccacctcccactctaccccatttccttttttttttttttttaaaaaaaggaagaaagaaagaaacaggttgaaccagatggtttcttaaccccccggaaccagagttttgtgagggcttatgagagctctcttgagtttggaaggagacaggcaggggaaggttggaggagaaataatgagtaccacctacagggctcaggaccacagggcaagaatgaatcacatgttgcttttatttatttatgttttaagattttatttatttatttatttatttatttatttgagagagaaagagagcacaagcagcagacagggagagggagaagcaggctcaccactgggcagggaacccaatgcagggctcaatctcaggaccctaagatcatgacctgagccgaaggcaaacatttaaccgactgagctgtccgggcgggcgcccttcatatgttgcttccaaatagcaaatgtcacaagtagtatatatatatatatctccttgctacctgccccccaagtgaagggtgttggcgctctctctctctctttctctctctctctctctctctctctctctctctatatatatatatatatatatatatatatatattttttttttttttttttttttttagttggaaatgcagtcagagagacagaatggaaagggaagcacaatggtaggggtagctcgccatgagctgcgtgactttagccaagtcattttatttttctctgaggtgtgggcactgcagagtaaggcaacgaggctgggctttagtgtcaacgtaagccccagctccaccatgtggcaggttcgtggccttggataaatctcttcacctctctgcatctgtttccccagctataaaatgaagatgagagcacccatctcacaggtttattgtgaggattaaattagctaatccatgggagcacttagcacagcacttggcatggggtatatatgctcattaaatggaatcgctgctccctgggccgcagttcccctccctatactagaaggggattggacgaggtgaacacacccaggcttgagtcatctgcatccgttccaaccaccagcaccacagagaggcaacagaagcagatcattttgagtgcctgggtggcgcggttggttgagtgcctgactcgtggtttctgctcaggtcgtgatctcagagctctgagactgaggcccacatggggctccttgctcagcagagagtttgtttctcttctccctctccctctgcccctcccctcaccataaataaatatataaatctttaaaatagagtggaggcagaggcacacactctgtgttcaagtccatgctccgccacctactggctgcaaactcttggacaaactactttgtgtgcttctgtttcccctctggtgtctacttcacgaggtgtcctgaggattaaacgagttaatgcagggaaagccctcagagcagtgcctggtgatcaaatgctataccattttaggaaacgctatctattatagattaccatgattgattgctaagtttttttaagactctttttatagctaactgaatttatttatagacaaggacacttgctttacatcatcactgtaaagcaagagattgacgtcatagttaaaaacttttaatcccaattcttactaaaataaataattagtagaatttggggtaaaccacctaaaatcttctggcagatgcccttttaggttatgggcattcctcacattgggaatgcagacctcagtgcttaacaggctttcccagccctgatacccaatgctcccacacagcctgagacctgaatctctaccccagctcccccaccccaccctgggaaaccggtttcctcacctggcctaattaccccacagcatatgcagtgtaattcatgtaaaaacgctttgagagtctcaagaactaagcaaaggtgggtttaagtgagtagaagggcaagattcctgagtttcggggacagtccccatcctcaaaaagtaacttcttgtcccttaggatctcccagaataaaatgatcccaatacttctggagctgttggtgaagcccctcacccccacctctgtcagttgagaaccgtcccctagtgttgaggggtccactctgaactcctgctctgtctccttctggaaatgtggaggccagcccacatgctagctgaggtttaccttatggtttccccagagtctggcaagcccatttggatccacaactctgaagatcttggcgttcttatcttcccatctgatgtagggctcatacctggtgtcacagagcagctggtacacataatcccacagcagccggcagtctacgatggagcacagccatttgcaggggctcattgtctcatttattcaccctaactctaggaagtgcccccccttaaataaatatataaatctttatccacagtgagatatgacgaaacaagcccagagaggtatggacatatcccagtcaccaatctcctgaatgacacacagactgaaaagactaactcagctctgcaaacatgagagccaacacccttcacttggggggcaggtagcaagggcaggcagtggggatgctggatggcggccagtggcctgcacctgcttccagatccctctctgccctttgccctattctctgttaaatcaggattgttaaatccatcctgtcaagtcctttagtgagaagcttgagaaaatcaaatcatcatggagggcaagtggccaagggagcctgggagcaagagcttaaggcctcctacctgggccacctggctgggtcatttcaggcagattacctaacctcttctgagccacagtatctttgtaagggatgatatgaggattgagtaacataataaacccaaaagcccttagcactgtgcctggtacagagtaagtgctcagagaatattaagcattattattaaaaagatcaaatgcttgtgcttcagtgattcccaggcatttccaacccagaagccaggcttagtggtgtcttaggacaaatgttattgccctagcgtggctcaaaattatgctttggaaaggcaggcagggggtacctgggtggctcagcggttgagcttctgcctttggctcagatcatgatcctggggtccggggatcaagtcctacatcaggctccctgcatggagcctgcttctccctctgcctgtgtctctgcctctctctctctctctctgtctctcaagaataaataaataaaatcttgtaaaaaaaagaaagagagagagagaaaaaaggcagtttatctgtcagtttttctggtggcctgttagtcaacactttaacaatgaatgtagagtggaagtgtgttgcctgcttagagctcaggctctggagccagactgcctgggttcatgccccagctctggcacttactgctgtgtgattgatcctgggggagtcacttaagttctctgtgtctcattttccttcctataaaatggagctaatactaacctcaaaaagttggtgtgggattaagtaaagttctcagaaccatgcctgatacacagtaagcacccaattgttgaaaaataaataaataaaaatttaaagagaggaatactccatgccaatctcactatctgactgtgactagtttaactgtccctgccctattgtggccagattatggcaagcacatgggacagtcaccctaaactcttctaaaagctcagcacagactccattcctcagctcaaaacaaacctctgccctgccaccacccaccctctagacttggcctcagcctacctcccaggggcacacagcctcctactcaccagagatcctgccatcgatgggggcctgtggcatcgtgggggaggagcagtctccctcagtcttgcagcccagctcctcacagtgaaatacatcgagggactcctccctgccaaggggccacttagacagggggctcaagaagctggcaggccccagatgtgatggctgctgcaggagatccctttggggggccaactgagggggcccggtcccctctgcaagcagataagcaccaattgattctgtggggagaatcctgagcctcccccagctcagacccctcaatgccatgcctgggagccccgtgaggcagcactcccaatgctcttcttccatctggtccccaggtggaaggtcaaggagacatagggtccccgagctctggcacaggtgagggccagacagcacaggggccaacctcagctctgagacaagtaacttaatctctcaaacccaccccttgcaaagccaagaggtgacagaaccaggtccagaatccagatgcttgtatcttagtcctgtatcctctccatccacccaacaaatatttattaagaactttctgtgagccaggcattgttctaaagcatgtgggggacatatcactgaacccaaaaaaggccccttccctcaaggagcttatattatagtgggagggtaagggggttgcaaacggagagaatgtgtaaaataaaaaaggaaatagtatacaatatgaggggggtgagaataaagcactgtaagacagatagggaatcctgggaaagacaggtacatgatggtaagggaaggtctcactgaagtgttaacatctagtagacatctaaaggaaagagaggagtgagctatgtgagaatctagaagagggaatgccaggcagagggagcagcaagagcaaaggccctgaggcaggaatgtgtctggcttattcaatgaccatggaggctgttgtagctagagcagcatgagcaagggggagagggttgggagaggacagcagaaggcaggagtcatttataaggactgtggctgggcagcccgggtggctcagcggtttagcgccaccttcagcccagggtgtgatcctggagacctgggttcgagtcccatgtcaggctccctgcatggagcctgcttctccctctgcctgtgtctctgcctctctctctctctctctgtgtctctcatgaataaagaaataagatctttaaaaaaaataaggactgtggctttgactctgagtttgatgggagccattggaagattttgagcagagaagtgacatgatctgatttattaatctctctggctactctattgtgaatagatcataggagatcaagagtgaaaacaaggacatcagtgaggagattctctagaagtgatgagggctgggccatgggcagcaatagaggtgtgtgaagtgattgagttctggatagattatgagggtagagtccactggtcgtgttgatggttgggatttaagtgggaaaaaaaagaaaacaagcagaggtgacatccaacattttggccagagcagtcaggaagatgatgttgcagtctgctgagatgaggaatcccagaagaggagtagagttgtggggagagaggtgggacaggtgtttgctttaggagctcttaaggttgaaatgcccattagacatcccaggggaggtatagggtaggcaatgtggggtgtgaaagtctagaatttgcaggggtctgtaggggtatatgtaggggtcatcggtactagatggtatttaacactctaggtctgagtgcagatagagaagaggccccttgagccatggggtactccaacatttagaagaaggagagaaaaagaaaagccaggaaactgaggagtgaccatggggtgttctggaagtcaagggaagagtttgaggggagggggtatgaccattgaaggccatgagaggtgacagtgaataagtattgacagtggacagagacatccccacattcaggtttctagaaaagagtttccacaaagagatcaggaggagagggaatagggacaccagacaacaatgctttgctagagaggagtgcagagaaatggggagatgggtggtctcaggagacccacaggggccaggggtgatggcttaggaggcagggcagaggggagctgggagcccagcccacacagctgcctcttcctttgcctggaggaatccctgttcttccaatgaagccaacttggggtagggtcccagagctctgagaggagcctcctcacctttcaggaggcaagggtagcgctgagtgggcatcttctgcctgaaggcccctccaaaaaagggcccacacaccagggcttgcctctgggtcttgatgtactggagcagctcatacaggacgtcccctaggggtgaaggcaagaagcaggtcggtcacctgcctcttgagtgaggtctgggatcagttacaagcttcatgctgatgagatgagaggcagcagagtggaaagggttaggggagacaagagctgtggggaaggcgaggggaagtgacagtaggacagagctctggggctctgcaaacaacacccagattcctttgctgcagcctgcttttgtgaggaaccactaggcaaacatttatggaaaaggggatgtctgccatgctggaagctgagaatgctcctccaaccaacacgtccatctccctccagcttcctccctgggcctacctggttttcattggaatgttttagagggaattcagtgagtttctctgacctgaaccaggtgcacgaagccggaagtcatccttggtgaggatgcagagggctcggccattcatctcaaatccatgctccccagtgcgctccagagagtactcctgctctgcccaacgcagccagtgcagtacgtcctccctgctccagagtgccggctggatgcctgcaaccagagggacagggactgagagagagcacagggtggggacaggagctctcccctcaacaatcactcatccttccatttcaggccctctctggaatatcacctcctccaagaagcccactcagaacgctacatctgagcagatgctctgctgtcctgtctcctcctttgtcaccaggtcctgttcttttacttcctagtaccttacttttcctcgtcattgcacttgatatggtcatatgtttaagttaatcattatctatgcattttgtatatgttcacttattttactttgggtaccccctccccctggcctgttttccaactattaagtcaacaaatatttactgaggaactattatatgccaggcaccaggctggatgtgctagggcaccttgttctatgtattcagcacccaggacagcgaccggaccacaggaggcgctccacagatatgtgttgagtgatggcatgtatgattagacgtgaagaaagggtgttactgtgactgtttccccaataaggaagctgaggctcccagaggctaaatgactagccccgggttacacaggtaacacgaggtacagccaggcccagaatccaggtctgtctggctgccccactcttccgctctcttgtaccagctcaggtctgggtttgctcagagagcagcccaagggaccaggaagtctcctgcacccattttaagtttgtgtgttcttgcctctggcaatacccagacaatgagttgctttcttttattccttctctctacatgtctacactgcctggacctattatgcttctaatgccaattatttgcctcactcatctgggttgcatttaagagggccacgtgacaactttcacggtccttggtactcttgcttataggccctttccttccctaaaaaatatttttaattttattttatgactacactggtataaagacgagtatattgttatgtattaaaacattttcttctgcctaaaagttttttttctcctaattttaaaataaatcagaacatttctgttggcccctaaaaatactggggcccccagaactgtgcccactgtgttgacaacctggggctttgctttgtgtggtgcttctcctctcaagagcatttcaaccctgccaggatcctggccatgtaacagtggaaggagctcagggttcatcagggctggtatgacaggtagaaagctgaggcaggggagatacctgtccatggccatatcttggcagtgacaaagatggagccaacctgtgactactttggtcccaaatcagcacaagagataaaactcattttcaagtttacgaaagaaagaaagagaaaaaagaaaaagtgcagtatccacttattcatcaattcagccaatatcccaggcaaagtgaggctggcaggagggaggtaaccaatgactacccaatgaaatcctgctcagccatgcagagggaaagagccctgagctacaaacacagaaagcagggcaacacagcccagcatgggaggaaggaggggctccttactttattttgggactgaagaatgaataataaagaagaaatttctgaaactgactgaaaaattatttaagggggaaaaaaaagaacagacgtggcaactggcattcatggtactacataccacaaaaccacgtaatcaagatctgacgctattacctgagactcacaagtatcattggaaaagaaggagcccgaaagtgtgaggtggggttttaattcagtgggaaaggatagtgactttaagctatggtaaaaaccacattggttgtccacctggaaaaaaatatatctggacctttacctgtcaccatttacaaaaatcagttccaaatgggattaagccttaatatatagaataatagaaactcaatagaaaaaaattaattaattaaaaaaaaagaaactcaatagaagtgggggcacctgggtgactcaatcagttaagcatctgccttcagctcaggtcataatctcagcgtcctgggatcgagccccaagtcgggctccctcctcagtgaggagactgcttctccctccccctctgcctgccactctcctcagcttatactcgtccaccctctctctgtcaaacaaataaatgaaatcttaaaaaaaagaaaaaaagtggaaatagggggagtacttgacgtcttacttggaggagcatgcaactttttatttcagggttgtgagttcgagccccatgctgagcatagagattacttaaaaataaaatatttaaaaagcaggaataggaaacccacatgcattcaataaggatgggggaacctcaaacctcaaccatgacagtaaactcagaggctataacattatgtggaggatgcacttgactacattaggttttgtatgtgtgtgtataccataaatgaaactaaaagagagcagaataaaggaaaataatttgcaatgtagatgacaaataaaggatgaatgtctatcataagtgaagagcacctttaaattgattttttttttttttaagaccaaacatcttaccagcaattcaggtggagcaatcagcctcggcacttctgacactttgcacctgataattccttgctgtgggggctatcccgagctttgtggaatgttcagcaggatccctggcccctgcccactagatgtcagcagcaaacacacacacacacacacacacacacacacacacacacacactgagatgtgacaaccaaaaatgtctgcagacactgggcagccctggtggctcaacggtttagcaccaccttcggcatggggtgtgatcctggagactcgggattgagtcccacatcaggctccctgcatggagcctgcttctctctctgcctgtctctgcctctctctctctgtctgtcatgaataaataaataaaatctttaaaaaaaaagtctgaaaaaaaatgtctgtagacattgcctcgtgtccccaagggagaggagaaaaattgcttccacttgagaacctctacagtagaacaatccactaataaagatgcgccaagacatgacacttcacagtcagggacaggcataatcagagaagaatgagatatcattttaatgataacacctacacctgacaggaatgcaggggaaaggatgccttgctggtggaaataggaatttagagcctccatgagagatcagtccagtaatcacagaagtgactgagacacaaaagctgagtggtatgaaagctgaagccacctgacagtaagattcaggagtatcaggggcaggcccatcagccagccagggcttctggggctctgggagcccactggccattgcatttttgcgggattgcctatttcatgatatttgaggctgtcatcctgaaaattcaaaactatgttccagagtcagaggaaaacatggtcctgtgtttggccagagtgaggggatggaatctaccccctccagctgtcctgcttccagagaaacactaaaactacagaaagaggaggaaaccatgaacttggcagatagtatcaaccacagatgtggtcctgctaccaggtctggagacaggggcataggacttcccaagccatctgtgactgactctaaggtcacacaatagtacctgaaagtgaagccagtcgtcactccggagtgaaatttggtttttctttcattacctcttcttctctcctaccctcacttttcatccctctgctgtcaaaacctccagtccaataaatacagaaaaaggaccttccggttccttgtgtcctcaaagaatactagggtcacaaaaggctttccaataggatttgagcccccagggaaggaccaagttccaagcagtggctcagccatctagttctgggccaaacctccaaccccagggtctgggtcccagctcaaccccttactagccaaatcacctacaaggtgttcttagcctcaatccccccacccctgtaaaatgggataaaatttcactgcctgagtgggctgctgggctgtatgaggggcaggatggtggaggggttagggacccaggctacatactatatcattcagcatctcacccctacgtaaagacccaagagacatggtgggaatgcatccaccagaagacatatatgcgaatgtccgcagtgtcagttcataacagacaagtatggaaacattccaaatatccatcagccagaggagggacaatcaaattgtgatgtgtccacgcaatggaatgctgcctggccattaaacagagagtataaggcactgctaatccatgacacatggattaaagtttactgatatattgaaggaaagaagccagacgtaaacatgtaatcaagaacagatactaatctagggggagaaatcagagcagtggttgccctttgtaggggaagggaccggggagaggagcaggggaacttcctgggacactggaaaaggtctagttcccgatctcactatggctcacaggtgtatccaaacataaacatagggatccctgggtggcgcagcggtttggcgcctgcctttggcccagggcacgatcctggagacccgggatcgaatcccacgtcgggctccctgcatggagcctgcttcttcctctgcctgtgtctctgcctctctctctctctgtgtgactatcataaataaataaaatcttaaaaaaaaaaaaacagaaaaaaaacaaacataaacatttgtagactcaagatctgtacacataatcttatgtaaattatacctaaaagaaaaggagaatcatacaacaaaaaggatcaatgatgttgccagaccagctgaaaactggcaaaacaactatgcttcagtgtcctcaccagcacatcgagggtggtgacgaatacagtactagcaacatgggactgtcatgagggttctacaagatcaccaacttaaagaccagggtctggcacgtggtatgtgctttccaagacaagtggagctcctgacactagctgaggtgacacaagtaaaatggttggcacaggactcagcacagcctaagagcttagcaattgctgacgagcattatctaaggtgtccactacccacccaccctcacacacacaatgtcttcctgacctcattactgggatgaccctaagagtctccccttaccagtctaaccacctttcaagggctttacctgcaaaccaacccatgcttttccctctcttggatgtgatccactgtattttcagttcctcacatcaaccatctttgtgtctcaagactccagctgataccaccttactctccctgccccaactacatgcttactggggatttccagcttggctggttcctgactcctgggacagatctggacagagccgccagctgggaaagatggagggttcatgtatcttcctgaagagtcagcactgcctcccacccacccccagagcagggcaggactcaagggctaccctccccatcctgggccacattatcctcttattacttattgcttattactgggcatcctgcttccttatgcagtcacggcatccctcgctagaatgtcagctccatgaccacagaccttgccagtctcggtcactgctgtctctccagcacctacagcaatgcccagcacacaggagatgctcaataaatataaattgcttaaatgagtgagctgaaggacttctaggcatcctgaccaactcccagtcctaccccaaccaggtctcttttctcatagcatccctttcactctcttgctcaagaaactgacatggctcccaacaatcaaccccagcaagtcaaaaaccctctgtcttgatttccagactccctccagctgccccttcccatgtgaccaaagctatttcccagctattccttaccatactcctgcagtttgctggatagagtgacctccagaacaacagagctggaccaatcattagcaaccaaatcagaactaacatctggtttctaccttcctggcagggttctcaggaggaatgcaggaaactatgaagtacttggctagtcctttaaaaatgaaagctgtcatcatcccacagtggaggctgatgctcagagtaaatgacagcttcagagtctgacgtacctgagtttgaatcccagccccccatctttttactgatgggtgactatggacaagataattcttttttttaagatcgtatttgtttattcataagagatacagagagagaggcagaaacataggcggagcgagaagcaggctccccgcagggagcctgggattacgccctgagctgaaggcagatgctcaatcgctgagccacccaggtgccccaaggacaagataattctccccactctaagaccaatgttcacatctataagatggggataataaaagaatctattttccaggcctgttcaagtgtatttaatcagacagtatatacaacacacccagcacaatgcctggtcaagagtaacaattcaacaaatggtatttattatgattatcagcatcctcattggtggagcttgcctgaaaatagagggactagcttgtttctctgctctgatgaccatagtttagcaattaccattgtccttggtttactgagagtcactgtccagcagcctcaaatccatcaccccattgtttgccctgttaacttagctaatattgcttttcttggcaatcatactcagctttatattcaccagacaatggggcagggccagcacacacagttgtgttgtgtcttgcacaaagccaccattaaggaaggaatgggagggtagagataaaaccaagggctttggcttagcttcttccaaaagtgaggttcttttcaatcggcacaaagatgcacacagtctagtccaggccctgacttgagggaggaggaagctcttggtttccaaattgttgggtttgggaatctcccatctgtttgttgtttgccatattccctttcattggcaggtgacaaacatcattgtctatattcaaagcttctaggacatgcgcttctagtctccagactccccattccaccccattctacctttgtcttggcacctgcgtccatctaacttactacttgtcatatgccaccatctagggcaaagtttctcagaccattctgacctcaactggaagtaaaaaaaaaaaaatgcattttatatcatgacccatacttataaagagcccaaagtatttgtaaaatgttctatttcattttttaaagatacttattttgatccattaaattgattccactccttagtgaatcctgaccaaacactttgaaaagcaccattaggacatagctatataaaatgaggtcctcaaatgtatttctagcagcagcagtgtcacccaggagtctactagagatatagctctctagaagctatgtcccaccctaaagctactgaatcaaaatctgtgtatctagcaaggctcacaggagtctcatttgcatgtgaaaaattgagccaccctggtccaggagaggaggaagctacactctgttagaattgtatatatgaaaatgagtgcccagagattctgtataggtgaaagatatgaacttgaacagcaacacgaacacctgttagagttcccccaagggcctcttcccttgttttatactgccagggagttgcagggatgtgtcatccctctgcctttgacatttgaaaattggacagggtgtgctttgtggtctcttcccatggcttactcacaactaggagctttgaaagtcaatttcaaaatgcagaaatcacagttcttctccatccagcagtgggaagttgacagagtttttttccccagggaataagctccagcaaaatgcaaagacatgggaccaaggactaagagtccaaggtgtgaggccctatctggccattagctgcacagatgactttctcacatggcgtctcagtgtctctgtcatcaaatgtggctgtgccagtgaccatctctaaactgcctcttctcaaaatcccctgagcagtccccttgaggttgcatcatttcctctcagacttactccccagggacctctgcccagcccctgccagtggtccctgggcctgtactgtcttcacagctcctgactcaccctggccttgagaaaatccttgtggatgcagactgggggatggggaaatgaattctctttcactctccacttccaaagagggaggaatcattgtgaatctccttttgtgagtgcaggacacagtgctggagcctcgtggatccagcccctcagtcccagcctacttcccgtcactagacaggacagtcatctttggagtgaactctgcactgctctaatgaacatctttgtttgtcaggcaaataggcacggaaatgtaagctctacagggaagttgtgtgtgctccacttatcaccaactcacaaagctaagcaagatttgttttgtttattcaccttcctgaggaggcaaatcaccctgatgattagaatagaagccagagatggaggagggaatggggtgggcaattggggataaatgtcagagagatgccaggcaatggaaacccaatttcaggaaacagggatgacatcactccagccatttgaaaggtcaatctctcattaggtgtcaggagtttgcttctttgggatgttgttggcaggaaaatgagtcatttagtgtgccctatcttttaagattgttagatatttactaaaggccagaaccgtgttgcctgaatattttcagaagtaaatatgagtcatgaaatctaagatgagaagtatagaagatgctgctggggtcctgctcaaggcccttagctctcacctctactccctgaaggccactgaatgctgaatgtcagcacctgactctgcatctgacttagccaatgcagaggacaacttggaaagctgaagaggaatgagaaagtagggatgaagccaagccaatccctggctgggtttggctccacttctccgcaaaggaggggtctttccaatttgctgtagaatcaaggaagcagcctcaccccatcatggatgggaagtgggtagatgaagaacctgcctctttatccctgggctagcatgactcagggggtgctctcactgtaccccagaagtcccctctgggagtgagctccaactgcccacagtgctacaatttaaatttcttttttttttctttttaagattttatttatttacttatttatttagagagagcacaagtggtgggggaggaacagagggagagggggaaagaatcccaagcagactctgggctgaacatggagcccaacatgggtgggatcccacaacccttagatcacgatctgagccaaaacaaagagtcagacacaaccaactgagccacccagccactcctacaatttaaatttaaatggaatttccttctctctctcctccatggggaagtttttccaggtctgtttctggagaaatctaaccaaaggctatagcactagtacctcaggagctctaaatagatcaaatgacctgcaccctgagttgagtaacagggaataaggctggctgaagaggggaggacgttcttgtcactagaaatgtgcagaaagacctggggaccatctcagaagggacccaccaaaggtgacctcaaaaaattaaaagccctgcataactgcatttaccaagatgatgactaaattttctaagtccctactccctctcctgtaccctcttacccaataaccttgagctagacacccagaagaagggaggtgaccaaagattacttgaccttgggcagaacacaatcttctggccctcaatttctggaatataagtgagttacctgaggcaacatctagggtctctatcagtgttgacattctagaacttggtgtgcaagttatgggggcggtctttgaatatgggggaggaaatggggggtaatctagagggccttgtggaacctgcaaagtagcccgtccctctctgagaatcggggtcctcagctgccatgagatgacatcaaagcttcttctcaacagcaacactcagggtcttcaggtctgtccccaaagttccatttttcctcattgccatggcttgggttgggtcagagtccaaattctatcctctatgtaaccattgccaaatatctccttggaacagccctgagccccgagctaccagtcagggcaggcatttggacaaaatgaaacaacagagattctttatagagctccatgcccgcctccctaaatcacactgccacttcctccaccactgctctgaggcatgagggcatccttcacactctgtggttctctcatatccatgagtccccctcttatcctcattaaaagaataccaggctgtggacagcaggggtatttggggggtatccaggtcttcccaaggcctgtaaagtcatacccaacattctgctcaatcctgttggtggctcaaaaatcaggtcgtggccaggaaatcagaagggtatgaaatcggtgtttcagacactgagtgagttgagcaagaagtggcctggaggtttcacaactcacgtcagatgtagctacccacagctgccccaagaagattaagaccttccactggcagtcggcttgctgcctatcccatgatttccatggcttaggaagtacatttaaaaatctcttggaagattatcagcaggaccaaggtttggccttagcatggagagcccatgtgctcttgagcatgtcacttagcttttccacctctcagctctggtcattgaaatacagacataaatacatgaatctacagcctgttctatggttatgagtttactcagacaagagcattacttaggaaagtgaaataaaaggatatggccagtatacttcccgtggctctctttgggcagatttgattattctacctattcttcttatgcttccctgccatttcccatttttttatgataagcacatgctacttttgtaacaataaaaattaaacataattatttaaaagagagttctacatacatatagctgttgctcactgattaaccctatctggcttcctcattagcaatatccccaactctttgtctttagactggaagagaacccatagctcatttgatcccagccttcatcttactaatgaggagactgccggccctaacctttggccacggcagctgcgctctctgcagtgagaattcacatttacatcctctgactttctcaccaaggaaaagttaaataaaacccagcaaagaaatagtaaatggagggaaggcagttccttaggtaagaagtttatgtgtcacatttatgtcctttaaaaacatcagcctggggcacctgggtggctcagtcgattaagtgtacaactcttgatttatgctcaggtcatgatctcagggtggtgagatgaagtcccatgttgttgggcaccacactcagtggggagtctatttgagagtctctctctccctctatcccttcccaccatattctctctctctctctctctctcaaataaataaacaaatcttaaaaaaaaaaaaaaaagtcagccttttcctcctctctactcacggagtcttcctggcaacttgcagatttccccttcacccagcaagttcattctagcttcacatctggcctgggctcctgggggtggtgtggctgcctcggggctcacagaagagctggccaatgctccctcctagaaagaggaaaaaccagggcagtcaaagacaaaccttcttggtgaagtctcagtcatccttaaacgtattaagaacttttctcaaagggaaagagcatccatctctgcatctaccttaaaggtaggaaccatgtggggtgcctgggtagttcagttgcctgggagtctgcttctccctctccctctgctcctcccccctgcttactctctctctctctcaaataaataagtgagaaattaaaaaaaaatttaaggtaggaaccatgcgcgtcttcagcttgatatcttcaacattttgtacagagtagacacttgataaatttcatctttctgattcaagtttttcatgcatatgcgtaaccccaccagaaggctcccctgccaaaatttgacttgtaagatagaaatctgagagtctagaaatatctactgggaccttggtgagaggacacaggggacatgaggggccaggataaaaagaccttaagttgtaaataaataaactagtaaatgcttattttaagggagaaaaaggaaggataaatttctgaatcccaaaatccctccaagggaagcctgtatctttacaattttataacaagctcagccccagaggtgatttggttcatccctcaggatgaggggatgaaaaagtgacaagattttgtagaaacagaagtggccttggggcttatgcccagctatataggtgccactccgtgaaaagtaaaagtgaaactagtcccagcaagtcattttctcaaactaggatcttcaagagcattacattcatctcttgatgtctgagaagggcaaccggcagtgaaagactgtggatctggagctgcaaagcagaggaggttttaacaccttttggggtagttctcactgcatttctggctggtatccccaaccccaccctcaaccccctccaaggctggtgctatttcccaggtaacccagcctcttgaggctgccacctaggagcattggcttgccaagctggagaagggtctagggtctcatgcttgcaggaaagccccctgtggactcctctagcctcttccaagcattaggatcagccaattctggagtttcagctgcctggaaaataccagccagggagctactgagagaactctgggcttctgcatgaaggccagggggaggtctgataaactgtggatatggatctgaatcttcttagagagaggaggtggaaaagggccttggaggtgggaagggaaccagctctggggcagttctgaagctgctggtgaaatatggcaaatggagagggactgcttgagtgggggcccctctgcagtggcgcttttgtcagctattagggtcgcaggaacttccagggacgtcacaactggatgatccaagggtgaggaggatgtaaggaggagcagaatagaacacagagaggttccgaggagagacagtgaggctggaggtgagtgaggagggaggccggtgagggatgaatggtgaggtttggggaaatgttggagagtgagattccaggcaggaaaaaggtctgataacttgggtatggaatttgaggtggcggagaagggatgggggtgcggagactcggcgcgctgaggggttcagccgccaggctcttacctgcattacaggtggaggtgggagagccgccgcggccgctgggcgctctcgggccctccttcccacccaccccgcaacgggccccggcactggaaggcgaggaggaggaaacctctttggagaagtgccgggcagcgtgccctcgggttccccggaccagcaggctcacagggcgctcgggtaatcgctgtccttccgggaaacgaaaacgaaagagcgggatctggcttccactcccgccccggcggctccgcggagggcaggcgcggcgggcgctgtcgggtcgccgccgcgaggcgtgggtccggctcgcgtcctcccaggacggcctggcgctggctcccgggggcacgggcgtgagattctgcgggacctggggggccgagagaaccaacagccacagaccaactgcgtgtcacccctgtgtgtctccgcatttggatggaggggaccttccatgctgccccctggccggggcctctccccttagggatgagcgacccccctggtcctgcccccaccccggcctgccgtttggcccgccgtgccccaccacccaggcagagccccatcatcagagcggctgtgctactccccccgatagaccctagtgactgtggatcccggctggcgcctttccccaggcctcggctcctccaggcacacccgcacacccgcacacccgcacacccgcacacacgcacacacgcacgagaaaaggagggaagtctgaaccttctgcggaaacttcaaggtatacatggggttacaaagaaggcttagcgctgatacagcgtgagctcccaggaactagtaagaacaaggccaaaaacccaatagaaaaaatgagcaaaggatatgaatagacagtgcacataaaacaaaatatcgaggcagcccgggtggctcagcggtttagcgccgcctgcagcccagggcgtgaccctggagacctgggatcgagtcccacgtcgggctccctgcggggagcctgcttctccctctgcctgtgtctctgtctctctctctcctctgtttcccatgaacaaataaataaataaatctaaaagaaaaaaaaaactttaaaacaaaatatcgaatggccctgggaacataaaagaagatgctcagactcacccgttataaaagatacgcacattaaagtttttgagataccatttttttacctgttaagttggcaaaaattcaaaagtttaataacatagtctgctggagaggctgaggggaacagagaacaccgggcaacccatggaaggtagtaaggcaagatctggcaaagttacaaatacatgtacccttcccccagcaatcccactactggaaatgtattcaataaatctacctgcacatatccagaatgcacctgctatttatttcagcatggctgttgataatgattagaaacaatccaggtatccattaaaagaggctgctgaggggcacctgggtggctcagtggttgagtgtctgcctttagttcagggcgtgatccccaggtcctgggatggagtctcacatcgggctccctgcatggagcctgcttctccctctgcctgtctctctgcctctctctgtgtgtgtctcatgaataaacaaataaaaaatttttttaaaaagaggggagctaatgaaataaattatggtagatccctttaacagaacaccatgcatcgtctgaaagagctctctgtgtcagatggcaagctctccaagaggtagtatagtatagcagttaagaatctagattctagggacacttgggtggctcagcagttgagctctgctttcatctcagggcgtgatcctggagttcagggattgagtcccacatcgggctccttgaggggagcctgcttctccctctgtctatgtctctgcctctctctctgtgtgtgtctctaatgaataagtaaataaaaccttaaaaaaaaaaaaagaatctagattctgggggcccatggatgactcagttggttaacccaccaactcttgattcccattcagggttgtgagattgaggttccactttgggctccatgctcaacacagagtttgcttgagactctctttccctctgctcctcctccccctaataaataaataaatcttttgaaaaagagggatccctgggtggcgcagcggtttagcgcctgcctttggcccagggcgtgatcctggagacccaggatcgaatcccacgtcgggctcctggtgcatggagcctgcttctccctctgcctgtgtctctgcctctctctctctctctctctctctctctctctgtgactatcataaataaataaaaatttaaaaaaatattttaaaaaagagaaaaagaacctagcctggaattccagctatgtcacttactggctatgtgcccttatggaaactagttaactgctctacttcctctctctattaactgccttagtttccttaacagtaagagctaataaaaataatacctgtctcttaaggttgctattagaagtaaataagttaacattcgtaagactactgatcaccatgctaagcaaaaaaaaaaaaatcaaggtacataacagtgtgtactacatacttccttttagggtaaatatacgtatgtgtgtttatgttatgtatttgtacatagaaactctaaagggatatgtaacaaactattagacataactgggattcaggatagaaaataagagcaagagttttcattggaaacctttttatattgttttgatttttaaccataggaataaatacctatcaaaagagtaaatataaataagaaagatgttccagcattcatccatccatgtcagcaaaccaaaacctaaataatgatgggactgtataggcattacctgcgacaaactggaaaattggggacatttcccttttggaaggacaaaggtgatgctacatatgatcaaagtctacaaaattttgaacccaaatgagcaggaataagtggaatccctccttcacaaaagaaatatgcacagttggagcacttgggtggtacgtcaggtaggcatccagctcttgatttcagctcaggtcatgaactcagggcatcatgacatcacactcacatccactccatgctcagcacagagtcttcttgtccctcttcctccccctctgcccctcccccagctctcacttgctctcaaataaataaataaacaaaatctttttttaaaaaaagaaatatgcacaggtgtttcatgttgaaaaaataacaatatttatttcatttttaaattatttatttttaaataatacttatcctacaaagaactcaaaaggtatatatagaacttataatttataaccacaaactttcttaatacttgtgatacttcaaaaagggggaagagagggaagatgaggtagacaggtggaagaacagggcactggagacctgggcacaggcaacaaggggggaccaacagatcactggagggcctggtaccccaggaaggggcaggagaaagcacccatttctgtgacctctgctttgaggatgaggttcaattttactcatggaagaaaatgtttaagatttccttacaaggaacacagggaccatccacagcgctggtgttctctaagtgtcatggccatcttgggcttttccaggaggcaatcacaaacatctcatagctggttgctctgcacaaacaagtggccgatgagtctgcatttctccaacaaaccaggtgtgaaccaacagtgatgggtaaaaaagaaggagatggagaagggttttctttcatctgttctagtaggattcaggttttctcagaagacaggagcaaagcaggagttggcatttacattccttttacagcaaatggttattccagagaaagcgcagcaacacatgaactcctccaaagaaaagcaagacaaaatgagccagtgcctctctgacttcctgttggagatcctgtttaacacaagaatgagaggggagggggttaaaaaaaaaaaaaagcaatagaacaatcagtagatagaaactccatattaagattaattcaatcaatgtcacaaacaagcttcttgggctgctttatgaactgtatgagccggacaatatcttggtctgttgtgtaatgtccacatcctctgcatgccctgggaagtcttcctctgggcgggttttcccatcttaaccatcagcaatcggggcactcttttcagggctgatgacctcttcctctggctttgcagagcctttgctttgttctctcaaagaagcaagatgtttgctttggggttgaaagaaaggataggacatagatgagtgtgtgggggtgaatatgagccaagttggaggtaacagagcacagcaggtctgtggagcagtaagcacacaccactgtttatttgtgaacatcaagagaacaaggctgagggtcaaatacaaatgggtctccctgtccctgtccctcgtccggcagtcccttctcaacacagcagacttggtgggccatgaactgtgctcctctgctcaatgctctccagcggctctgcctcagtcctcagggggacctcagcgccctccctcatctgcctctaccaaccactctgacatagattttactactttttctcctactcagcctcagcctcattgcttccttgctcaaacatgccatatctgctcctgcctctgagtctctgctttcggcttgcctccactgttaccccaccccaccccactcaggacccagaatcttggggtcctgagatcatccagggctccctccacacctctgtcaaggttttgctcagaaattaccctcccagtaaggccttccctcctcaacttaaaactgtaaatcctccaacactcttcatttctttccttgctttatttttctccacaatatttatcagtgtctgataagctatatactttatttgttcacttatagtttgtctcccttttagattatcaactccatgagattagggagttgtctcattttttaaaagattttatttatttacttgagagaaagagagaacatacacacgggggctaaggagaaagggagagggagaagcagactccccactaaagcagagagcctgacaaggggctcaatcccagaacccaagatcatgatctaagccaaaggcatccacttaaacaactgagccatccaggttccccagttttgtctcttttaatctctgccataactccagtacttaaacagatcctgacacacagtagatactcaataagtgttagttgaataaatgaatgaatgaatgataaaccaatagtagcaagctaaagaatttagactgtgtcctgtcagcaactgggaatcattagaggattttcccccctttttagttgatatcagttaggaaaattgaacgagtttccttccagcaatgtagatgagaaaatgtatacagcaccaagtcagatgctcatatatttaaattctagttttgtcacttaattgccaagtgaccttaggttacctaatctctctgagcctcaaccgatttctcctgaaatgctaatccactaacccataaaattattgggagaattaaatgaaatgtttaagagtctttcaaagagcacctgcaagaaattgtttaataaacattggcttctctcccctctttctaacaagctaagatattccatatgcattattgtaccaatgagggtcccagagggaacagatggcacactgcagagtaggataattcagaaagaggggtacttgggtggttcagttcacttgggtcatgatcttggggtcctgagatcaagccctacatcagggtccctgctccatgggaggcttctcactctctctttgtccccaatctcgtgctcactctctctcaatcatgcagtctctctctctctcataaataaataaaatctttttttaaaaaaaggataattcagggagagttaaataaagagactatctacaaaggtgggggacaaacaaggtgatgcagttccccaggctagtaatgtctcaattattgccactcctaggcctgtaaggatggcaggggaggcaagggcacaatttctagaatccaaaaggaaagagtcctctagagaaaaattccaaagacatatttaaatcctaaaagtgataggaagactattttaaaacatactttaggggggatccctgggtggtgcagcggtttagcgcctgcctttggcccagggcgcgatcctggagacccgggatcgaatcccacgtcaggctcctggtgcatggaacctgtttctccctctgcctgtgtctctgcctctctctctctctctgtgtgactatcataaataaataaaaattaaaaaaaaaaaacatactttagggatacctgggtggcagagtcagttaagcattcaattcttggttttggctcaggttatgatctcggagttgtggaatcaagctccacattgggctctgcactcagtgtggaatctgctggggattttttttccttttcaccaacccctttaaaaaaaaaaaaataaattttttcttaaaataataaaattaaaacttcctttttacctaggaaaattccatcccctgaatggggggggggggggggaagaccaggtccttgaaccaaaatcccgcaaaacccctaaatagcaaaatagaagatgttttttttttaatttttatttatttatgatagtcacagagagagaaagagaggcagagacacaggcagagagaagcaggctccatgcaccgggagcccgacgtgggaatcgatccccggtctccaggatcgcgccctaggccaaaggcaggcgccaaaccgctgtgccacccagggatcccagaagatgtcatttttgagaatcaaggcctatttgaaaataaagaacacttgcttaagtgaaaaccgcaagaaatcaaattacatggcagctcaaggacaatccatttagcagacaaaagctgctccttgttagggagtttcaagagcaagaataaaagtttctttaaatacaccaaaagcaagaagacatctggagaatcactgtggccacttgattaaacagagtacaaaaggtaaataaatgatgactatatatgaaatataccattccaggtttgaaattctgttaaagttgcttgatttaagtcttgaaccagcagagtaaagccttgagcattttagagccaaacttcagaggtattttttaaattattttttaaatgtactgtggtctatttataagtggtctaaaatgtaattttgtggtccaggacaagatatctttaacagtctagggcaaagccagctttgaaaaatgctgcagggaaagctagggcaggcgtatagatagacacacagatcaatggaatagaatggagagtccagaaataaaccctcacatttacagccaaatgatttttgacaaggatgacaaggcaatttaatagggagagaatagtcttttcttttcaacaaatagtgctgggacagctggatacccatatgcaaaggaacgaagatgatcttttaactcataccatatgtaaaaacgaactccaaatggatcaaagacctaaatataagggctaaaactaaatctctcagaagaacaaataggtgtaaatcttcatggctttggattaggcaatggcttcttagatataaccccaaaagtagcagaaataaaagaaaaaaatacataaattgaactccatcaaaattaaaaactgtgcttaaagaacaccatcaaaaaagtgaaaatgggagaaaatataaggaacctccacctagaatgtacaaagaactcctacaactcaataatgaaaaagaagaataatccaattttaaaatggacaaagaatgtgaatagacatttttccaaggagatatacaaatgagcagtaagcacataggaagatatacaacatcagggaatcccatcagggaattgtagatcacttgggactccacacccaccaggctggctataataaaaaagacagttaacaacaaatgttgtcaaggatgtggagaaactggaatcctcacatcctgctactgtgccacaatgtaaaatggtgcagccactttagaaaaccacctggaagttcctccaaaagttaaacataaagttgccccatgactcagcaattccattcctagatatactccacaaagaattgaaaacatatttctacacaaaaacttctacacaaatgttcatggcattgttattcataacagtcaaagtttaaaccaccaaaatgtccatcaactgctgaatggataaacaaaatgtgatacatacatacaatgggataatgttcagcaataaaaagaaatagaatagggcgcctgggtggctcagttggttaagtgtctgccttcagctcaggtcatgatcttagggtcttggaatcaagccccacatagggctccctctgcctgctgctccccatgcttgtgctttcttcctttctccctctcaaataaagaaaacaaaaagaaatagaatactgataggtgttacaatatggaagaaccttgaaaaaaaacatgtgaagtgaaagaaaccatacacgaaaggctgcatattagtccacttacatgaaatgttcagaataggcaaatccatggagatagaaggaattgggtggggctgggaagaaaagtgggaggaaacagaagtgactattaactattgggtctgaggtgtctttctgaggtgatgaaaatgttctaaagttgattctgatgatggctgtacagctctgtgaatattcgaaaaccatttgtcgtacaatctcaataagtgaattgtatagtatgtgaattttatttttccataaagttatttatttttttaaaaagccaggagagttcaatgtcaacttattaagctgtagccgtaaatttaagacataagttaattataccttcaaagggaagggaaagaaagaaggaggaaaattgaataggaagttaggtagagcagtgccctcttgactgggttgaggcaaatacagaaaacaggtcgctgtgctttgtcctcctctgttctctcctcttgaaagaaaaaaattataaggaaccatgagtattcagagtttgcagataaagaagcaggaacattgagctaaggatcttaattcataaagtacagtcatctgggaaaactttcctacagaagagactgcggcctggaagggaaatggtgaataacaggaatatgcggtgataaatgatccatagcagaggtggtcaactccaactgggaaagggcgaaggcagaaaattagttcattcttggctgagataacatttagtcatcattttctgtggctcaggctctgttctaagtgatttacatgaattatctcatttaattttcacgacagtgctcgcttcggcagcacatatactaaaataattttcacgacagcctactctctgcctggcagccagtccttatcctaaatgtagatcaatcagctcatggcactctcctgctctctcttccctgaagcttcctttatctctagggtaaaacccagacaccttaccactgcctctaacactgagaccaacttctggacttcaactctctccactccagcctccttgctgtgccttaagcctgctcctatcacagaggctttgcactccctgttccccagcccagaacacttttccccacaggtattcccatggctcattccctgatttccactctccgctcaaatattgcctccccaagaaaggccttccccaaagtcactgtgcatcactcagcatcccccatccttctttgagcctgcacccctatctgacgagtcatctgctttactgtccccctcctacattacaagttcaacgagtgcaggctcatctgctaccctgctctctgctctggctaccaatgcctggaactgagtctagcatacggtaagcactaaataaaatgtgtttgaatgaaagttgtccatcaaatattttatttgacgctctgtgtttatttcctctttccttctcacttttagtagttgggatgtttagtctcagggaatgtgttctctgagggaagggctgagtattgttcacctttggacccgaccataaaagagggcatggcactccctgaagccaacatgatggcaacagtagtgatgaacaagaaatcatcacaggacaggtccatttgagggaaagaagttgagctctgaaggcagcccctcccccacccagccccacccccttatggagcaattataggttgttctggtggacttgaacacctcttaagacatcaaacggtaatcattcttctttcccgtttccccttattatctcttataataatcaagagaaacaaagaaaccagaggggtagggttatcgttatcacctctgggttggttcaaggaggaaaaccatgacaaagcaaaggctttcttccctgaatgagtattagattcacctggggagcctttttttttttttttttttaagattttacttatttgacagagagcgaacaccagcgggcatgaggctccccagtgaggcggggagcctgaggtgggctcaaccccaggaccataggaatcaggacctgaatcgaaggcaggcacttaaccgactgagccacccaggtgccccaccacctggagagcttttaaagtacctgatgtcgggcagcctgggtggctcagcggtttagcgccgccttcagctcagggcctgatcctggagacctaggatcgagtcccacgtcgggctccctgcatagagcctgcttctccctctgcctgtgtctctgcccctctgtgtctctcatgaataaataaataaaatttaaaaaaaaaagtgcccagaccacacatctcatgccaattaaatcagaatctctcaaggtagggcccaggcggctgttcttcaaactccacaggtgaatctaatatgcactctagtttgagggtgtggagcaacgtttctcacaccttaatgtgcacacacatctctggggtatgtgtaaaaaagtagattctgattccagcactgaggctggggactgagattttgcacattgaccagttgccaaaagctgctgctgctatacagctgtccatgtaccacagtttgaatagcaagtgtgagatcaaatactggctttgactcacgttcacaattttcagatctaatgttcatactctagacattactaatccatgtgttctgttaattcctgggcatcccagccacttgacagccattgttctgtttgcttttcctcgctacctgactgaccgtggctggggaaaacgaagacccacctcttgaaccatcctacgatcaatgctgtctccagtgtttctcaactgcatggccaacttgtggattatttcctcctggtgatggttctggccaatgctactctccttaggctgagaaggcagactgtgatctacattgacaggaaagagttcaagagagatgattaactatctgtaaatcactccccacttgtcactaaaaactgtctcaggcaatgagagggatgaaatctcatcatcaatgattatagaaatgcaaagtcttgccttggaatagattaatctagatttcaaatcttttagaagtaacatcagaaaaaataattttagtagtatattttacttaagacaatacagccaaagtattagtattaaacatataatcaatagaaaattattaccaatatgttttgcattcttatttattatacttaagtctttcaaatccagtgtttattttatacctacagcaatctcaatccaggtgctatcttttcattggaaaaccttaatctgtattttgatttcatgaaatctacagtttaaaggtagatatatacaacccagttgttccaaacatacttaagagttttccaacaatgaaatcaagtgtcaggttttttgtttgtttttactgaaatttgatttgccagcatatagtgtaacacccagttacaagtgctctcctcagtgcccgtcacccaagtgtcagtttttacatttaaataaattaaaaataacgaaaacttaaaactcagttcctcaatgggccacatttcaagcactcaggaggcaaacatggttaatagttactctgctgcacaactcaggtctctatctttatagttttgtaaaatagatttttccatttcatgcttatatccatggtccttgaatgagttcctccttcaagtgctcctcctctccttgaatgagttcctccttgaatgagttcctccttcaagtgctctcttcagtgcccgtcacccaagtgtcagtttttacatttaaataaattaaaaataacgaaaacttaaaactcagttcctcaatgggccacatttcaagcactcaggaggcaaacatggttaatagttactctactgcacaactcaggtctctatctttatagttttgtaaaatagatttttccatttcatgcttatatccatggtccttgaatgagttcctccaaaccttatttgcttttaacaaccaatgagtgtttttaagcaatactatgagtaaactactgtgctggatgctttggggaacttacaaagattaagacaaggtttctgtccttaagttgtgtacaaccgggatccctgggtggcgcagcggtttggcgcctgcctttggcccagggcgcgatcctggagacccaggatcgagtcccacgtcgggctcccggtgcatggagtctgcttctccctctgcctgtgtctctgcctctctctctctctgtgactatcataaataaataaaatttaaaaaaaaaaattaaaaaaaaaaagttgtgtacaaccctctggttgggatgaaacaattaccaagtgcttcaggcatacagaggaggaggaaataaatttggactaaagtagatataagtatggcttcatagacacagcaaattttgcattgaacctattttgtttcaatacaatttgaggactttgattttccaggctttgaactgagagagtaagtcctgtcctcaaaaaatctagcaggagagagacacaaactacaattcaacatgttatatataagagcaaggtctacacagaggagtcaggacagatgacccttaaaaagtgataactgaattcagtcttgaagaatgaagaatgaaaaattagccaggagaagggagagatgggggtgggcccagctgggaaggaatggcaaacgagatctttcaagcagaagtgtcaactgagcaaaagcacagggatgacagtgaggttttgtacataaagtctaagtagggctattgttgaaaggcaggcgatgatgagagacagaggtaagagagtaggcaaaagtaaaatcataaaggcacagaaagaggcttggacttcatctaggagagcaggggacccaccgaaggattttaagctggaaattacaggatcagatttcttctagctctttccttctgggattgaagtggagatgggtaaaatttaagacagggaatgcagtaagaggctactgcaaagtactgcagagagatgataaggagttgccttataataactagcttgcctaccccacgccagcattgtcttactaactacttcctcacaatgacccccatgtggtcataaccgcagggtacagatgagagaactgtggattagggcagtccttttcaaacttggctctggcttggaatcccttgggaagtctttaaaaattcacacagttcaggcctcacttcattccagtgaaatcagttgaaccaagcaagcagcagtattttatttaaagctccttaggtagttgccatggaccggtgatttagatgggttgagtaatttgcccagggtttgaaagctagtaagtgtgagagccaggatttaaacctaggtctgcctggctgcagagcccatattcttaaacctcaccatacagagcttgaactagtgcatacacacctgaagcagtactaataggggtgagtggtgagaacaaatcctataaatacttgggaaacagaataggccagaatttggcaatagattagctgagaaatgtgagggaaaaggaaattcttacttttccagctcaggacactggaaaggtgatggcatcatcagctgtacagagaatgagggtcaagggcggacaggtatagaaggtagaggaggcaggtagaaagaagaagaagctaattttgagttcttttatacatttaaggtacctggtaggacatcttagcaggcatctggaatatttctgaagcaaaaaaacaaaaaaaaagcaatatatccaaagctcaagggatgtcagaactcaaagatttatgagtttcatttatttattcaataaaaatgtaggagagagtaagatctttctgagcttatatagctgatggataagattgatgattaacaaggtaagcaaaggaacaaaagaccataaaaatgactgagaaggaataatgagagaagtaaatgggaaagcagaagaaacagtgttttcctaaccatttttaaatgccttttgaaaatttccttctcagggaacctggatggttcagtgggtcaagcatctgcctttggcttaggtcatgatcctagggtcctgggattgggctctgcactcagtggggaatcagcttctccctccccctctccttttgcccttccctctgctcatgctctctctttcaaataaaatattttttaaaaaaagaaaatttccttctgaaatatattattgggcatcgttacttgtaactatagtatattgactatgactctgtgtgtgcatgtgttgatgaggatgataatgattctgaatcctgaaacacaccttacagtcctttcattaaagatgcccatctttaatgtgatgtccacatccccttccaaaagaatctgccatgttgcctaagcaatcaagctccttccatgtccccaccccaaccctaggccacagctgtttggatcagagatgaatacctgacctaagcacatacactggctggccaggtagtcagaacctagcctctcaagagaacacggtcccttcacctctgttcaatgttcaagagactaagggaaaagttgtcagtaggacaaggaatgccacaggattatgtcaggcctaggataagtcaaagcatttgcaaatgaaaattatgaaggggaaggaaacatttaaaggagagatagaggaagctcccaacagagaagaagtaagcagaacaaacattcattagaaagcaagactcaaaaaagactgggcccagaactgcctcagaacctgaaccctccaagttcagttctgtttcataagcgttctcaccagcaaacacagctttttggaggtgactggagtaagtttcttccctgcaaccaaacaaatagtcatcaatatccatatcaatttccaaagctgtcaaatataggaaaaactgtgtaggaaattgtgttggcaataaatctgcttcagggcagactccaaaagtgaaatttaaaaattagtttccgggcagccccggtggtgcagcggtttagcgccgcctgcagcccggggtgtgatcctggagatccaggatcaagtcccacgtcgggttccctgcatggagcctgtttctctctctgcctgtgtctctgcctctctcgctctctctctgaataaataaataagtaaatcttaaataaataaataaataaataaataataataaaaataaaaattagtttcctggggtgcccagctggctcagtcaatgggatattgactcttgatcccggggttgtgagtccgagccccacactggatgtagagattacttcaaaataaaatctttaaaaaataataaaataaaataaaaattaggttcctggcagcttgtgttttggttctgatcatttagtcattcctcataaaagttgaatgcaagggcgcctgggtggctcagtccgttaaacatcttccttcagctcaggtcatgatcccagggtcctggataagactgaaccccttgtctggctccctgctcagtgctgagtttgcttctccctctccctctgcccctctctcccccgctccttgtgctcatgaatgcacacacacactctctctctctcaaataaataaataaaatatattttttaaagttgaatacaaaatggcttcagggctctgctgtactaacctgtttagtcagcattatttgctgactcttaaagagagactgatatccctgtcctgcagacatttacgcagcaaaataactatgtcaccatattataataaatattataaaattacaggtaagaaattgttaaatcaaatttctaaaacagttatatgttgaagaagtgcaaagtcctgtgacaagataaccaaaacaaattaaacaaaaaagtaaataaaactgtattttccaagtattgaattttttatatccagaggggaaaagtatcttgctctatgctgaaaagttgtatggagaaatatatatatatttatttatataaatatatattttgtattatgtaaatataatatatttatatatatttatatttataaaatagtgtataatcatatatatactatataacatagttactatatatacatataatagtatatatagtattatactatataacatatatactatatatatgtgtgtactatatatatacacacatatctccacacagagttctgaaaataaaatcacagtctaaatgggctactgggaaatctgggacaatcatgtgattaatctttttgcaagaataattccttcataaagcaaataataagcctcaatgtattgtaattttaaaaaacactgctgtaaaaaaataaaataaaaaacactgctgtgtgttaagaatcctacataagaaactttgaccacctctcccttcagttgcactcaggaaatcttctaagcaaatatggttttataagtgtttctctgctgctagctataatgtgaatattttaatttctcatatagtgatcatgctttcataagcttgattttgttcactaaaagtagaggtctagggacttctggctcaaggctgaacacaagcattggcctcccattgcccctaatccctcccaagacatcaccaaaatgaatgtatgaaaaaaaataaataaagccacaaaagtgaaaagaatggaagactgggtcaacagcagatgggagatctgtacatgtttctggaaggcagaaagcagatgagacaagatatggaccaataagccaggcagagaaagcaccaagacttcaccacaagagttcctgaggcttgcaaggtcatttactccactaaatggagcccttccagggctgggagaaggagatgtgacattggctggaaatctgatgggaatcacctgtatcacttggtggcctcgacacccccaggccactcactatacccacacacttcaggcaaaaaaaaaaaaaaaaaaaaaaaaaacccagaccactcttctctaatggaagaaaacaaatcttgtgaagaaagctaaggtttctttaggaatgttggtgcctcaaattaaagatctccttgttctagtatttgggggacctgggaccagaaagtgagctccctaactcatctccctaaagcacccccaactcagagctctcctatgcctccatatgagtctccactcagcagggagccagttaggcagagtggtaaaattttgaaaccagatcacttgggtccaaatacaaaacccactacagataacactgtgaaacccgggacaagttatttaatctctctgtgcctcagtttctccaactgtaagatgggaatagtaatgtaatagtaatgtattagtaaaaccctaagatttttttccaaagattttatttatttatttatttatttatttatttatttatttgagagagagagagagagagagagagagagcataagcagaggcagaagcagagggagaagcaaactttccactgagcagggagcccaatgtggagcttgatcctaggaccctgggatcatgacctgagcagaaggcaggtgcttaacagactgagccccccaggtgccccaaccctaagattttttaatgcctctaaaatcaaaatatattttataacctatggcatgtcatatttcaacaacatttatcttcttagtagtaaacaacaatgatggtatatttatcttcttagtagtaaacaaaatgatggtatattttacaattgatggaatgtaatgaaacttaaaatatcatagtaactacctcatagagtggtatttgagatgattaaatgaattaatatatttagcttgcacaaggcagtgcctggaacatgggtagacactacataaatgttagctactgctaccatctaagaaaacagtcctactcacacaaagcagagaaaaaaaaacacaccagctacccagtccatatttctttaaaataacacaggatcactaggcaattgagaaggaccaaagaatgcaagaaataccagaaaaacaaactaagctaatcctaaagaaaatatataattcagggaatggaagagaatgtttgcaatttctaatgtatatattttgagagatttaagaaaatattacattcaagaacaaaaagagaatgctatgaaaaaagaataatcctagagcaaaatctttctgatttaaaaaatatgattgccaaaattaaaagcataacagtttgtctgaaaaaataaagtcaaggaaatcactcagaaaaaaaatcagaaggtgaaaaatatgaaagaaaagatgacctagagggccaatatggaaagatgagtatttgatttatgggaatgccagaaagagagaaatgggagggggggcagatttcaaagcaaagaacgtaagagagctccccaaagctgaaagacaccaaacttcagattagaaagtaacccccacacatacacacgcacatacacacaaaagccccacaaagttctcaggacaacaaatggggaagtaaaaacctcacttctagaacatattaaaatttcaaaataaaataaaataaaataaataaataaataaaataaaatttcaaaacactaagcataggagatgctaaaaatctccagagaaacattgatttgtttggcaacagacttcccatgaatgcatgagtgaatgaatgaatgaatataaaggaactatttttgccctgaagaatcttataaaagattattttcaacctagaattccatgtctagcagaactctcaattatatgtgagaggtgaataaagatatttgcagatatatgaaggtttgggaagattttcttccatccaaaattcctgaggaggtctccaaaagaagtcttccagtaacacagactatgactaaaccaagaaagaaaaaaatttggcagaaggtgaatccaacccacatgatctgggaaagtccccggatgacagaggtgcaatacgcctagaaagagactagatgggagttagagaacagctctagaagggaagtctcccgggcaaggaagacttatagaagagccagtacagctgaaaattgggggaaattcaaagaaatggaaactataaatcatgtggcagaagagaaggtggggcatctggggggctcaattggttaggtatctgcctttggctcaggtcatgatcccaggatcctgggatccagtccccaaacaggctccctgtttagcacagagtctgcttctccctctcttccctgcccctgctcattctctccctctctccctccttctctctctctttctataaataaataaataaataaataaataaataaataaataaataaataaataaattccttaaaagaagaaaaaaaggaaaggcaataagaaagtccagaaaacaataaaaggtcatacaggaagtttatggtctgaatgtgaagcaaattataatgtggcttaagttgaagatgaaggaattgctttatagttccttctaacagggcattcgtctgtgttaaacttcatggtacttacctgtatgacacggcaattttgtccctgtttcaatcaccgggaagtgattatacttagagaaaaaaatccttcccgtacatatggattttattgctggtggccaccacccctaaacttcagggtcttgaacaaccgtttacctttggatgctgacacaacaagtggacagaactgagtgtgaagcgtctgaagtcttggcctctccacatgtgggaccatctgcttccagattggaaaaatacatacgtctcctttgcagaaacaaactaccttagtgaaaagtaaggcctcatctcaaactcagtgaaacctttccttttaattgaggaaagtggcatcttttaagagcactttaagccattaagtagtgctgtaagttcaactactttgaacatttaaatctgccaagtgcaaaatcagtggtcactgcctcatctcaaaggtcatcttttcaggggtgcctggctggctcagttggttgagtgtctgcctgtggcttgggtcatgatcctaaagtctcgggactgggccccacattgggctccctgcttggtgggcatctgcctctttctctgcccctcaccctgctctcatgctgtatttcactctctctaaataaataaaacttttttaaaaaggacatcttttcaaaaccaattaaacatatatagttgaatgttcaatagctaacaatacccaagctgaataacaatttcaaaacagtttgcttaaatttagcgagaccactataatcaatctcaggaaagctcaaatctctcaccaaggacaaactgctcttttcaaaaaggactgctggtatcacccaggactgaagtagagcaaaagagaattgttcatacagtaaggatgaaaagaagtttgcatgacagcgaagtgtgaatttgagccactagactggatttagcgccaagaggtatagactactcttccaaagggtgccctgatgaaggaaggagagagaataggcagtagcaaaaagaagagatatgtcgaaggaatttcctaggttgagagtcctgagcaggttttgtaggttgaggagaggaattagagcagaaataatggcaatgaaagatagagtagagcaaattgtcgagggaacatcccagaggtttaggagcaatgagaataaaagtacatggaaagtttattaattaaacttcgattaattttgaatcgaaggtggggggtggggaggagtagggggtgtgcccttcctctgagatagaatagaaggaggtaagttgtgatgttggtgtaaagaagtctggagcaagggagaaggagattcgggtgtgtaccccaatgacatcaattttgtacatgaagcagaaaactacgccatcagctgagaaagaaggggatcctaaagtggctgaaattagttactaacagaaatggaaaaaagaaaactgatcagagttgtataacaggagctgaagacaagcatcacctcccccacccccaaaaaaagagaaagaaaaaaatgtgtatatatccttcatgagcattctctttccagccagtaggtgtcctaaccttgaatctaaacaaaagaaatttctatcccatcctccataggggaagcttcaaggtttggcccagttactttctaatttcctgttcttaagcaagatacttagattctctgggcctcagtttcctcatttgttaaaaaggactttaaaattattatgaatattaggggcacctgggtggctcagttggttaagcagctgccttcggctcagggcatgatctcacagtcctgggattgagccctgagaggctccctgctcagtggggagcgtgattctccctctccctctgcccctcctccacacttgtgctcattctctctctttcaaacaaataaataaataaaatatttcaaaaaagattattatgatattaaaaactgatgttcataggtgccaggtatacaataaggcttatatatcttattgactaccactagacttggtatttggcagtatttacataggtacaaaaatgtaaaccaaggttattggtttctaacttttggactcagctgatggacaaagcatggaagagttgcttgtggctggaggccagaatgtaaatgctaacaactctggctatataaaaataaaaaagtgtaagggacaaagagcagggtgagcagaggactggaaagttagtatctgcctcttataaaatggggagtcatgtgatcatgctgaaaatatatgaaataaggagtttaaattgcttaagtttacaaagacaacgaagagaagtgttacaataataatttaactattaaacatgagaagagagggtatgatctgtcatgttaaagaatcaataggaaaaaaagaatcaatggatggcatcaattcgataaaccaagagatagatgaacaaacacattatttagaacagtacttctcaactctggctatacatgattattgacttggagacaaaaaaaaaaaaaaaaaaacaatttgggggacgcctgggtggctcagcggttgagcagacatctgcctttgctcagggcgtgatcctggagccccgggatcaagtcccacatcaggatccctgcatggagcctgcttgtccctctgcctgtgtctctgcctctctctctgtgtgtctctcatgaataagcaaataaaaacttaaaaaaaaaattggggggatgcctgggtggctcaggcagttaagtagtcggccttcagttcagatcataatcccagggtcctgggactaagccctgagccctgtatcgggctccctgctcagcagggaatctgcttctccctctccctttaaccctcccctctcctcctgtgcacctgcacattcatgcatgctcttgcacacgcatgctctctctcaaatgaataaataaaaaaacttaaaaaaaaaaaacacttggttgttcttggaataaacctacacataggttgtttttgttttgtttttttaaaaaagcttcccaggtgatcctaacatacagagttgagactcattaatctacacaactgaaaaacagccagttaaagagtttctcttctggaaatgggacagtgggatagggtagaggtgaaaggagaggctggatactaatttagccttcattcattcattcattcattcaacaaatacagtagaaggccttcaggccctttttaccaaacaacctctctaatccatgatttgttctcatgggcatgagtgcctggagaaaaaaaaaaatgtaatgcaatgaaatacatcatcattacctgattccatacatttattatttttttatcttatttatttattcataagagacagagagagtgtgaggcagagatacaggcagggggcgcccaatgtgggacttgatcccgggactccaggatcacaccctgggctgaaggcagacgcttaaccactgagccacccaaatgtccctgattccatacatttaaatacattgggcagccagtgagaaccacttctgcctgagtacaaagtgtatcacctatgcagggtaatacagttggaaaaaaaacaatctttcacaagagatcagccaggctgtgagcagcctgggaaaagatgaaggggaagagtgtctaagggcactggagagcacccactccacttcacaggccccctttccttctgccagatgccactgagccagggctgcctgactgggttcaaaagtaaagaactctgaaaggtgccggagtagttcctttggttgagcctctgactcttgatttcgacgaaggtcatgttctcagggtcccatgatgggttccatgctcaataaggagtctgcttctctccttctccctctccccattcgctctatctctaagataaataaaataaaatatttttttaaaaaaagctgtgagggcaatggccctcagagttcctgaaccctacaacagagtaaagagggagagggcgaagagagggggcagggagggctagggtctcagtacaataatttgcctcagccaagagtaagcccctacgtaggtggcttacatagtagctgaaatatatggccctttgataaaaattgcaaccatactgtcatttcagtttctattgctgttttcaagagtatcatgaaacctacacatattaatgacattcacatctcaggccatcttgaaataacaccctaatgattagttgacacccaaacgaagggttgagggtattagtgaggactgagagcctccccaggagagaaggttcccagaaaggagaaatactatcctctctgggcacaatcaagtagagagatcctccaaagggaggtcacctacttcgaagtggtaagggccagccctgcctatgccaatcaaaagcataatgacttgcatctcttagtttaactcatcaattaactgtcatctgggaaatacaaaatctagtatctgcattaggaagatggaatacaagttggatatgtttcagtaatggacaataagagaaatgaggagctatatgaaaggcaacaaggcttgggtagctcaactgggtaggcaaaggggcagaaaaggaaggacatggaggtaggatgcaacagaggattgagtgtgccaaagccagagatgtgttttgcattctggaactcaacataataactattcatattttgtgcatgtctgatcaactgaacagtgaattccttgaggattctatttcataactctggaatcttgctcaatgccctacacatagaaggtatccaacagatattatcgattatgattctaaagatgcggttgcataaagggagtggagagaatgggacagaacatagggttagacgaaaaaacattggctattctataagtttatctaagaacagccctaccttttagtttctcttgaagacaaatatttcatttaaacttgtacaacatcaacaataattcacattcacatattattgcctcttggcatacaactttatcaaaagcctgaagatactcccacagttgatgggaatgaaactggaacaacttctgtagggggcaatgtatctgtcaaattttacaaatgcaaatatgttcaagattatttgttgtagggatccctgggtggcgcagtggtttggcacctgcctttggcccggggcgcgatcctggagaccggggatcgaatcccacatcaggctcccggtgcatggagcctgcttctctctgcctatgtctctgcctctctctctctctctgtgactatcataaataaataaaatttaaaaaaaaaaaaaaggaaaccaagttggattccttaaaaaaaaaaaaaagattatttattgtagcattcgtgtcaatagtaaatgattggaaacaaccgaaatgtatatcaagagtaaactatttaaataaattatgttatattcacacaatggaatattatgccttgtaaataacactgtattaatgcagaaagatctccaaatcatattgttaagtgagaaaacaaagacaatgtgctttgtatgctaccttttctctaaaaagggagtataaaaatctatactcacaattattcatatttacataaagaacctctagaagaatgtcccaaaatcaagaacaatggttgcctataataagaagtgctgagagtggcaactgaacagacagggaacaagaatgtaagacttttcaccatatgccaaaattttcatattctttggttttccactcatgaaaatgtgtttttataagcaaacacttgtatagcacttaatgtctcagtcattgttgcatgctatttaaaattagtaactcatttattattgatatgttaatgtgaatactcaaattttaatttaaaaaatatctcagggatgcctgcgtggctcagcagttaagtgtctgccttcagctcagggcatgatcctggagtcccgggatcaagttctgcatcaggctccctgtgaggagcctgtttcttcctctgcctgtgtctctgcctatctctccctatctctctctctctctctttctctctgcgtctctcatgaatacatttttaaaaatctttaaaaaataaaaaaataaaaaatacctcatgaatgtcataattgtactgcggttatgcagaaaaatctttgttcttgggagataaatttagagatagaattatttagagatgaagttagtatatctactttatctaactctctttgtagcaaagaaaaacatctgtacatccattcacgagtatgtgtgaatgtagagagagataaaaagataaagtaaatgtgccacctcccccccaaaaatggtaaatccatgtaaaaggtatatgactaaccatagacttatttatgcaactcttttgtagattttaaattttccaaggtaaacactggaaaggaaaaaatatctcaggaaagtccttaaaagtgaaataaaacatttctatttagtttctataaactctttggactggttttcaaggcgcttagatcacatctcaattcatccatccagccttcttatcctgtttgaccaaatcttacctttgaatcacatctcaaaaattactttctcaagatgtattttttgaatcttccaaaagactgtgttctcttaccactttgaattcctgtagtgcttttagttctgttgagatatagcatattctaaatggttataatcattgcatgtttttattatataaaacaagagatgataatgtatattagacgcatatattgatttttaagattttatttattcatgagagatacagagagagaggcagagacacaggcagagagagaagcagggtccctgaggggaacctgttgtgggtgggattctatcagggaactctagtatcaggccctaaactgaaggcagatgctgaaccactgagccacctaggcatccctagatgtgtatagtgtatacttacctactgtacatacattgtctataacaataattataggttatgagtcactccctaagaacttaacaattgaatgataaaagtgtctttgataacttggaagcaagattaatttatatgtggtggaaaggagtgagaggggcagtcactggaaggggagaggctatcagctctcccttggccaagctgctccctccgcctgcaactcccactgtccttaactccttcaggttctcaggcctgggttacatcttgagcgaagccttctctaatctctctgctaggtcaaagacccattatagcacctggacctcttcttagcactaatcccatcatattgaacattactatgtttaattgactactatctgcctcctttaccacacagtacgctccggggtggaaggcactgttaatgtttttgttcatcactgtcatcccagtatgtagcatggcatctggaattcagtaggccctagcaatttttttttttgaatgaataaaataagaaaatgcgtccacctagaggaagagggagttgatgagacttaggagaagcaaaaatgagcacccaagcactctcaaagggagaaagaggctgaataactggactagacttatacaatccacttatctcatttatacctagacacacacttacgtcatgctgccctcccctaccagtaattattgcactttttataagtggaaaagccctattttgtttttactaattgtttccccaagagtttctcatttcccttaaatgacttatcaggacctcccaaggggaggggatgcccagaggggatgccctggacttcccaagatcctccgcatcccctcaacttttccaagaaaaagtggttaagttcccctcacaaaaattgcttccttggggacccctgggtggctcagcggcttggcgctggccttcggcccagggtgtgatcctggggactcgggatcgagccccatgttgggctccctgcagggagcctgcctctctctgtgtctctcataaataaaatcttttttaaataattgttttctttctccgaggagttcaacgttcaaacgtgtctattccccaaaagtaacaagagaaacagatgtgggcttcacactgcataacgactggtgatttccacttccagtctgtgtccaaaagccaaaagagggggaaaggagacctttccagaatcagcttcctcataggggttttacgttgagcagtacttaaggcgttttttggttcttttgttctcgttcttgttaaggttcccagcgagacagcttccgcaggccctcggagcgacctcccgcgaccccaccagcccctgcaaatggcggtggcccagccgcgctctcccgcggcgctgcgagccaggtcacgtggacccgctgtggccaatgaggggcgcgcaccgcgctcccggcggcccgcgcgctctccgggcccctggcggcgagcgggagacgtgggctgcgtgtccgcaggactccggccggcgcctcccctcaccctgcggctcggcgctcctgacgccgtccggacacctccgcggccctctcacagcgccgccctcagtctgcgcgcacctacatgccccccaaaggcaaagggagaagcgcgcggcagcctcctgggccgggaagcgggtgggaaagaagcgggaggctcgtgccggatcccagtccctggacgctcgccgctggcccgcccggggggcccagcgggtcagcgccgccctcggcccggggcgcgatcctggagacgcggatcgagtcccgcgtcgggctccctgcgaggagcctgcttctccctctgcctgtgtctctgcctctctctctctctctctctctcatgaattagtaaataaaatcttaaaaaaaaaaaaaaaaaaaaagaccagtcccgagtaaggctttacatacagagcgaaaacaaacacgtcgactggttgttggcggtcaccccgtacatcaagcggaggggctttggttttcaccctgcttctgcgtttgaggcgagactaattaggaaagcatttggaccagcctcccatggggcacctcggaaggggcccgaggaggaatctgtgaggatccaatggtttcgctgagtgtgaaaacgtaccaggaaaagtttacaacattagttccagaacagtgattgcgattgcgcagccttatgaatatgctgaaaaccactggattctgccctttaagaggttaaactttatggtgtacggggttacatctcaaacatgttctagaaggtattcacaggtgacagtctcaggctttaggcaatcattgttgacacctgcacataccaaaattcagtatttcagtcaattcgggtctttctagaagatagctaccctatttgatatggtggcaagagactatcaggatgcctgaaattgccactttctcagtggcttatacttctttttaaaatggagaatagtctgaaattagctttgattattcctctcaggtgtttagcatattcttaatctaaaagtctaagaaaaaaaaacataaatttaacacctgatcctaatatccttcacaacataaggctttaattttccaacattcagggacatttagtaagcgtgcaaatttttgtaaaacaataattcaagcttatctttccttcatgttctttcctatattggcaaaatcaaagaggaacctaaagtgtattttccctacttaacatggacattgtcaggtcaagttaaagacgaatttgtattaaaagacaaatatgatctattttagttaatttggggtcatctgaatgagttgtcacaacaattcagagctaatagacactaagagatttagtatcatgaggcaaagtcagctttagatttttaccaccgaagaacattgatgaatagatttaccactatcttcttacagttaatgtttaaataatctatttaaggcccaattttatgtcctcaataccaagcaaaatatgtgctagatagaatatttatcttagcttaacacaaataatatcttacctgggttccttgacatggctgaaactggctgggagctgacaagtcgggtcatgtactccttctgaaaactgtatttcacccacagggatttgcaacaatttgttactttgggagagggattcagaagttctttaggttcacaaacaatggtatcatgttttttcttcatgttttttccctgttgaaaaatatatcttcagagaatttcccccatcagtatatattcagtatgtttgatgaatattggtgttctcacaatacaagcagcctttattctacatatctaagggttatggtttagagtggaaaatggaacagggtaattaaggtcttttttcaacttagataaacatctttaagacctatgctgttggtctttagatctgcaacaccaccccacatcctcatctccaagcagtttttcttcaatagccacgttctaccaacagagcagtctaaataagtatgcatagaaaaaggcagacgtattaacatcaccaaaaagaaaatagattaaaatcatagagatggggagggttggagatgaaatacatttttgtcctacttccttgtgtatgtatgattttgtattatctctttatgtctccacatacacaaagtccatctctacaaacactaatgaagactattctcctgtcccacctttttctaatactgtagcaccaacccaatacattgaagaattgaactgagacttttcattgtttaccagtgcctttaattctcttgacttaaaggttggccacagagtttcactttctagtttaccttctaaatctaagcagttactgaaagggaaggaatggttaagagcagtcagacaataaagaacaacaaaaaaaagtaacaggagaaaacttcaggagtcttagatcagtgctacccaatacaaatttgtgactcagatatgtaattttaaggtttctagcagctacactaagcaagtaaaaagaatcatgtaaaagtaattttaatgatatattttatttacccaaatatatcccaaaataaatccagatattatcattctaataagtaatcagtataaaaaattattaatgaaatatcttacattcttgttaatgtacgtcttcaaaatccagtatgtcttttacacttacaatacatctcaatttggactcagccacatttccggtactcagtagctacacgtggctagtggctgcattgcagctttagacaaagaaacaagaactaaaaagaaatgactgagagaaaagtaataagcagttatcttgcaaaccaagagggggtgggaatcagcaagtagaattctgactcattatttttcaaatatactacattttccaatgcagaatgctacatgaatattttgatttttataatttgagccagattagggaaaggggagctgtgggttgaagggttgtgagtgcctgggcatttttgatttttggtaccttgggcagcttgatagttgttttgttttcttttttaaatccctgtgacttctttattttatcactgaaaatttgtgcttcttaatccccttcacctattttaacagcttgacattttaactatatgcatcaggcaaccttctgatcctaatttgatttctcaagtaaactttacattgcaaaaaaggacatgctctctaggtaatgcatcacagccaaattagccctgaatagaattattaaatattaaatattagtttactaatattaagtattagtaaatagtcaaagttgacagtcaagatacagttacagagtgaggttcttctctttttttaagattttatttatttatttgagagagagagagagcatgagaggggagaggcaaccggagaaggagaagcaggctccccactgagaagagagccttatgccaggctcagcttgatcccagaacccaccaggatcacaacctgagccaaaggcagatgctcaactgcttaaccgactgagccactcaggcacccccagaatgaggttcctatctgaaagagccaactgatagcctcccataagcccattgtcatcttatactatgtactcatatgacattgctagataacagaataaaatatctaaccatggtcttttatttttttaattttttttattggagttcaatttgccaacatatagcataacacccagtgctcatcccgccaagtgcccccctcagtgcccatcacccagtcaccccaaccccccgcccacctccccttccactaccccttgttcatttcccagagttaggtgtctctcatgttttgtcaccctcactgatattttcactcattttctctcctttccctttattccctttcactaatttttatattccccaaatgaatgagaccatataatgtttaaaataaacaattgagaatgttagaattggtttttcccaaataggttgttttataatttttcccaaactttttgggaaactttttgggaattttgcaggatattaagaggtatttattgaaaaaaatcattgctaattatatttttcatctaaaatttatttttagacatatgtaagaaaagcactatgctgttatatatagttgtttgtataattatataattgcctttaggaaacggtgtgtgtacctgaaaacagcaggaaatcccaggtttcatgaaagcattatagtggatatgcacatggaagcaaggcaactactgagctgatgatgtatgttgtctatttaataatctttggtttatgcttgtcttctttcaatatatatttatgatatttttcacttaataaattatgtcatcgggatccctgggtggcgcagcggtttagcgcctgcctttggcccggggcacgatcctggagacccgggatcgaatcccacgtcaggctcccgggatggagcctgcttctccctctgcctgtgtctctgcttctctctctctctctgtctatcataaataaatcttttaaaaataaataaataaataaataaattatgtcacctactctggaagttgttctgatataaagtttatatatgaacaaagttcttatcatttcttgcaataactaattcatgtatgcatttacattttactgtcttgtgtgctagacttaataatggtccccccaaagatgttcacatcctaattggatgtgtggatattttaccttatgtggcaaaatgagaaatagaaaacttatacactatgctcatctgaatggatattactatcagtacattatcatcttaaaagcgttcgtgtaaaataagtttggagatggacaagagtccatttgatagtgtttctataataataactagacaatcactgtaactaagattgttaaactctaaataacttattggtggtagcaactgtaaatccagctacttttttaaaagtaatctctacacccaacatggggcttgattgaactcacaattccaagatcaagagtcacatgttctatggactgagccagcctggtgcccctagctaaaaatctttataatgagtaatatatgttgatcaacaatgaaatatatatatttagccctactaaatgctagggctacccactggggatatagcagtcatcaagacagaaatactcccttccctcatggaggtaacaatctagcaggggaggcagatatatacacttaattagaatcatggtaggtgatatgaaaatatagggagtggactaacctagtctgggtcgtcagacaggactcatctaggaatgatgtttaagctatgatctaaaagatgacttggaattggccaagagggaagaggagagagggaaaaagaaagtctcagagagctagagtaccacatgcaaaagcccaaaggcagtaaagacttcatgggacttgaagaactaaaaataaaaacagtggagcctttcaattcaagatagctgagaacttccccataccacttttcttaaaaataacaaggaggaaaaagagaaaacagatttcatctttattgaactggtagtcaccccaaaccacaatacacgaaaatgaaaaatggatcgaggatggtgaagcacttagcagactcaaggaaggtcaagctgaagtggttagaggagaaaccaaggagaagcaaggcaggtcaccctgaggaaccctagaaaagactcacaaactgtaagtaggtaaagtgcaggaaggaagctagagtgaaaaatgggagaagtgtaatgcagaaaagggagatttgtttaaaaatctgtttaataagcagacagatcctcacatccccattctacctgataatatcaggctactgcttttactttcacaggagacaggaaatgtcacctctggagaaagtaaaccagatgagttctagatgtggcagcatgaggcatagatcagagagtgagatatctcactgaaaaaagaagaaataaggggtacctgggtggtgcctgcttctccctctgcctatgtctctgcctgtgtctctgccttttctctgtctctcatgaataaataaataaaatcttaaaaaaaaaaaagaggaattaagtctgaaactgaaaataagacacccagtccgcttctcctgcttgtagaactttgcagccaagttctactctctagcaaaaaataaaaggtaaaaactttattctcaggaaaaactgagccatgtcagaaaaaaagccaaagacactgacatctggggctccccaaaggaaaactcttcaattgccacgactcaaacacacatttggggcctctgatcagcttttaggacttcactcctaaaatatgaacagataaaaatcaccatataccagagggaacccttcaacatgaaaaagtaaaaaacctccaacatgtaagaatcagggagagaaaaggaatcacaagaaacagagacaatgcagggagcatatacatacttcaaagaaattaagagtatcatcagaaaaatattgtatctgtaaaacaagaacaggatactaaaagaagaaatagtctaagagcaaggaagaccagttgaaaattacaaatactaaaactatttaaaattcagtaaaaaattatatattgaaagataaatcctctgaagtagaatgaacttggaaactgacacaggtcagaaaaagtcatgaggacattctaaaaaataacttgctgatctttttttttttttaattagtcttaaaaaaataataaataaataagtcttagagggagataaaatggtaggcagatggggagcattgctctagatttaaaaactctaaagaaataaaacaataaaatgcaatgtgtgaactttggatcctggcttttttttttttttttttttttttaagatttatttattcatgagagacacagagagaggcagagacacaggcagagggggaaccaggctccctgtgggggagcctgatgtgggactagatcccaggaccctgggatcatgacctgagccaaaggcagacactcaaccgctaagacacccaggcgtccctggatcctggctttaaaaaacaaacaaacaaaaaaagagggactcctggatggctcagcgctttagcacctgcttttagcccggggcatgatcctggagtcccaggatggagtcctaggatcgagtcccaagacctagtcccaggatcgagtcctacattgagctccctgcagggagcctgcttctccctctgcctgtgtctctgcctctctctttctctctctttctttgtgtttctcatgaataaataaaaatcttaaaaaaaaaaaaaaaaagaaaagaaaagaaaaactgctataaaaaatattactgaagaattattgttacttttcctcagcaggatagtgctattacaggcatacagggatagtccttatttttaggagttatattttaaaatgtttggcaatgtaatgtcctgttgtctgccacttacttccaaataggtcgccaaaatagtcaaatagataaagcaaatatagggaaatgttgacaattgtttagtctaaataatggatatcctagtgttgatcatgctattctctcaactttgaatttttcataataaattgttataaaaaataaagggcagcctgggtggctcagcggtttagcgccgccttcagcccaggaagtgatcctggagtcccaggatcaaatcccttgtcgggctccctgcttcccagcatggagcctacttctccctctgcctgtgtctctgcctctctctgtgcgtcttccatgaataaataaataaaatctttaaaaatgaataaattcaatttagctaacatagtgtattattagtgtgtcaggggtaggatttagtgattcatcactaaacaacacccagtagtcatcccatcaagtgccctccttttttttttttttttaagattttatttatttatccatgagagacacggagagatgcagagacagaggcagagacacaggcagagggagaagcaggctctgtgccgggagcccgacgtggaactcgatcccacgtctccaagataacgccctgggctgaaaggcagcgctaaaccattgagtcacctgggatacccccacatcttctttatgcattcatctgttgatagacatctggtctctttccatactttggctattgtggacattgtttctataaacattggggtgcatgtgccccttcaaattactatgtttgtatcttttggataaagtgcaattgctgggtggtagggtagttctattttgaacttttgggggaacctccattctgttttctagagcagctgtaccagcttgcattcccaccaacagtgtaggaaggttcccttttctctgcatcctcatcaacatctgttgtttcctgacttgttaattttagccattctgactggtgtgaggtggtatctcactgtggttttgatttgtaatttccctgatgctgagtgatgttgagcattttttcatgtgtctgttggacacgtgtaggtcttctatggagaaatgtctatttatgtcttctgcccatttcttgactgggtttttgtttgtttgttttttgggtgttgagcctgataagttctttataaattttgaatactaggcctttatctgataagacatttacgaatatcctctcccattctgtaggctgccttctagttttttttattgtttcctttgctatgcaaaagctttttatcctgatgaagtcccaatagttcattttttgtatgttttgaattgtggcctcttttgagaagaattcaaaatagaatgaagcagtaaataaattggctgaatccaatcaagcgaggtagctaatcagactgaaatcagtcctaatcagattgaaaattagttaacgatataattgaaatcctccttacttttagtggaacagtttgggtatataaaggacaagtgaaatcaaatctatttttgagatatccaagagaatttggagtataaaagaactaacaatcactcatatttataaatataaaagcacaagtacttaaaaaagcttgtcaatcaattaaggtatgtgaagaaataaaatatttaaatgtatacaatttgaaaagagttatatttaagtggcaaaactgctaaaatttgctagattcttttttgattttgtttttagatttttaactaaagtaataaaatgtattaactgaaatgttataattctctttttattcttcttttaacagcttagacaacttgccaagagaaatttggatctcagaagacagatcagggctagaaatttaaatttaaaattaaagttaagtgagtcattatcttagagaaaataaaaaatgctgtgtaagtgaaaagaacactcttacgttcaataactaaagaaatatttattaaacttctagtatgtgccaggcactgtgttaagtgctaggttgcaattgtgagcaaaatgtctatggtatgggatatataagtggactgcactgtgagcagtaccagtccttacagggtgttgttgaaagtgttgttgtgtatttgtagagtgatattaataaagggttatattcagatttaaccgatcaaattatgtaccacagacatactccaatcctgccaagatcctgcccacaaaaaaattgtcttataacctgtgtactgtatttgttctgttcctctggatattcatataggttaaaaaatgcatgtataggggcaaccctggtggcacagtggtttagcaccgcctgcagcccagggcgtgatcctggagaccctggatcaagtcccacttcaggctctctgcatggagcctgcttctccctctgcctgtgtctctgcctctcattctctctctgtgtttctatgaataaataaataaaatctttttaaaaaatgcgtataattatctgtgtttagaacttaagtctgtttcacatataaacccaaagattttttgcatgggttttatacacactagattttcttttttttttttttttcttttcttttttatattcatgagagacacacagagagaggcagagacacaggcagagggagaagcagactccatgcaggaagcctgatgtagaactccatccggagaccctgggatcacgtcttgagccaaaggcagatggtcaactgctgagccacccaggcatccccacactggattttctaagaattcattacagcataaattcagagaaatcaagagaaacatacttttatgtctttctgaactttaccaaaatttgtttactatatcagaaaatcagattatgggggcacctgggtagctcagtggttgagcatctgtctggctcagggtgtgatcctggggtcctgggatctagggagcctgattctccctcagctgtgtctctgcctctttctgtgtgcctctcatgagtaaataaataaaatcttaaaaaaagaaagaaagaaaaagaaaaaatcaggttatggactacaataccattcatgctaattgagttcctaatttaacatacatatcagattgtatttgtggctgtcacattcccagtgattctatgtataggttcaaccaaataagtgcttaagtcttctcttatattatgcctgggtagtgcctgtgtagtatactgatatatatattattttatagtaactgctattgtaaattactttccttttattcttctctatgagaagggcgttatatagatttttttaaattggcaacgcctgggtgtctcagtgtttgagcatctgcctttggctcttggcgtgatcccaggatcggtgatcgagtcttgcatcaggctccttgagggagcctgcttctccctctgccaatgtctctgcctctctctctgtgtctctcatgaataaataaataaaatctttaaaaatatacaaatttataaaattggatttgtatatatttcttattaaccatacattctaggatagaagaggaggtgtgaaacatagttgctttacaaagggactttcaaagtgttctaaggcccttgcattgtcccaggagaggtaaaagtacaaatgcgaatttatgttatacttaggaagttatactttttatatgatacgaaattagatccacatgattattggccccattttacttcactggcttcatgagactgggacacttacaactgtgctagctccaacctgggcctgaaggggcctaatgtgtctctgcctgccaatttgtacttcctgtcatctccagaagagttttccctgggtagctgctgcccttcaaaccagaaggaatgcaaaacagaagccagcaaaaagtcaataggatagaattagggattcgtttcccaccccacccccccactttctcctagagaaagagattccttaatccactattttccaaaatttctaaatgagcataaattacttttcattctcagaagatgaaaaggtcactaatgaaagaaaaccattaactcttcttgcagtggagtaatgcatatttatttcttctaggacgtgaatttctcaaagtgcacacagtaggcaataaacaattgttgatgaaacaaggaaccctcttaactcatgtctcctgggtaatctttgttctcagtcttctcccttctaataccagcttcctccttttctccacttctggtttctctctccctgactcccccttctccttccctaactcttcttcttcttcttcttcttcttttttttttaattaataatttattctctagggacgcctgggtggctcagtggttgagcatttgccttcagctcgggtgtgatcctggggtcctaggatcgagtcccacatccagctccttgcaggaagcctgcttctccctctgcctgtgtctctgtctctcaatgtatctcttatgaataaataaataaaatctttaaaaataataataataatttattctctatattgtcccagcattttataatctttttttttttttttccttaggaagagagagagtgtgagcacaggcagaaaggcaggaggagtagggcagggtgcaggaagggagaagagagagagaggaagagaatcttaagcaggctccatgcccggcccagagcctgacatcaggctccatctcataaccctgagatcatgatctgatccaaaatcaagagttggatgctaaaaaaaaaaaaagagagagagagagagagttggatgcttcagtggctgagctactcaagcattctcttccccactgttctttgtcattcttttttccttctctccagctctaattttttctgcccatgtttctctccttttttctctttaatctagtattgcctccacctctctttcttctctcctccttctatggaaattctaactcttagctagccataataaattcttatagtatttattgaaagtttattatttacagaaatttacctgcttttagtgtttgaataattttaaaatgtaaaaatgtatctacagcaatgcttaatttctaaggattattttaataacatattaatagctaaattaaggggcatctggggggctcagtcagtgaagtatctgcctttagctcagatcatgaccccaagatcctgagatggagccccacattgagctccttgcttagtggggagcctgcctctccctcttcctctacctgtcactctatctacttgtgcgctctctctgtcaaacaaataaaatctttcttaaaaatagctaaattaaattgctttttcattatgtgtgattctttcttaacttttcaggggtcagtaattctctgtgaaagtttcactgcctcattttatacctctccaaagaaaaggactgtcctccagtgaccttcaggtcctggaaattctgcttatttggacaatatttacgcacataaccaaggtcacctttaagaaacttttggagtccaggccaaattccacctcctgagacatctccctatatatatttctacccaggtagaatcaggttacaatgagcagtacaggcaaactcagaaaagaaaataaattaaaaccatgggctgatcactcatcctctttggaccttagattccttcttgagaactaaaaaacctgacactgatgatttctaaggccctttccacatttggcatttcatgactgaatctcaaacagtgggatttctaaaagggaaacatgaaacccaagaggtagattttctcagtaatcctagaatttcaaagctaaagtggttccatggcgttcacctaatgtgacctgcaataacttcatgtctttgaaccttttattctctacctgtaatatgggactacaaacccagtcttgccaggctgctaggagaattagagctactatctgcctactgctaaaaaacatgacaacaggcccaaaatgaattgctcatgctcagccccacagcactaaatggagacttaattataagtttggctctctcagaaatggaattttaaatcagtcaatcaggaatcactgatcagcactcttgaggtaatctgcctactagaccctctgaaatacccttaaggaaagtaactttgcaataactaacctgctttttgtgcctaataataatgtccttgttcctgctcccttctgcctataagcctttcattttcacaactcctcagagcttctctctgtttactagattggatgatgccaaataaactcttatttttttaatttatgtgtatttattgaagaataattgacatacaatatcatattagtttctagtgcacaacacagtgatccaatatttataggcattatgaaatggttaccacagtaaactccagttaccatctgtcaccatagaaagttgttataatattattgactatactccctaccctctatgttacatctccacattctatttattttataacaggaagattgtacttcttaatccccttcacctgtttcatgcatcccctcctcccctctgccaaccatcagtttgttctctgtatctctgagttggcttctgttttgttttgtttgctcacctattttgttttttagattccacatatgagtgaaatgatacagtatttgtctctttctgtccgacttatttcacttagcattatactctctaggtccatccacattgttgcaaatgtcaagatttcatactttttttatgactgtaaactcttttttttaattctttgaactttgtatgtattctaacttgaaagatagatcagttaaacatttatttatttatttatttatttatttatttatttatttattcatgagagacagagagagagagagagagagagagaggcagagacacaagcagaggaagaagcaggctccatgcaaggagcccgacgtgggactcgatcccgggtccccaggatcacgccctgggcttaaggcagtgctaaaccgctgagccacccaggctgccctatggctgtaaattcttaaaatctttaatgtgactcagtttaccttttaacactactttatggaatgtggcgaataaatggcagttatcatttcatctaaaactcctaacttttttttttaaagatttatgtatttatttgagagagagaacaccagtgaaggggaaggtcagagggaaaagcagactccctgctgagcagggagcctgatgtggagctccctcccaggccccaggatcacgacctgagccgaaggcagatgctcaaccactgagccacccaggtgtccctcaaagtagaggattcttatgaaaactttcataagccaaaatggcataaagaagaagaaatcaacagtaatttatgtggaacatttttttagcattcccagacccaagcgaataacctctattaagcttttctgataccttaaggacacatcttgctaacaaaagcacaaaataaattgaggtaaagcaaagatgctcacagacacaaatcaaagccatggcaccttgatcctgagatgctgagtgtacttcagaggcggggagatggggggtacagggacttgtgtcaggtacacgctgcctctctaagggtttgctgcaaaataaatgctgaatgctatttttgctttttgccttttttcttgtaaaaaacgaaaattctctttggatttctttcagttggcaaaaacagttcctcatgcaggtcttttaaaaacaatgcagcataattcaaattttcagaaatcaagaagtttttttttattttaagattgtatatgtttattcatgagagacagaaacataggcagagggagaagcaggctcttcacagggagcccgatgtgggactgtttcccaaaaccctgggatcaggccctgagccaaagacagaggctcaaccgctgagccacccaggtgtcccaaaaatcaagggatatttgtatataatctccaccccaaggcctgaacatctactaattttcagcatcctagggcctaccagcatttacaataaagaaaaagagagaatagcccaaattgctatctaaacttaagtgttaaatgctttagaaactcagagcaagaaaacaaactttctgaaattgctctcttcaaccttgtttgtatgctgctatcatgtgattaaaaaggaatggtgggaaaaaaaaaaaaaaaaaaaaaaaaaaaaaaaggaatggtgggggtgcctggctggctcagtcagtacaacctgtgaccattttttttttaagattttatttatttattcatgagagacacagagagagagagagagaaagagagaggcagaaacacaggcagagggagaagcaggctccatgcagggaacctgacatgggactcgatcccaggtcttcaaaatcaggccctgagctgaaagcagcactaaactgctgagccacctgggctgccccaacctgtgacccttgatctcaggtttgtgagttcaagcctgactctgggcttacattaaaaaaaaaaaaaaaaaaaaaaaaatcatagcatggctgaggaaggactgagttaggaaatttcccataatttcttcagccaggggagtgtgtgtgtgtgtcggggggtggcatgtgcccactatagccctttaaaaataagaatctatgagggcaattacttactgcaccattaaaaaattgctccattaaaaaggacacattacataaagaaccaaatgtccttttaagatgttaaagggaggtgggtgggggtatagggtaactgtaactgggtgatgggcattaaggagggcacttgatgtgatgagcactgggtgttatatgcaactgatgaatcactaaattctactcctgaaactaataatatactatatgttaactaattgaatttaaataaacaatttaaattcaaaaaagaaaagatgttaaattctctttaaatgtaactcgattgttaccaatgattatgaatgaaaggagaaaatactgaaactattttgccattataacatggttttattttcattcaaactgcataatgttaaggaaagcagtatattttgatacataataattaatggttgacattgacgaggtcaactttatctcacaagaaagtcttttggtattccttttattttttatttatttattttttttaaatattaagaaagtttctttcttttttttttaaatattttatttatttattcatgagagacacacagagaggcagagacacaggcaaagggagaagcaggctccatgcagggagcccgaagtgggactcgatcctgggtctccagggtcaggccctggaccaaaggtggcattaaaccgctgagccacccaggccgccccttggtattccttttaaagataatattggttggaatggaatgtgtgaatatgacattaagagtaaatacttcaataaaaattgttttaagtacaaaaataacattaatactgatagtacctttttctctaatactaatagtacctaatttctctagtgctttgagattatatacttctgcatacatttgactatattttcttcctcataacaacttcaaggcaaaggtaggtcagttatcatgttacaaattaggaaacccaagcttttgcatgacttgctgagccagtaagtggtggaatggcctcaaactgaggtcatctggctctttttccaatgttgttttcttcactacatcgtactgcctgccctatgaatcggatatcacttcatgtttttgtacttccttttttatgtactttgtacattcacaaacactgatgtacttccaaggaggcatcataactccaagtaaacaagaacactttgggctcttggttaacagcagaagaaacctttctgaatttacctagtccctattatttactgtctgtttttcattataaagtttccccaaaagtggaggtatgggccagggcacatgctgtggtaagcagattttgctttatttcagttactgaaagtttcaggggaaagaggaggtatgatttgagcatgtaaaacaatctcttgattttctatggtggctcaatggataactggagtctattttgcaagcctgaagtttacttgttcaaaccctggtttgaagaatgtatactttggaacctgtttgttttctttttctgatgcagttcattgaaaacgtgtatgaagtaaaaaaataaaaaataaaaaaataaaaaaaaattcccagcattctcagtattgtgttcaagaatgagacttctgtgttcataaacagagacatcctgtgctgtcagagcctgtgcatgagatctggaaggtcagagtctgtttgtaaactgtaacaggagtaatgagagataaacatattatcagtttacacccagcctgctgaagccccagggtaacatatttctacattttccgaagcctccattctgactcccagcaggacttctatttacaggggtttatttgatcttgaatctcaagctgagcattttatgtccctttaagaagtcatagaattcggagatgaattgtcttcactgatgggtgggcaaaggaggtagctcctgcccttggcaaaatctcaagctgagccacccaggcatcctggattgggtttttttttttttttaatttttatttattatttatgatagtcacacacagagagagagagagagagagaggggcagagacacaggcagagggagaagcaggctccatgcactgggagcccgacgtgggattcgattctgggtctccaggatcgtgccctgggccaaaggcaggcgccaaaccgctgcgccacccagggatccctttttttttttttttttttttttttaaagcatctttcttttaaaaataatttaaccgggacacctgggtggctgagtgtctgacttcagctcaggtggtgatcccagggtccagggatcgaatcctgcattaggctccctgcggagagcctgcttttccctctgcctatgtctctgcctctctctgtctctcatgaataaataaataaaatctttaaaaaaaataatttaaacataatattgttccaggagaccaaatgaatacatttgcaaatagcttggtgtggagaaaatatatttcagctctaaggtaggactggcctgtccctcttttttttttattttaatatttttatcataaaacaaaacacagaaacagatgacactataaaggaaatgtttgccttaataaattattctaaggcaaacactcttgtaaccatcaccaggtcaggaaacagaactttgctacctactcttaggaacttcttccaagtatcccttctcaatcatttcctatcaccaccatctcagaagtgacattatcttaacttttaatagtatcaccttcacttccttttttctttaatggtttctccacccagatgtttaccccaggtggtatagtctctcccccaacacatacaggacacttaaaatttttttatatatcctttaaataattttttttccaactttatgtttatctctcgaagaatggaggccctttgacttgtagagtttcccacagtcaggactgtgggattgcatgatcatgtagtgttcaacatatttctgtttcctacaaactggcagccggatctcaagtctgtaacagatttaggtttgatctcttcagcagcaatttaagtggtggtgtggtcttccctcaggaggtacaaaatgtctagttctctctcttttttatgatcttaggagctgctgaggcacaatgactgtatctattaattcatagggagttacaaaattgggatattttatcattttccttttacttaatactggaatacttttatctagattcacttccccttatctatttggttacccaaataaccaaactttttaaagttcctttagagaagagatcttgcaatcatcatctacataattcttttggggtcctatacctttggattgtactacatgtttgttgaatttgcagatgagacattataaacaagactaaaaagctcactgaagttgtatgtaaagcagatgtatccaaataaagatccagtagcaaattccagccactagaaacttaaaattcatgctcctctggttgattatgttttcaagatccagtctttgtttcctgctggtcattaacctttgtgactttcatgaagagaaagttgttaacaaaagtgaactgatagagtaaaggaaaaaagattcttgtgaatctattttgggctaacatgcagagttccagcctccctctagaaagtcagaagttaaatagttatttacatcgatatttgatcacaattttggacttccaaatgaaagtgattattctttcaaaaagtctcattttacatgtctgcagtgacctagaaatcatacaacctaaatcacttagttttttaaaatgtaaatataattactttgggagttcaaaaatcctgggatttttgcattgtttttacatttactacatataatgtagaaaggataattattttcttatactaatgttaacagctatttaaaaatattttcattctaaaaaataataaaataaaaataataaaaatattttcattctaagttaaccttaaaattgtttggtgttgacagctgaaggcatttaaggtgcctcctgaaagcactccagagttcacctggaagcaattagggagatttgccatatgctcagtggatgctgagcaagaatttgggggtcagatgatccaggtttctcagcccaccagtaccactatgtatttaataaccttagatacttgtttgtcttgttctgctcatttgtaaatctaagtaataaaatctatctcccagaattgttaattaatattggaaaaggtgccttgtaatatttgctggtagtaagtatcctattcaaggagacttaacacagttaatcagatgaactgaactgccttttgaattagccattatggcagtggaaaattccaggtctgccaacttgatatttgaaagggtttcagcttcagatataaatgcatctgagagattccagtttggagatgcattaacttacaggcgaatgataaaaatctgcacacaccggtgcttcctgtgaatatacatttctcatacttcattcatctcctcagtgtctaccctgaaaaagtgctagatctgatacgctgttcactacatgaaagtatagacaaaaatagaacaatttagtcttaactattaattaaaaggcacagtcattagcctgactgtctgatctttgtgccagatttttgtgtattacaaatctgcagaaagaaaactttccagaaaggaagaatttgcttcaagaactatcctgcaggaatatcaaaaggttttcctcctttccttcttttttgcctcaggcataacattgtactttatagaaatggaaataaaggtattaatttggacaatcctctctttttaattaaagattttatttatttattaatgaaagatacagagagagagaggcagagacataggcagaggaagaagcaggctccctgcggggagcccaatgtgggactcaatcccaggaccccgggatcttgacctgagccaaaggcagccactcaaccgcggagccaccctggcttcccaacaatcctctttgactgtaaagtttggatcctaagattctcaaagacctctaaagtcaaattacaatgaaaaaacatagcttcagtttttttaaattaaagttgctaataatgcaattttgccatacaagtatccaacaaccatttgcaacctgttagaatgagaatcaaaacaatttaatcatgttccttccacttcaactctaatcctgatctttggcctcaaattaatttctagagactttttttaaagattttatttatttatttatttatttatttatttatttatttatttatttatttatgagagatacagagagagagagagaggcagagacacaggcagagggagaagcaggctccacacagggagcccaacgtgggactcaatcccaggaccccaggatcacgccctgggctaaaggcggcactaaaccgctgagccaccggggctgccccctagagacttttctaacaaaaaactggactcagaattttaagaaatcatgctattaacttacacggttttcaacaatttcattatttttttttccacaggcaggtgaaacaactttatttcacagttgtctttaaaaccacaaagacactatgttcttcatataaaaacattagtacagataactatactttctagaaaatgattatatagaccctctcaaagaaaaatgcacaccattatatggttcagacaagttacttgggaaaaacacatctggaccgatacctaaaacataccagaagaccacgctgcatcttttggttcaaagtatagattactgtcatcagtaagggctcctgcattcttacatatttgataatacacatatagactggtttgtgacttaatgctccattggttcatcagccttttctgcaggttcatcagcagggtgagcaggctgtgcctttctctgtggtctttcttcaagaccttccaggaacggagatacatcatcatcatcataaattgtaaactccaagtctttaccaacaattccaatggaaacattctttgtagttaggtcctgttctgcaggaagtgtctctcgtaaggcacgcagaccatgtttaaccagttcattcaaattgcattccataaacccagacatatgtctctccaagtaagtaggagctgattgaaaacgggctccaatggacatggctctacagtcaaaatagttggcagatggacaggtttggaaaatgtgagggcccatatcatcataaccagcaataaacagtccaacaccatatggtctgcggccataccgttgtgttggtatctgggtcttgcttccaattagagatacaagacgagacacaggaagtggtctgtcaaatacaaatctggaatccaaacactcctggcgcataaaattacataacagtctagcatcagcagtaagtcccgcaattgagataccaatatggttagcaacatgaagaattttcttctgttgagctgcaagctctgactgtgctctcttcaatgcaaccaacactgcatgggtttttgatttcagaccaagtgtggctgaatcttgtttgacagcttccattgcatattcagtttgatgaatcctgccctgagggctccaaacagtgacgtcattgtcatactggttgcgaaacatggttccggcgcgggtcccgctgcggcctccggcagaggtggcggcttcaggagcgagctcattattttttaaatattttatttttatttatgagagaatggtggggagggaagggcagagagagtagcccttagccggctctatcccaccaccctgaggtcccaacctgagccgacaccgtgtcccacgcttaacctacggcgccacccggcgccaccgtagaacttggtgccctagttctcaaaattgttattttaatttttattttaaaacaaaactgcataatcagtacaacttcataacttttaaaagtacaaaagccactagaaatcaggacaatgagggctgataccgtttccttcatattttcagcactcctgttataggacaaggaccgtgtgttcatgtttttcgagtgttgaaatagtttactcgtaacacgaccagttttccaataattcgcttccggtttattttagacttgtaattcaactttgtttgctatacatagcatgtgatttcatgagctcaaaatctgagaaaaatataggttgttgttttttttcctcctttggtcagaatgcattcccaggataggggcttctaagcaacacgtgtttaaggggctccgttattctacctacctacctactcccttccccaagctcccaatcttctttaagcttagctgtcccgggggctgcacgagattattttacaactcaggtaactgctaactttccgttttctttttttaaaagattttatttattcatgagagacacgcagagacacaggcagagggagaagcaggctccatgcagggagcccgggaccccaggatcacgccccgggccaaaggcggcgctaaaccgctgagccacccgggctgccctaactttccgttttctacctttaacaattgaaagcgggcatccacagcgcagaccccgctccgacccgccgagcaggtgccgctgcgtcctcccgggtcggtgggcggggcggcaaggagagcgggcacctatcagcggccgccccaggcggcgggcccggacggccttcccggcgtgccccgcgcgccgaggggactcttaacgtgaagcgccgggtgactcagccgcgtggccgcgccggcccgggtggggggcgtggggggcgtggggggcgcgccgctgcggcacggcggctcctcgcggcgacgtgtgcgcgcgcctccagggcgggttcgggcccgagcgcgagagcgcggcggggagcgtcaggtaagcggtggccgggagcccggaagggcgagggtggccgtgggcagcgcccggacttggcctttgtgtcagggcgggggcgtctcctccggccgccgctcgtgcggaccccgccggctcgggcccgggtggaaaggccgcgggagtaaagtcgtcgcgcggaggcatgtccgcggctgcgtgtggggcgcgggtgtgcgtgcggaggcgaagtctagtaacccgggacagggctgtcccctcacagggagacggtaaacgccgcggggctggggggcgaagtgtaactcgtcggtcttctgcaggcctggggtgttttcgtcccgcccgcgcggcggcgacggcgacggcgacggcgaccccgggcggctgttgatagcgcctttgcaggcgcgttttctgccggcagttactggaactccttagaaaccaggtagttgatcggacttcttgtccaactctggagcggagagcgctctcgctcgcctccccacctcggcttcacagtccttcgtgccccccaagatactgcctttcgttagtggctccgagggcaccagagctgggcagagcctgaacccgcgagctccttttttttttttttttttcaagtgaaaccctatttttttttatagtagacagcgacttcgggtttacaagcctagttctgcgctatcaaaaaaaaaacaaaaaaaaccagatctcttctgttttggagtttgtgattctttctaaaaattcctgggttgaaccggcatattttgtaaacaagaaaccagtggaaaaaaaaaaaaaaaaaaaaagaaagaaagaaagaaaagaaaccagtgaacaaacgaaacccggtaaacaaggtcctggaggagctgtttaaccagttcccaaaaaaacattttccaagccctttcattgggcccctgtgagctgttagacaacttagctgcagctgttacctgagaaacaggtattgaggggtttcagtaatggtccccaaaacagagtggtgtagtccaatgtaatccagaagcaaaagaacctcacttcaatgcctatcgctgccccacccccatccccacctgtcattctggggcagtagttctcaaacgtaagtttgccccttaaaaaatgccaatttgattctagagatctgtgatgggtccctgaaactgcattttaagcaggcacccccttccttggtgtgttataccacactttgagaaacaccaccatagggctggcctgagaatctccagaagtgcccaactcccgcatcccttggttgatttactgtccccttccctccagccagccatgagccaagaagctggccttgagctagtgctttcttggactctgacaccagggtaggaaatgactttcatacatattctgatcttgcctcggtgggttagagatggcctgtgcctattagtctgtactgtacttccagtatcatgagaatttaagcagtgccattaggtcacatcttcccatcctaactcagtctcagtcttcccgttagaaccagggcagccaatgctatgtaattcccatggactcgagtcctcagatttcatggtacctagcggtcctggtagcatttatgagagctttcagtttcgctgaataccatcaccgaatatcctagtaatgccctattttgttgcaaagcctgtagggggccactttagcaacaacattgcaaagatggtacacagtcacattgctcccttgacatggaaaccagtgctgaataacgtctgctgctaagagctttttctatttcctagttcctcttcaaatagatatgtaagggtgaggttagataggctgctggactttcctgtttttgacatctttttttctatattaatcttttcccgttggttcacaaatgtcatatcttttccttctgtggccccagacttcctatttattgtcttgcctctcccccagaatctgaatgcctgcctctccttggctaactggagtaaaaagttgagggaagtcgttggaatgttgaatgacttctagtaggaagacccagaatcatggaaatatgaggcttagagatataaggaaacctattacaaatgtgtctggtgcagtcctctcgtctttcagatgaagaatctaggagatgagatggcagaggtgaggatgcctggctcctaacccagtgttcttcctgttaaatcttctcaagaaaaatgcttcagtgggatccctgggtggctcagcggttgagcacctgcctttgcctcagggcatgatcctggagtcccggatcgagtcccacatcaggctccctgcatggagcctgcttctccctctgcctgtgtctttgcctctgtgtgtgtgtgtgtgtgtgtgtctttcatgaataaataaaaatctttaagaaaaggttgaaagaaattcagttataagaagatgacagtggagagacttttacatgaccacaaaagcattattttctagaaaaatagagattgaaggaaaatgtaggagattgaaggactctgaagcatgaaataggtagtaaaagtttaaataagcagataccttgtaatcccaagagacattgtgaacttaaaattttttaaaaattcagtaaaggttaagatgagtaccttggtgaatttttattaaatattaggtgtttgagcaatatccagaatgttgttgtttgttttgtttttaaagattttatttattcatgagtgacacaggcagagggagaagcaggctccatacagggagcccgatgtgggactctatcccgggactcggggatcatgccctgggctgaaggcagacggtaaaccgctgagccacccaggcgaccctgtacgtattgttttgaggttgttacataactatattgttgtccatatcaaagttattagatattctgtggaagacagaacataaaactgatctaactactaatctgatttaatatattttcttaggagaaatgagattaatgggatacaaacgcatttctgagatgtaggcaggaaagaagtatggatggaaaaagaagcttttgttttgttcttagagagtgagtgcacacgcacatacacatgtatgggggcaaagggagaaggagagagagaatcctaatcatgctgtatgcccagtgtgaagctggacatggggctctatctcatgaccctgagatcacgacgtgaaccaaaatcaagagtttgatacttgagtgactgagtcccaagagaaccttttgatatttttgcttttagtccccaaattagacattgttggattctccttgtatcttgatgaaagtagaattagaggagtaagggctaatgtactaaatgcttctacatccattgttttatttatttccattatatagctgaggaatctaagatacaaagagcttaagtttgttcaaagtcatgcacctagtaagtggcagagccactgttcaaacttaaatctgcatgcccccaaagctattaagatttatgctcaatagtgccctcattatacttcattgggtggtagttcagaatgtgggcattgagcccagcctttcctgggttcaaatcctggctcctttatttactaactggataaagtactcctccgtttctatgtctctgaaatggagattgtcatagttacctacctcagagggctgttagggtcaagttaattcacataaagtacttagaactgtgcctgacacagtaaattctcaggaaatgttggcttttttttttttttttttaatcaagatactcttttctttagattcagatggtccttcctactgttaaattactaaggcattatgataaatatagacaaactatctctgttcttactaaaacagagggagccttattaaaattttggaaaatactggggtatagtgcaaagatctgtaattgggaccagagggtttagtttctgtttgtttcatagagaaggttgtacgaatcagatgaagtaacaaatacaaatggaattttacatttgtatagcatatacagttattaaaattagagaggaaagttgcagtaaattattgataagattttttttttttgataagatttttaaaagaaagtttgacttccttaaaacagctagtgatttacagttctataggaagatcacagtccataccataaaaccacataagagtccttccatgtgtttgtcctacatctcttttttggtggtagagcctgaaatttttttttttttttttgcagttgtatctgttatattagtttgctagggctgccataaaaaaaaaaaaaaaaaaaaaagtatcacagactgttaactaacagaaatttattttcctacaattccgaaggctggaggtctgagatcaagatgttggcaggattggtttcttctgaggccttcttgctttgtttatgtcctcacttccttttcttaaaaattctattagtttagggcctgctctaatgacttcatttaaccttaattacctcttttaaagtccttatttccaaacagtcccactgaggatttaggagttgggatttcaacatacaaatgttgaagggaacacaatttagcttataacagtctgtttaggggattaaaaattttttatttagaaaattttattttttttaggaaattttaggaaaatttgttttttatttaggaaattctgtgccagctaatctgaatgttccattgcccttattgttgagtgccctaggtctcaagcaacatcctttatccccatgcctgccctgtcttaccttccatctgttacttagaaccatgcttgctgtcgagtaccctaagaaacacatcatgcctctgcattaagtcattgcgtttggatttttttttaaagatttatttatgagagaacagagagagaaggcggcgggggggggggggggtggcagcagaaggagaagcaggctccatgcagggagcccgatgtggaactcgatcctgggactccgggatcaccccctgggccgaaggcaggcactttaactgctgagccacccaggtgtcccgtgtttggatattttaaatatatatatatttatttattcatgagagacacagagagagaggcagagacacaggcagagggaggagcaggctccctttggggagcctgatgcaggactcccccaggaccccaggatcacaccctgagccaaaggcagatgctcaaccaccgagccacccaggtgcccctgcatttggacttaaagcaagaatctgcttgagaaactataccatatatttaatctaataaattcctaatttatttggtaagcatatttctttcatctaaatggaagaatttcaaaatttcttatgtattaattttttttaacttttaaaatttgttcttaaactgttttaagccttttttcttttcttttctttttttaagattttatttatttattcatgagagagagagagaggcatagacacaggcagagggagaagtaggctccatgcagggagtccaacatgggactccatcccaggactccaggatcacaccccgggctgaaggcggccttaaaccgctacaccactggggctgccctaagccttttctaagaaaaaaaaaaaggtttttttttttttgttgttgttgttgtttgaaaaaaagttctcacattttcttgaagagttctctgttttaagatacattttcctccccccccccttttttttaagattttattcattcactcatgaaagacacacagggggccaggggggcagagacacaggcagagggagaagcaggctccaagcagggagctggagatgggacttgatctcaggtctccaggatcacaccctgggctgaaggcagcactaaactgctgagccactggggctgccccttttttcccattttaaaagtaataacacttttattttagggacttcggaatattcaataaaatacaatttaatggggtgcctgagtggctcagttggttaaacatctgccttcagctcctgtcatgattccagaatcctgggatggagccccacatcaggcttcctgatgagtggggagtctgcttctgcctctccccctgctcatgatgtctctcactctttcaaataaatgaataaaatctttaaaatacaattaaacacacatgataagcctacaatggagaataattaatattatcaaacttttttctatgaatatttcaatctgcttttttcaatcaatattgttccatgctactttagtcataatataaaacttatttctttttagtctttgaatgtgaattgtattataagttatattaattttttagactgttaaaccaactttcctcataatatgttacccctttggttttttaataatgtttaggatttttgtgcttatgtttatgagagaaaataacctcagaaaattaactggggaaatattcctcctttttctgctttcagaaagagtttgtataagattgatgtaatttcttccttaaagatgtgggaaaatttgctagccaagccatttggtcctggagttttatttatggaaaggttttaattatggattatgattctgtgtgtatgtatatgataatatatgtatcttctatctataaatatacacacctatattatatatgttaagatatttatcatagggagttggcttatagaatcgtgggggctggactagaccatcaggaagggcaggttgaaactctggacaggagttgaagctatagtccaaaggtgaattttttctttcctaatagagaaaccttagttctgctcttagagcctttcaattgactggatcaggcccactcagaatatctaaaattaccttccttaattaaagtgattatagacttttaatcacatctaccacactttcacagtaacacctagattagtgtttgaactgtgactgtaacttaagcaagtttacatatgaaactgaccatcatagcttctctccagtcttcaagacttggctactttacttgtctgatgccttcaagcaattgtctttttctgttttgcccatttttctgaaggatgtattattctaggggatagactaaaaccaaacatggaagttatggtgggtctggggaggaagacaaacttgggttcaactcgaaaaaagagaaattttcccccaaggattgctattcaacgattgagtgaatgagcaaaacaagagactcttatttttgaatgtttttaggtaggctggactaaactggtagaagtgtttttgtagtcctaggtggaaggttattggagtccagatttttttgagattcatgattggtaaaattgtgggggaggaaattgggagcctatcataagcttgccagtatcttagcacattaaaaacaaaaacaaaacaaaaaaacaaacctggccatcattttctgttaccattatttcataaaagaaaagacatttaatatcaaaaaagaaaggtataatttaggtacaaaggactgcccttcccaagaaagcactacacctataccataattctttagttaacattttaatatttttggaattatggggtatcttaaaatcatgtatatatctaatacactagtactttttcctacaaagctgttattattagattgatgatgtctccatcaatgtccagtgtctttgaactggaatgacttgtctgtttatgtgtatattgcattgtcctcatttctgctaagaattcagtggaaacttttgacactaatggtactggtccttgaagcaagcatcttctgacaatgatttttggattgtctccaaaattttcagcatcttctgtagctacagtactgatccatggatctgtctccagagaccttcagatctttcttgccatatgtacatctagctttttttttctaaaatgacctgctatgttaactagtacttttttttttttttaagattttatttatttattcatgtgagacacacagagaggcagacacgtagtcagagggagaaagagtctcactgcagggtgcctggtgcagagctcgatcccaggaccccaggatcatgacctgagccaaaggccgatggtcaaccattgagtcatccaggtgccccatttttaaattttttaattgcactgccttgcactataccttttaagacactattactaatagtatatcccttggagatttcctggaagtttgccaaagtaatctttgtgtatctcttcctttaaaggttttcaggtttttaacaagcagaagagtgtcttggacattaggaacatcaccctggagattatataatatgttgactggcttcttagtagtcataagctttgcctggtctattatgtgccttgggttgttcttagcataatgttgtcactaacatgaatagaactagttgaatccaatcaaaagatcgaaacagctgtgtggaaattataaaatttcatctacaccgttttttaggtaataaagttgaaagttgaagcagaattaggtaagatctttgaactcggaattcacattgtaaaatcgaccctccacatggagttaattgatttagaaatccttttatagcaactatttaaaccaaaaaggtgctgagtatgcccattattggcacagaaaagctgtgtgcccaggctacagatcttgggcttgaaattataattccaaacctctgtgacttaagtagaaattgtgaggtaaatcagacctataacacagcatgatgggtaacatagatagtgaagccagaagcctgggtttgaagcttggctccactatttattagctgtgtgactgagaactttccttaacctctttcttcctctgtttactcacctataaaatgagggtaataatggcacctactttgtaaagttttaacatttataaagtacttagaaccatatgtggcacatgatatgtgtgaataaagtttatggccatctgtacttaagatgtaggatttgtagtaatttgacatattgaacaatctcagctgattcatttgtgattgtaatgtagaatgtgttcttgagtaattagttgggctttagatttgattactagtttaaggatataagataactttgctgtttgaaagagttgcaatatttaagaacttcttgagatacactagattcatcagtttaactttttttaggatctaccagtttcttttcattgcttaaagatttgcttggtatgcagttgaagtgctaaaacaagaaaagagaatatattaagactataggtatagtttgaaatatttgatagaaataccaaacttaggggcacatgggtggctcagtcagttaaggtctgcctttcactcaggtcatgatcccaggatcctgggattgagccccatgtggggaaatccctgctcagcggggagcctgcttctctccctctccctctgcctgctgctctgcctacttgtgttctctctctctctgtcaaataaataaaatcctaaaaaaagaaataccaaacttaggatagtggttatagaggattcaactatattatcatgttttttgttttaaactgggtggtaagtataaaagtttttattgtttaaatctttttttttcaagtacagtagttttttaattaatttgaaaaatgtgtaaaagaaactgattaagggcagtcttagttttaaattggacacaaggtcttaaatcttaatttaaatccaagtaattataatatagtctctgtgaacaaaacctgttcttggacataagtaatcacaaaaagtactagaggcagtaaattgggaatgtcaagtagaaaagacaagaaatagtgtccaagcaattatgatctttcactactgtcattgtgcttttatctgccagccttttagcctgtcctcagcaattcatagggaagaaggaaagaaaggggaagtggaattagagctccagcctttctgtagaattggaatgtcctcttctctcttgcatctcttctctcattgtggctttcttccaagatagaaaaaaatgaggaacagaggtggttgtgccaatagacatctttgaattttatgccttccccaacttgttttttgccttaaattctattttgtaggctattaatatattttcaccatctctcttttgggtgagtttctttttccatcctttgcccgtttttctgttgttagtttcatgcattctcataagccctcactgaatattgtgataataactctgtgtagcctgttgcaaatacatttttcaaatctatttttatagcatcccttgtcatacaaaaatttttagttttttgttttgggggtggggagttttggagtcaaatttgtcttttttcttttagcttttgggttttgggtcctgattaaaaaggcatgcctctcttggggcgcctgggtggctcaatgtgttaaagtctgccttctgctcaggtcatgatctctgggatcaggccctgtgttgtgctccctgctcagcagggagtctccttctccctcttcatctgcccttccctcttttctgctaccgcactcacactctctcaaatgaataaataaaatcttttaaaaaaaaaattaaaaaggtctctctatcccaagattgtaagtctcctagaatattctttaaaaagaatattgctgtgattcagtctctcatccatgaaatgaaaagttatactaaatcatttgttcctaaacatcatcagtctacaggatcacctgaggagcttattaaaaattcattctctctctttttttttttaaaggttttatttatttattcatgagagacacagagaaagagagagagaggcagagacacaggcagagggagaagcaggctccacacagggagccagatgtgagactcgatcctgcaactccaagattacgccctgggctgaaggcaggtgctaaaccgctgagccacccagggatcccctaaacattcattctcagatcctaccccaatcagaatctttgcggaatggagcccaagaatatgtttttaaccagttcttctgagtgatactgattatcaactagacttgagaactactggaaatataatcaccctaaggtctctttttccaaaatattacttttctgtattatgtaactcttgtgtttggagttttcttaacaactagactataagctctttgaatgtaggcaggactatgtcttacgtactacccttcttgccattaacccattgagatcctattacttcactcttggacagttctaatagcctcttcttttaattattccagtctgtctgtggctgtatttatcttgaagcattcatcttcaaacattttgaacatgagccttttttttttttaaagattttattatttatttgacagcacaagcagggggcatgggagagggagaagcaggctccccactgagcagagatcacaatgatgcaatgcagggcttgatcccaggaccccgggatcatgacctgagctgaagtcaagacactttactgactgagccacccaggcacctgaatatgaactttctatatgtaaaaacattggctataggacaaaattctaactgttttactttgtaattcaaggcctccataagctggttccatcttgttttttaattttatctgcccccaggactgttgtgtatactcatctaagttatacattgtacagttccttaaatgatggtatacatggggtttcctggagttgtatgatacgatgatgaccctggtttctcccatccttttgcattaaccctttactctagcctgattggtcttctaccccaccccccttatatatagtaataaagctttattcactcttactttcctgcctgttatatgtcgtatacgctatctagcatgctctttcttcttttctctatcaaagttctacatgttaacatctacagagtggagtattacatagtaataaagagaatgaggatggtttctaatcactcttttggcgtaaattccagtttagttaaaaatagccaaagataggaggattagataatagcgttccatcttctgtataagaaaaaggaattttgaatctacctgtatatacacattttatgcttatttcttcaaaaagaaatatgaagggtaaataaattaataaaactggttgtggggaatagatggggaaagattggagggaaaagggaagggaaagatacttctctgagcattcttttcttttttaattacgattcatccatttattctgcaggtatggaggcagagggggagggagacagagaatctcaagcagacttcctgctgagcttggagccccacatagggctccatcttatgcccccaagaccaggacctgaactgaaatcaaaagtcagatgcccacatgactaagccacctaggtgccccataacacctggacttttgaaccatgtaaaggttttacatagtaagtataaagagaaatgaacctaacctacaggaggatatatagaggaaaaataagttgaacatagcatactgatagtacatccctagtagggtatactttaaggacaaaaagagctgccccctaatatgtacttaaaatttagtatattctttattgtaagtaataatatagatgttataattttgtttttttaaagattttattttttattcatgagagacacagagaggcagagacacaggcagagggagaagcaggctccatgcagggagcctgatgcaagactcgatcccaggaccccaggatcacaccctgggctgaaggcaggcactaaaccactgaaccacccaggtgtccctagatgttataaatttgaactagtttatgaaccaagattttcattgtgagggaaaagatatataaggaaaaactatagtgttgaattagagttgaaaatatcagtatggggggcctgggtggctcagttggttaagtgtctgcctttggctcaagtcatgatctcaaggtcctagaatcaagccctgctttgggctccttgctcagcagggagtctgcttcttcctctcctcctcctcccccccgattgtactctctctctctcaaataaataaaaattttaaaaaaagaagaaaatatcagtataaactcataattgttaaaaaaaaaaaaagtcacaaagtttgtctattaaaatagcttagaagtagtgacactcctgtaactatgaggacaactagtgctcagatcttgatttataaatgccattgcccactagaagaaacagaggctccagggagaagtggctgattccaggtctggggcagagatggcaaaaggtgagcttagagaaatcttatgtcaacaaatagcctcaaaagcaaatagaattgtgtgaaaatgacacagatgataacttgaagagaatcccactggcaatatttggaatagtttgaaccaaaaattggggacaatttgaaaaaaaagttatggtaatggattattatactagattaaaacaaatgagttcacaatgatacttaaggagaaataagggaagggtgaaaaaatagttctacttcatggaatactgctatattgtagatgtaggaagaattacacaattagaaagccatcattttacagtctgaaatgtaataactgatgcaggcaagaatcctcagtagattgccaaaaccacagggtaagattattaacttctctctttacaatggagagagatatagagtcaccatttagctgagtcatcaaacttatctcctgtagtggggtaacctggcattatgtgcccctaatgtaatggtgtttggaagggtacaactgccatctatgttgtattctagtttagacgcaaaattttttactcatttggaaacaatcagatccagtatgttggaactgacctagactcttttaaaatgtcagtttcaggggtgcctaggtggctatcagttgagcttccaactcttcattttggcccaggtcatgagattttgagatggaaccctgtactccctatagagtgctcagtaagaagtctacttctctccctctctgtactctctttcagctctctctgtaaaataaattaaaaataagtaaaatgtcaatttcattttttttaaatggagggagggaatatgcaaaattaaaagattcagaacaaccaaatgcaaggaatgggccttgattgaattatggatccccaaaaaggctgtaaaagaaaatatgaagccaaattaataaatttaattatagattatatgttgagattatagaattgttcattttcttagatgaaaatggtactgtagcattttgtaggagaatgttgtgattcttagactatgtatactgaagtattaggattatcaaatgtgatacctaacaggtgatttggaaaattgtggaggaggaagcataagcacagacaaatgagacaggatgatcactggtaagtctgaggggtacatatgagggtactgattgtaatgatttttccattttcctgtagatatgaaaagtttcaaaataaaaaattgaggatccctgggtggcacagcggtttggcgcctgccttcggcccagggcgcaatcctggaggcccgggatcgagtcccacgtcgggctcccggtgcgtggagcctgcttctctctctgcctgtgtctctgcctctctctctctctctgtgtgtgactatcataaataaataaaaaattattaaaaaaataaataaataaataaaaaattggggagaaaaaaatcttatcttcagagcccagcacagatttttttctgatgaagactttgttttcctagccacactagctcgaggtgattttctcatataaattttttttaagactttattttgttttatcttattttgttttattttattttattattttattattttatttatttgtttgtttgtttgtttatgatagtcacagagagagagaggcagagacacaggcagagggagaagcaggctccatgtaccgggagcctgacgtgggattcgatcccgggtgtccaggatcacgccctgggccaaaggcaggtgccaaaccactgcgccacccagggatccctcttgtataaatttttatgactttttctcttacgatccccaaaactaaatgcacatgggagctgcctgaggagttgactttaaaaaaaaaaaattacaaactgctggatcccactgtgagcctatggcaactactgtgggaggatagacctgagaatcgaactggtgtttttagaaccacttattctgtatatattactttatttatctttttcacatatccccacctaaacagcccaaccctgaagttgttactcaatactttgtgtccctcattgctggcacacaataatatgtatgttccacaaagtagatgtttggtaaatatatgctgactatatatgttgactaataggtagataatctgaagagattaccagaaacttctcacattttgagagcttaaaaaagaaacatagctgataaaagtttttagtcaagacaaaagattcattagaaggctgtgtaattttggggcacttgactggctcagttggtagataacacaactcttggtctcagggtcattatttcaagccccacgttggccatggagcctactttcaaaaaaagaaagctgtgtagtttttaggtctaaaattacaggtttggtttacagaaataacatgtcttatcagtaaatgtttgaaattaagacttaacagtggtatcataactaaattttttttttttttttaatgatagtcacagagagagagagagagaggcagagacacaggcagaggtagaagcaggctccatgcagggagcccgacgtgggacctgatcccaggtctccaggatcacaccccgggctgcaggcaacgctaaaccgctgcgccaccaaggctgccccataactaaattttattatctctgcagacgaacatattcagaatccagtagttattcttaacattaaaaaatacagatacagggcagccccgctggcacagtggtttagcaccgcctgcggcccagggcgtgatcctggagtcctgggatcgagtcccacatcgggctcccttcatggagccttcttctcctctgcctgtgtctctgcctctctctctctcgctctgtgtctctcatgaataaaataaaatctttaaaaaaaataaaaaatacaaatacacagagataatagaaggttgttggtattggagctgagatgagggatgatatggtaggtgggtaatgcaaaaaagaaacaagcaaagattaaaaaatgtttttgagtatgattgaaatatgatttttttataagcttgaagccaaaaagaaaagcttgaagctagatttgaatatatgaatagtaacagctaacagtttcttcagtttcttcttcatatgccggagattgtgcatgatctgaagtattcgtaatccttcttccaaatagatattacttcaggctccctgccaggatcctgcttctccctctgcctgtgtctctgcctctctctgggtgtctctcatgaatacataaataaaatcttttaaacaaacaaaaaaagacaaacaaaggggcgcctggatggctcagtggttgagcatctgcctttggcccagggcatgatcccggggtcctgggatcgagtcccacatcaggctccccgcagggatcctgcttcttcctctgcctgtgtctctgctctctctctctctctctctctctctgtgtctctcatgaataaataaatcttttaaaaaatttttttgactaaacactgtctcaacaataaacagcaaaatcactctagtattaatagtttcaatcacccacacatatttttaatattccattggaatgagttaatggcagtaatcttttcaggtaaagcgaagttttacttcctataataaaagttggaacaaatgggtgccaggctggctcagttggtagagcatgcaactcttggggctgttagtttaagtcccacattgggtatagagattgcttacaaaataaaatctttacaaacaaagctacagtttgggtaacaaactgttacagggaatctgtgtacaactgctatccattaaatgtaatgttcttatcacagtaattctaaactaataaaacatgttattcattgcagaaaaaaatgtaaggaaaagttaggcaactgaggcaaaaaatactatgtggaattccaaaaatagtacagggtgttgtcttactgaatcgaaatgagaaaggcgagcagcccaggtggctcagcggtttagcgccttcagcccagggtgtgatcctggagactcgggatcgagtcccacatcgggctccctgcatggagcctgcttctccctctgcctctctctctctctgtgtctcttgtgaataaataaataaaatctttaaaaaaataaaaagacatgtttaaaaaaaaagagaaaggtggctcaagtcagaaccagacaatagtcagaacataataaacattcagaagtggaggataagcatgatgtgcttagagagctaaataagtactgagcagttgtataagagaaattgacacatctccaagtttatctcgtgtcttttgtatgttgtctcatgatttttgagagcttttgtctcatgatttttgagagcttttccatgcatcctgtttgagacaggtttgtctgacttggtaacggcagatatcttcctctattttcatagatgaaaacattgaagcttaaagaatgttttggtgacatggctagttaataatgaagccaaagccagaagctgctttgctttagtctagtgggtggtcttgtaatcatatgttgttttctcagacttccagggagatgagagcagtcctgggaaacatccagtgattctggtcaagcctgacaaacttgatatgaataaatctctattacctaatacctgcccagtgtggttgtttttccccacccacccagaatttaaggctttttttttttttttttaagattttatttatttatttatgagagacacagaaagagaggcagagacttaggcagagggagaagcaggctccatgcagggagcccaatgcgggactccatccagggactccaggatcatgccgtgagctaaagtcaggcaccaactggctgagccacccaggtgtccctacttttaaggctcttgaaggtgaaatttttgatgaaaaaaatgatgttaatttactacattaaaatgaatatcaaaaaatgagttatatttgtatttcactcatcagaatagcaaagatgaagaaaactgaaacactagcaagagttctggaaagtgaatgccccatgttgctggaaagattttatttattttttttaagattttatttatttggcagatagcacaagcagggggaatggcagagagagagggataagcagacactacccccaccccttcccaccctccctgagcagggagcccaatgtggggcttgatcctaggaacccgtggtcatgacctgagccaaaggtagatgttcaactaactgagccacccaggtgcccctagagatactttaaatgggtatatttatagaggataatctggcagtatctatcaaaacttaaaaattatttacctttttttttaaaagattatatttattcatgagagagagacagagacacaagcagagagagaagcaggctccatgcagggagcccgacgtgggactcgatcccgggactcagggatcacaccctgggctaaaggcagcactaaaccactgagccactggggctgccctgtttacctttttcattatcagttttacttctaagagtttattccaaggatataatggggagatgcccaaagttataataatacgtgcaaagatttcaccacagctttattgttttttttgtttttgttttttgctgtttttttttttttagattttgtttattttagagcaggaggcaggggcaaagggagaggaagagaatcttcagcagactccctgctgagtgaggagccggcgacacggggctcagtcccaggaccctgagctcatgacctgagtcaaaatcgagagtctgatgctttgggcccctgggtagctcagtcagttaagcatctgtcattggctcagatcaagcccctcattgggctccctgctcagtggggaatctgcttctccctttgccccctacccatctcccctcatgcactctcacgctctctctctctgaaataaataaaatcttaaaaaaaaaaaaaaaaaaaaaaagtctgacacttaaccaaccaggccacctaggtgccccagctttgttgatttttcaagtatctttctatattgactgcttttttttttttcagtgagtacatattgcttttataagcagtaaaatactaataatgcttattttatggaagaatataaccatgctatcacaggattcttactgccgtaacccctacatgttaagaatagcagcagtgacactactggctttctctttcatttgtgacaaacaatagaaggaataacttctagagtcagtaatggattaaaggcaagatggtttgcaggaaacactgtgactaaatggaaagaatacaggaatccagggacctaattctggaatctacctttgccttttagctagagttatgatttggagaaagttgctaacctctctaaagcttaattcccacccccacccccacccccacccccgatttgagtgaggataattaaagtatccctcctggagttgtttcagtagcaaataagattaggttggtaaaatctctttgtagactctttggtttaggaatagaacagtaatcactatacatgccaagcattgtactaagcactttaaatgtattacctcatttaatccttatatcaactttgtgtaattaatagttatttcctttctgacaagtgagaaagttgagacacagacttatagggcctgcacagggccacgttataaatgttagagccatgataaaagatcatacgtgggggggaagtgtggcaggagagctctaagaagtgattcatgtctcaccagtctgccagagttcaaggaagcacgtgtgtaggggggacccagtagaaataatttactaacaagggtctcattgctcatttaaacagctaaattattatggatttagggacctattgtaggacaattccaagatttaaaaatgttaacagaatttatatgggctttatctggagtggtcttacttaagatttttagaaatattctgggaaaaggaaaaccagaagccttcaatagttagaagactgaatttcttcagaaattggaacattagggtcacacatgcaaaggaagtgaatagaactatgacagaaaagcttcggtagagttggtttaaaaaaaatggatacctggagtatattctaaaaatggtagccttgaggattcttgggtggcttgagcgtctgcctttggctcagggtgtgatcctggagtcctgggatcaagccccacatcaggctccctgcatggagcctgcttctccctctccgtgtgtgtgtgtgtgtgtgtgtgtgtgtgtgtgtgtgtgtgtgtgtgtctgtctctcatgaataaataaaatcttttaaaaataataaataaatgttttaaaattgcagcctctttgcaatccatccattaataccttagaaggtgatcatgaagacattttagattatatctttgttgtctctctcctcccctactattagccctttttaactatttccagaaatcctgggtatcatcagagaatatatgtgaagcaaaatgaaaacctgttcaactttaaataaaaaacattagcagggttgtcattactatgcataaataatggaactaggccaaagtcaacaatatgccattaaaacagttaaagaaatgtagtagttttcacataagaatagactgaagggatccctgggtggctcagcagtttagcgcctgccttcagcctaggtgtgatcctggagtcccgggatcgaatcccacatcaggcctgcatggagcctgcttctccctctgcctgtgtctctgcctctctctctctctctgtgtctctcatgaataaataaataaaatcttaaaaaaaaaaaaaaagaagaagaacagactgaaaagaccgagacttgtttagaattaagtttgggcaaagatgtaattattttctaaagctaattatggagtatggatgaagggtggactggtttatttactgaattctgtggcatcctacctcatctccaccactcagcttactctgaagtaaaaaggtactgccttttaaaagatcatacccaagaccttctcggggtcctgggatccagccctatgttgggctccttgctcagcaggaggtctgtttctccctctccatctccttctgctccttcccctgcttgtgcgctcactctctctctcaaatgaataaataaaatctttaaaaaatgaacagtctaaaagcgtacttttgaaatagattaaaccttattaaaaaataagaccccattttggtctttcccttgtcggcaataagcattttctgattttacggatctttttcttttcctgttccgtagacctgactttgacatcttctgaatcaaacttgagagcaatagtggttttatttgactttaccagtggctagggatctgttttaacctctccatgctacatgttattgcccttagtgacctaactttttcgttaactggtgttaggatgcagtccatttgcataaaaattggtggtgacataagatcattcttccaccagagcaccaaagggaatcaggacagtataaaccgaaagtgctaatacaataagtagggtgaacttcgggagtattttgaatagttggacatcccccaaagtatagaggggttggggggtgtgattacctgaaagagagggatgaagcttcccacatagccccctccccattgtgccttgggagcaaatgccttgcatgaggcagtagctcattacttgttccttacatgactcccctgcttgagggagagttagccttctagccagtgacattgtggtgtaattttgacataggggctgagggttaagcataaggtacagaaagtgagagaggacttatgaataggaagttgagcactgtaagtcaaactgcttatttgagggcagatgacttcttgttccaactcttggatgagccttacagtgcttgatagtttgcatttcctaatgcttgttagaggagcatatgtgcctagattatttttaatacatgggcaggttttctttaactgaccagttggattcttgccctcttttgtgtctgtgatctaaacaccaccaaattattgcactaccatttaatttgtagaactgatcatgactgcagcaagaattgtggatttgaggtctctttttggatacagcttaaaattattctcaagtaacaaggtggtcaatgtttttacattgtcagtggtttggtaaagaccatttcgataagcccagttcctcccagtataaaatcacaggaatgtttaagatgtcatttcttttcagagcaagaatgcgaggcatctgtgagttctccagcttgcctttcatgccttggagttccttgggaacgtgtttggagaatgttctagatcatgcatattcctgtcttccaggctttttttttctggtcaagcagacagttcaggattccgaatccaagcatgaacgttcatcgtggcagtgagagtgacagagggctgtggcaggaagcgagcggcccaactgacgggcccacagccccagcgccagaaagagaaacaaacagcttggctgctgctgttcttcagaacctcacttaccctccaggtcccaggagtgatggtacgagggttagagcttaacttccttgggagggctttctgacactcgagcattcactctacccagaaggcatataaaaaaaaaatccccagctaattggcttagctcacatatcactgttacataaagctgactgtcaccaaaaatccctgcttacttaatcagtccagcacacccaactcagcaacaacagtataagaaaaatagtcctgggtctgcagtcagaagacagatgcaaattctagctctgctactaatcacctataaccatagatgagctctttaatctttctgagccctgctttcttaatctagaaaacagggatattaatattattcttcatgagactggaagacttcggagttcatggatgtgcaagctcttgataaactgtcaggttctttttaactttaaaaggcagtggcaacactaataataacagttactgagttactgtttattgagcgttcaccttcactgtgctaggaactttatatacatgtttttagataaagggtggcaaactgtggccaaatctaaaccaccgcctgtttttgtgcataaagttcaaaaatgcagccatcatgcccgtttgttgacccacggtctttggctgctttcctacagtggcagaaactgaccggcaaagctttctggccccttatagaaagtgtgctgatccctgcttagattcatcctccttgtgcagatgaggaaacagaagtttcataagcttacagaacgtgcccaggcccacaccggtaggaggtgggcagccaccatttaaacatgtgtctttctgaccaggctctgctagagaagcagagagtgctagaagcattctagatgcatccgctggcagaggagcagggtgtgcctgccatcctagagggtgccattagggagagtttatgcactgagtcccttttcctgctcacccatgtatgcccggtgggacttgcaccgttcaggaatcaggccacctgaactgcttccttggtgggcgggcggggtcaggcatcctgaatttgtgacataggtatttactttcattttttagaacagcactttgaattcaaaagcccatcttagtgattaaaatgtttcttgctagaagcttgcttgtgggccgtgtggaaatttaactcttggtgtgcaaacacagggccacactgaaaatttgtcaaaagtcaataggtttttggtctagattttggggtttttttcttgaaaagcgaatggagaagaaaagtgtgtgtatgctagctcacaatttttttggttatctaagggtccgaaatcagactgatttcccagaagtcatgagcagtgatcatgttcataaaatattgtatacaaacttaaaatatgtgagggatgggagtgagacattcagttgtatttctaaccttttactctttaaaaaaaaagatttgaagaaaacgtagaaaagtgttaattaagcttgtcaaatctaggtgacaggatatgcatattatatattgtgttaataaccttggtatgtttgaaatttttcataaaaatatttttttacattaaaataacagacttttttttacattaaagtaaaatatattaggacaactgccaatttaaaagaatcctatagtagtcatttgataaatatttccccctaattgtctactgcatgcatcccaatttcagatatttagttaaaagccttttttttttctttttttgcatgatatggtattagcacactttgaaatctctcacaatactttatttcagctgatagaataatcctgtgagggaggtggaatgaacatgattcttattttttttaaaatgaaccaggtttagaaaattaaataaactgcttaaagcaaatggctgcttggtgataccaggacaaaaacaggttctgtgaaggaatcctaactcaaggccaccagcattggaacttttctgttgagggcaaacctaacctcattttgaacctctttcaagaaatggtattggtgatgttaggattctccagtgcatagtgacaatgcatttttatgggaatttctagaaaaagtaatgcaacaactgtcatcccttttaggaaataaaatttagaaacatttagaaatttttgaagaatgtgaaaaatgaagtttttgcacacagaggtagcagtttccttaaataaatcataagaagtacaagagtattatttagagccagaagtagaaacagaagtaaaaagtgactgcctctgtgaacaagaccaggggagggcttggagtgtggcagggccttgctgattgtccacaagaattctctagtgtttaaatttttttaagccatacacatagtttactttaaattttttaaaacattttaaagtgtgggcattattgcctgccttctctcctctccaaaatataaacctgggaaaaaagctcagaggggtccaatatgagtctctagcttatttttcctttacttgttcaaagcaagaggttttttgggttttttgtttttgtttttttttgcctgcaaacatctaaaagtttgggggggggtttgttgttttttaaagagatgaagtttctttttcccccaagccttttttgctgtcaagttattttggtttgtttgtatgatcttttagacctttcacttgactatgcctctcagccagcaaatcttcagttccctcacataatgccacttcccgaagacgtcaaaggctcctgcttccaaaatgggaataaacggaaccatgaaccctttatggctccagaacgatttggaaacagcactgtgggctttggcagtaacgttcattcccaggcgccagagaaagtgacacttcttgtagatggcacacgttttgttgtgaatccacaaattttcactgctcatccggataccatgttgggaaggtaattgacaataatttccttccaaattcactctgttctctatgaatagaagtacctgttaatcttgcactagatgtgaggaaaagaagcactgcattgcttatttttctaccttcatacttttgtgaaatagggaggggaagcttataaaaagccttatatgtgttgatgatttaggggaggtacttatttacgaagccagtacagctttgagcctccgcagaagggagtgtagtcagttagaactgtgggaagtaatctgctgaatatccctcccaatttctctataaactcagtctaaaacagaagtcagatacctaatttcttttcttcttttttttttttagatacctaatttctattatccataatttgtatactctcaaaagtaatcttgtctgagttccacaggtcaaagacaggattaggtgagatctaagtcatgtttgttttttttctttaatctttcaataaatagaattagacacgtgtttcacatgacacaacagcaaagccattttactaccattttgtctgccatccatcaggcttggcagtaggtgtcatgctgtcattttctaatgcctccatcactattccaagttttctcaaataaaatctttgtatctggctgttttagtgtttcatgatttctttcttttcttcatattccattctctgtgctgcttcatttagaccatagtcttaactctcctcaccatctcctgcctccagcattttagagttaagagtttaggaaatacaagcagagcctgccagggaggagtactggccagaaagaattcttgggagcctgggctgagaattaggaagttctctttctggccaaccatagaccttgacatgaggaatagcaagttgggataagagtaaaaataataataatctgtgtgtatatacacacaaacatttgatttgtgaggactttcatctccttggaagtagatcttatttaaagatctaacttcactcaggaccttgaactaatttgaactgatttagaaatcagaatggaccacactcatttgttgaattttaggatcagtggaatctagctattcaaatatatttatatttgaacatacacatacagattcatgaagaaccatttttaaccagaaccaaacctgtatatttctcaaacatctaaagtaagactaaactagaacattaaaacattttccaaattggccctacattttatcagacttgacctcctgtcctcaggtttggtgtcactaccactattgcactgcccccacccatccccaccccctgaaactgttccctcagtgctggctggctctttgagatagattgcccctgaaggtagcaattgcaagaaggaaggcaagcattttctgagtgatagattaatagattcttgagtgacactctttgaatctggttatgagttgtcccatggcaagagagtctgattctttgtctaggtggttcatcagctgaggttatcagttctgagagatacttaggttgctctgtcctgaggttacatacagtgttcataagcctaggcagtgagcttacaaatatgggccactggtcacaagatggacaagctgagagattgcgaatggatttatgttaacccacgccactaccagataaataactttgagcttaggtcttgctgatgatagttggggggactggttacatggcatgtgttcactattttggtttttttgttttgttttaattttatttatttattcatgagagagaagcagagacacaggctccatgcagggagcctgacgtgggactcgatcctgggtcgccagtatcagaccctgggccgaaggcggcgctaaaccactgagccacccaggctgtccgtgttcactattttgactcataactgtcttggctagacttcaaccagaatgttccagaaaaatgtcagcattctttgaagacacttatcaggatggatttcttatatatggtgttcgtggtttggaaagcatgtgatttggagtctttttcagaactctgaaaagcagccaatttagggtggagggtaacagctttacattgaacagcaggactcccagcaggtgaaggaaggatatggcagtgaggccccattaggaacttaaatcaggctggccaaagatcctacctgcctgccctgtccctccctcacactgttttcccactccacggctcagaaatgtaatctgagtggtagaagtcatggggccagttgtactggacgggatctgagagaagggaggaagcatgggaaaatatgagtaagaaaaagtaagatctccttgtaccctcatgacctctgagttcatccacagagcaggcttgcctctctaacctgtggcagaccactgatgagcctaatacctcccgtccctgtctacttgacctgaagttcccatcattagggttactccttgggttgaaggaggacattttcccagagcccagtattaaaaggtaccaggagagggagaacagtaacatgtgcacccaccagtgcagatacatctgtcacacaggtgttgaaaagcaaaactcagaactactgagaattggcatactggataagtaacggtaacagggggcggaaaggaccaggaagggtcaggagcacgagacacgcggtcttcctgagctgccggcacacaggcaggttcctgagcagtggggagcgtgtgggaagcaaccctcacacacgccagagattttccaggggctaactctgcagatgccgctttatttcattactgtcacagatgcttaccacaggtgtttcttgaggacttgctgcttcatctctgcttggattctaatgttgaaagcaattgctaccacctggagggagcttcttcaaaggggttgggtcccattgctgtttttttaatttatactatgagaacatggaatggagtcttccagaatgaagatgggagcagtcctcatgtgtgaagaatcccttgaactagagaaggttaacatagttgcctgatgtctttcagaatgtttggaccaggaagagagtacaacttcactcggcccaatgagaagggagagtatgagatcgcggaaggaatcagtgctaccgtatttcgaacagtgctggtgtgtaggagcctcttcctgacatcctcttccccaggcacaagcatagtcagaagccttcagagttccatcaaattgttactgactttagagtctctggttcccagtttcctttccattttcttttttaattagtttatctttcttttttcaaatatttgagaaggagagcataaacagggggaagggggagagggagaagcaaaatccccctgagcagggagcctgacttgggcctctgtcccaggacctggagatcatgacctgaggcaaaagcaagacgcttaaccaactgagccacccaggtgcccttccctctgttttccattcctgtaacttttaggtacttcttgcttgtgcaagctcagtcaggtaccaggttgtggttaagcatgccaggagagaccaggggctactttgccagctgacaagtcagccaacttggtgatagttctagtaacctgtcattttaacagaaccaggaatgaatagagggttgaagaggtcattcttcgtctcgttctttgcctacatttctttttaatctgtttacaggattattataaaactggtatcatcaattgtcctgatggcatctcgattccagaccttagagatacatgtgattatctctgcattaactttgacttcaacactatccgatgtcaagatttgagtgagtacaggagcagctcccatctgcatttgagccactgaactttgagtttgcttggaatcaactgatatttttgatcactaaacagtttcaggcatggttgaaaatctctgcagaggcagagacatgatactaacttgttccctcttcctgcttcagagcactgtgaggaagtgtggagtaaacaaaccagaacatgtggtgggttctgaatctagcttgtccagcaaagcaccgagctaactactactcctcttggaaccttggtgtctcaactaataaatagggatactgattcttggacattagtctccaggtcccctgattctctctcccatagagtcaaacaacataaactggctgggttcttctaattatttttaccattattattaacttcgtgtgtactaagtcctttctagatgtgaacttgcttcattcttaaaacagtgagccctgcagggtgggcgataaccccatttaacaaatgagaagaccgagaaattagcttgttcaaagctataagcgttaaagctgggattagaactgattgtctgactacaaacaccatctcttattatcacctaggcttcctgaaattatttttaaaataattgaggttcacgatacatttccctgcatattccatgaagttctctagacttgtggtttctctactgggtctagcgcacacttagagcaaatcccttggtgtcctcaaacttcagatgattcctctttgtggtactgtaaatccatgaaattggggtccagagcatcttcagaacgagtactacaaatgctagttctgtctctggtattattaatgtgtgtggtctgacattgtatagctaacaaaacctcagttggtcagaatgctcagggattattaaacatgaggggggtgcttgggtggcttagttgattaagcatccaactcttggtttttgctcacatcttgatcctctgggttgtgggattgaggcctgcatcagctccatgctgggcatgttgggcggtggaacctgcttgggattctctctctccttccaccccacacccctccctccctctctctctaataaaataaataaacatgaggaagttaaagagtggtaaaatgtgagacccatctagcaaaatcagcttaattagcgtcttggagcaagaaacagtttctgcctttaatgggcaacctctctggaacttctcagtaataacagccattacctcatagtctttttgctccagtgatatctgcatttgggcagagaggatattcacctatagtttctctccccaggtgctttactgcatgaattgtctaatgatggtgctcacaagcagtttgaccactaccttgaagaattgatcttgcccatcatggtgggctgtgccaagaaaggggagcgagagtgccacatcgttgtgctaacagatgaggattctgtggactgggatgaagaccaccctcctcccatgggggaggaatattcccaaagtaggagccccctgcatggtgtacatgttttctgcaagaaacatgctgcccagagtagcagctagatcctagaagcagtgcgaatatcacttattgagctggcaatgagcacactcacctggatgatgagtgcagtgtagtgctgatgcagggctaacacttatgctgagcatctacaactccgactgctgcgcccagtgtcggatactgtggtgatacggagcctattaaatggtggtgtccctcttctctccgttggtcttatttttaaatccttttgaattggtaataattcaaaaagtacaaaaggttggatatacattgaaaagtcttgatcctacccctgcctcatctcagtttcttttatacccttcagatgtattcagtgcacacacataagcaattatgtccatgtttttccctttttttcaaatgctaccatattctatggactgttcaacaccatgtcttacataaaaagcttccacgatctttttaatggttatttactattccaccgtatgactgtgccatagttgatttaactggttctgttggtgggcttttaagctacaaattataaatgatgctgcaataaatttccttttaaacagtctattcatatgtataattctatagaacaatattcctagaaatggaatttctgtgccaaagccatgttcctttataatttgataaatgtggccagattctcctccatattacactcacaaagcaacatatgacaggtttgttccctcaccaaaacaaacaatgttttactaaacttttatcattgccactcagataaaaaatagcgttgcatttacacttaaatttgcatttcgcattccacaatcaagatttaccatctttttcatttttaagaaaccattttaatttccttttctgtaactttattttgccttttgcctattacagaattggatagtcttgcttagtgatttgtgaaggctctctctttgtatatatattaaggaaattagccctttgtaatgtgagctgcaggtatttttcccagttgactatttgtttttagctttattaaaagtggttttagctaagcagaaatgttgcatttctaggtagctgaatgtattaatttttattttaaatgtattaatttttattttatggcttctgggttttaggtcatacccagaaaagacttccccaccctgagactataacaatttctcaggtggtttctttcttatgtttgatctattgcttaacatttaatctgtgatctacctggattttgtttttggcatcagggtcaggtatacctttcattagactgattctgttagctcatctccctcctttttcagaagtcttcattccatgactaactcaatttttctttttccagttctttatagctccaagctctatagattcttcaaatatattgagaaccgtgatgttgctaaaacagtgttaaaggagcgaggcctgaaaaatattcgcattggaattgaaggtaataaatatcccagttagtattcagtttgcatggcttctggaataggctgtatctctgggcaccgcttatgtccttcaaacttggcttccagaggacctagagaatagacacctgtgagaactacattcctacctgttgaaaggattcctggttctgcttttgttcgcccttatatttcctttccattttatttccagttgtaaatgctttaaaacagctggaggaataagtcccagcatactgcttcgggataaagagcagtaagggctagggacactactgggtgaatggagcagagccccaggggctcaccaagtgctaaggatctctttggaatctggaagggtccttctgaaaactatagcctagagacttataatttgaatttattccactacatacctttgaggaatttctgtattgatagaatggttttaaatgatgttgagcagtggctcccaacctatggtctccatgaaagggtcttagccgctgactcttagagtacgctgaagttgtgctggtttcccctctgtgagtctttgactcttgtgttttactattcttgctgtctcagtctagcctactgagacatatcagatcttcactgtgtctgacttaggttggaattgcaggtgggaagagatttttgaggtctattaaacctttcactgcgtccctccttttcacgagaaaccccaggaacagggtgataaggattactccatttcccagagcagcctgtcatactgtcctaccactagaacattcttccgcatatctagtgcataacttcctctctcttctgtcttccagttctaatctctgaagctactctaaaatttctactcccatttccatgtgatagcatttcagatacttcaggcaacttccctgttttttctttaagaaagcgtgtaatgtataccttaaactactcctcctacagtgtgctctctaagcactagaattagagactggagttcaccatggcctagcaggatttctgttctctggcattgctgccagtgagtacaggcttctgaaattactaagaggctcttctcaccctgccattagaggggatagaatttttgttacttcccttctagggacaagacctgctaacctggatagatgggaggtgagtgtagcacagagggttgggagtggcaggacatggtcagaggtcatttccccagtagttttttttttttttttttttaagatttttaatttatttattcatgacagacacagagagagaggcagagacacaggcagagggagaagcaggctccatggagggagcccgatgtgggactcgatctgggtctccaggatcacgctccgggctgaaggcagcgctaaaccactgtgccaccggggctgtccatttctccagtagttcttatgcacagtctttgaatttgggaggaaattaccgtggttaggcaaagagaaagcgtggaatctagagtgagcaatttcctggagtcatgagaatggccttctgtgtttcaggttaccctacctgtaaagaaaaaattaagaggagacctggtggccggtctgaagtaatctataactatgtgcagcgcccctttattcagatgtcctgggaaaaggaagaagggaaaagtcgccatgtggatttccagtgtgtccgaagcaaatccctcaccaatctggtagctgctggagaagatgtcttggaggaccatgagatattaatgcaccacccaccccaagtggatgaacttgaccggctgaacgccccactttctcagatggcttctaacgactttcaggattagggccagctgtggacccacgcctcttcggagcccttctttgtactggatgcccacagctagcccttcccatggtttgtctcaccctgagtaggagacctgcttctccgtcctttccgtttttcccacagttagcgtgtgtccttttcattactgaaaagtctgtgcctccggcagtggataaaaaagcactgactggtaattaagctaccaactttgtagcagccctggtaacttgaaaaatctggtgccgtttacagagtctttgcataactgcaaaaagcaggaaaggaagtcaagactcttgtggcttcgtattcatcaaagcagtcctctcatcctttatactttgttcttggcttttttgtttgttttataccaggcaaattacttggcagcaaagggaccaaaccttaaaaaaagacaatctctagctcccataagctggcgctaatgggattcttgttaggggtcaataaaaatgccactcctggtggcctctgtgcccagatcacatctgggaagaactaggctctcatcaaaatgtccagaggggatttcttaagagtttaaattcagttttgtttttcattcattcagtgaataactcaaaaccagacagattctttgactataatagtgtaacaatgtttatgaaaccttgtcaggttcaagtctaaaggaattatttggaatgaccatttggaatcaaattcacagctccagaagaatcttttgaatcaggccactttaattatctggcttggaatctgatgtgaagaagctgtaggtcttcactgtaggcagcacactactgtaagtgtggcttggaaaccttagatgatatgggcttaaaggctttcaagagatgggcagaaacttctgacaagtgctctgtttctcaatagaaaagacttctaagagctccagggaagggggcatttggggtgaagctgggtggggaaacatcacctacccaggttttaccccagtacaggattttactttatatattcttttcatacaatggaatttttttttggatatcaggatatttgtttttgaagtggcctatcacactgctcacactgggttagaaaaccatagtaccgtcatccccaaaggaaggatgagttgaagggatgttaggcctaataattttgtttgatctgtcggctctgggttagtatggcatggtgtgtgacaacccagaccactcccccccccaccccggtactgaaccattttccctcatggccccttggctgttaacagcagagctaaatctagagtctagagccagacattaagtgtctggggctaatctcccatcttgtggtaaaggttggccacctacccagagcctgtagtcctcacacatttcagaggtacatagtttccttcaagttctttaaggtaacatgactagttttcttaaattccattcccataagacaccataaggcaaactagtcgattccagtttgccctaatcatagtcctccaaaggtataaagtcagatgggtgttgaaagctactctttccaaggcttgaagaacaagaacgttcttaagaaatgtgttctctgtacatgtgaccagcatcacagtagaaatcaatgctctgttcattactcagaaaaaagtagtaataagtagttaaactgagccatctcccacctatagtcgttctaccactggcatccaatttgtaaggctgatggtaatggttcaatttggggttaggtctttttgtagccagaggggacttttattttttatttttttgttttgttttgtttttccagaggggacttttatgtctgtgaaactcactgactcttgtttgaggtctggtttggctttgaccttaccagtacttcattcctaccaatagctgtccagcccagataatcgtttaatggtgcttcctttctgcttctcagttgacttccttctatgccatcacaaaggaaatctgaattaactgtgtagtgtaataacttcattctacgtcttctgtattaccattcaagtgtgaacatgccgcagctgacactgtaaaaccagttagtccttgcctaggtaaaaagccaggtatgaaagtatggcatgtatgtagcactctgttctatgtaaatgactcatttcctcaggctttcaagaagtaggtcccccccacacacaaaaggtgggtaatgtgcttttggccgcaatccatgggggtgagtgagcctcacaggtaaacccgtacaggtaaatctgctggtgtcactggatagtggtgacaaagggaaaagtggggcctaaaggtcccttctggtgaagagggaggtgtcttatggacccaccacccttccaacctggagctcagcatcactgtaatttagtagctccccttagccatggctgctctgttcccagggccaggacattccattaatggcaggaccgttcagtcgctgcagggacaagggggctgggttgcagtcattcccttcagagtccaccactggccagttcggcaagagatatttctaataaaggtggaactcaggtttggtgatttttttttttttctctaagtgcctaaataaggaagccaggctgttcatacatcttcttatgaagatggttttgctcagactgtctaactcagaggtagctcagtgagccaagaggaacctgaacttggagtttagaatctgagtttgtgaatgcatcatcatcatgcatcgttgattaggaaacatttggcattgagctggagagtgggcagagtgttaacatgagatgacgtcatggtttctcccaagtggaggaaaagtatagaaaagatgccagcaaaaatggtaaggaagctagaaagtaaatttactgcataatgtataatagcctatatattattttaagctaaatttgaagaaagtagaatgtcatctaacgtatacaggtctctgaaaatactgtagaataagcccaggaaacaatcagcacaggctttaactcaaattgtcggagtgtgacatagagtctttttttattaagtgtcaacagaaggttaagaatcagggggttttagtaatttattcaatgccacttcttgccattattttgaaattgttaaaatgggtaagagttcagaaagcaaacctgatggcttcactgggggagatggagccacactgtgctctgggtgggattgcctctgcacgagaacattacattttctctcaaaggcaaaatgcttgtagattttgcctctttactttgtatttacttttaaagttgcacttgttcacctaccagtgtttacgatatcctattacttgggatgctttttctataataaagtattatcatttgtgtccgtgttgtttttgagcagaaaataaaattggaagccaggacattaaaagggactgaagtagcagcacctcgactatccagagcagagcctcttcctttcctacaaggccacagggtcacttggagccaatgtgcatccttcttatcctattaatcactcccgggttccagaaccctaagagtctgccttcttgagttcctggttcattggcattcaagccctcctgaatcctccagtccaacctagtagggtcccacaaagccaaatacaaatttggaaggtaagaggactcagactttgatgttctggtttcaaacaaatgaggaactgcaacaggaatgaagagcaggtccctggaaaacactgctgtagagctgtgggctcctcctctggtctctgtgacttggcctgactccagtctggtgcctactgagtttcctcagctcccttagcctaggagtttatcgatgatggtaatttcaaggggtgctaacacctcccagcaggcctgcctttatcaacaaagaggttaagaacgtctctgtaaaaaaaataataataaaaaaaaaaaaacgtctctgtagacacggcctattaaacatattctgtgccaagtcctatatgaccacagggacacaatgaccaggacagttcctctccaagggatttttagatttgtgtggggaaaacctctatctatagtccaagtcacccagaaaacccaagagcatgcagtagccagttcttcagcatgaggagagtttacaagagtgctctacaagtgatatgtgaaccgaattctgaagaacaaacacgagttgtttttggatccgtgaacatgccaggtgttgttccaggccaacaccactatttgagaaaagatgcaaaggtgagataatcatcagggaagacggagagatgcagagatgaagccagagtaaggaaggactcttctacctcagaaaaggtgtttggtcttgttcatataaactattgggagccctgaagggttttatgcaggagaatgacatggtcagacttgactttctttggcagcagggaggcccgtggacttgaagggggaaggcccagggacagaggtcagctaaggggccacagcagtagattcagcaaatgaaggcaccagtaagacagatggctgtgccccagctgtgcgtgtttaccgatgggagccgggaaagaagtttctggctggacagctgagtaggcagagtcaaaaaggccagtgggaagcaacaggagttccgtctggactgcagtagtttgagcctgaacgaggccttccacactgcggtgtctagtgggcgcctggcttcgtgggatctagtgttccagggctagggctggaagttggtcactttgaggaactccccacaaaaaggggcgctgaagccccggtgttggggagatcaccaagaccacgtgagtcaaaagagggcaaaggcattgctcagacgatcctgagcatttcagtcggtggcaaggaaaccaccaagaagaaagctgggtgagagtagtcttggttttgttttttaagtcaacagtatgcatgcaacaggttgatcaagtaaggagggctgaagggctgcctgggtagctcaggtcatgatcccaaggtcttgggatggagccccaaggcgggctccctgctcgacggggggtctgcttctccctcagcctccctcttcctcccctctaccccctcttctttaataaatcttaatgaggactgaatggaagccaaaggctatgacaggacatccatgaccagagaaatgactataaaaacaaaaactagtaggttttatacctgggataatgaatacatgtttcacactagggacggaagtcagatgaagtgaagtgggagcggggaaatgaggaagtaacagctccacgactctgccaagtcactgctattaagaaacctctccggaataaataaatcttaaaagaaacctctccgggaagcttccctcagctccccaacaccaccaggtcccccaacagctccaggtcagctatcacactgcttcgccaggacttcacagctggtgccgcgtgcccttaggccacttagtgggaactctccaactgctctgcagttcaggaccaaagggggctccccgggtgcatcccagggtgcccagtactgtgctctgtatatgatgggtgcttcatgtgatttaggcaagatgctcttccctgaaagtacgcctgaaaagcatcatggaggtggttttcaagtcagtgctggcttttgtagatcattccagggaaatatatgctagctaggaaagggaaataccattcactgaatcctttttgaattcaagaaaaaaataccatgtggggttccacacagagccccaggaaagagtgaaacccaaacacacctcccaaggaaccaattcagagaaaaagcattaacagttgatggcagatattatgccatatacatgagctttgacattgcagcctgctatccagagcctgaatattaatcctgaaggaacccattcatagcttttcaaagtaattctaaaaagaaatgtacaggggcggggcagggggatgcctggctggctcagccggtagagcatgggacgcatgacctcagagtcggtattcaagccctgtgttgcgtgtggagcctactttgaaaaaatttaaaaagaaaaagaaacaggcaccgaagaaaatcctgatgtagccccaaatcaagaggaggctgaatgacatcagcattgtttcacttcagtatgcagtacggtccaagtcctatttcctgactccccctaagagagcagggggcagtactatccgtgaagaggaccaacgctgaaccagcggctcctaacatgtttcttgaaactcttaagttttgcaaagacaacagccattctggctgcattcggcttccttctgcctgcggttctgacccgggatggcctttgctcttctttcctctttctgaggctcctttccctagaccagagaaggggctgatgtggggccccagcaggtagacccaaagggcccaaaaggctctgccaaagtcccatcccaggagcctgtgagggtcctggtcgaccccaggtgggtaaacagctgtacggaagtccaacaactaacaggacttttgtcagcaggtgtccccttggccttgctgcagggggaggccccactgccccgcagccctgaaccaggcagaaagaacacatgcatggcgccaacagaagatggtctctttatacaaaccaactcagaaggctcatcctcggggaacaaaaaagcaggccccagcctccctgagacagaagagcgctttacttaaacatggtgatgaatagttccgatggtctgcagataaacgggctaaaagaagccacagcactctgcccctttcagttatgaaccatgctggctttaaaacacatcagattcacaccgtttcacacagtttattcagaagtttaaaatatgggcatcttcccctaaaacaaatcatcccctgccagtccccacacacagactatcaccactcctgctaacttctctttactgtgcttaccaaacatacttgcaaaacacctcgggatcaaaacctcagctatttggtaatacaacgaaatgacaaagttacacaaaagaatctcatttacttccttttcactagcagaccatgagtgaaagattaaagggcaaacattaccttcaaccaaagttaatgcttccctattactctctttctccttcctctaagacgttgaaactcaaagcagtttcatttactgtaactctgatatcccatttttcttttcagaatggctaagccaggacatacgttcctttcaagtcgatcttaacctcaagactggcagaaggcggactccctgttgtcgcttggccatgacgctttgccataggcaaaattaccacagaggtgcaaatgatgctttcagagttatcaaaaatcttaatgcattagtatggaacctccacatttttctgatgccacaaaattcctcttaaggtggtggcaggtgtgaaagaaaaggcactttgtgctaaaattcagagggtctcttgggagagtgccacagcagagaggaccggtcagcctgagcagcaggctgccctttaagttggagagaagcaccccccctgccctgccctggaaggcatctgcaaaggaaaaatcagtaatcatgattccaaggcaaaatggttacttaaattggagaggacaaatacaaatagagagagagagagagagagacaccaaacacagttgcaccaaggactgaggaggagcgagctttacagggccctgtaggccagctttcgccttctactgggctggctccttcacttcggaggaggttctggagaccgagcaggaacagcaccttggccaagagggttccaggcctcctgcctctgcctggactctccctgttgtgttcccaggaacaaaccgagttcctgctgacagcacttgtggctactgctggtccgcgacaacatccatcttaaggattttttgatccagccatgaagggacagtaagggttttccacatgatctgggactccttggcaaagcccagtggcttctgggtcttctgagagcgacgatggatcacgctaggatcccccaccaacactcagaaaagcagcatgagtgttttagatgggcaggagataaatcagtggactcagggtctttatcctagtaccataaataaagtgcaccatgaatggaggctgtgaggagccactcaccagaggccgaggtatgggagacactaccctcaccacccgctcagaggatggtggatcatttccttcagccagaacgctggctgctgaggctttcattattgctttatttccttagtactatggaacttttagctgtaaaggaaaaagaagtacttggtgggcttggcagaaagcaggtctgtcacaaaaatcacagaaattggctgatactcagttaagtgtatgttacaatcttaataatgtttgatgatggctgttttttttttttctccttcattctgaggaacttaggaaaacgagttttttaagaactctatcaaattggctcatgaggcttctgaagaagcggtacagatgtttatggccgacgtagtagaaatggttgtctttgttctgcaggtttccaatgctttatggaagagaatccacttactgtcacatttcaggagagtttaccatgacatactggcaggttccataaacttcttggaaactcttttcaaagaatgtgtaagaggaaaaccgcaacgttgtacaaagagctctgctccatttaggattctatttcgaggacactatttagctgctttcatgtaggaaggtattgccccccgagccgtcaggccctcaaagcgcttgtatgtgtaattgatgaagacccagtctttgttcttgtagtcagtctcagggtgattacttgtagctactgggaaagaaacagatgtgagagttgattcactgccttaccccgatggactgctcagtactgaggacaggacattctgaagaagatagcacagtctgtatttgggaaaaactgcttttcactctgcaaattttctacatttgcgtgtctatggtctttgaatctcccatttgtcacaaatattttaaaagttccattttcccatttctgtcatttcaggttacctaacccttaataaataaaacaaaagaacaaacctttgtgatttacccactccatttagcaggtaaacactgggagtccgtgggggcatttgggtggctcagttggttaagcgccgggctcttgattttggctcaggtgatgatctcagggtcacgagagccaatggagagcctgctggagatcctctctctccttctccccctgcccctccccccactcatgctcactctctaaaatcaattttaaagatcttaaaaaaataaattaataaataaggaaagagaccatgagagtttatattcattctccattcgacaaggggtcactgctacccagcgttagcaccacaaaaatacttacaaagaacccaaagaactaaagttcctctagctgacctgtgaatacaacccctaaactggcaggacgtaatgggcctataatgcagcaggaggcagtgttggcgatgttacctgttggcttaagaatatcagattctggaaattcatcgaagtttgaggtatcatcaatgcttttgatttcaatagatattgcagcaggtctctctctgccaagaacagacatgccaaaaattactatagttagtactcacatggctcacagctgatttttttctccaaaaagaaccctggcctgacacgggaagaccaccccactggcaggcagcatttcctttctctgaagagcttctgacaccaagcgaccacgccacttggccacatccaaatgagagaatataactaacaattatccagagctgggaagaaagacaaaacccatgaggagaaagtcaaatccaaggttaacgcactgcccttgtgtcctgcccagttgttaaaaggggaactaaacctccgggcgccctcttgcgcggggctctcactttccaccacaggtgttaacaaggagagggctaaaaatgtggcaaaagggaggtaaaggtaaaacttatgagagtgcaaaacagaacacaattatgaggagaggacaacgtccccaccttgtttgggaaccaccgaatgcctaggaagcagcgctgggccgggggcaagaggcggcgcgctggccacaccccgcagcccacaccggggccagttccttccttcctaccccggctccggtggccgacgctacagaggttggtgtgttctaggtaagagcaagggcaacacgcttaaagtgctgtcttcaccacggaactcaaatgtcccttcactttggaaataactgctggcttccccatgtccccgggcacatggccgacagcaagccctgactcctgagccccgccaagaatgaaaatcaagaaaggacgctcactgtctccgaagccctcttcccttacctggcttgccaatactggggcctctatattagtggtaagcaaattacaccctttcggaaataatcctgaaagcctttatgtggatatacctgatatgttcccagtcaacgccttcaaaaaaagaattacttttgatttcctcaactccaggggctccaattctatgttcccactcagagcagaatctggaaaagacagaggtctttcagcaaacctcaagtagtctctttagaagaagatatggaataacctaaacagaggaatgggagacagcagggggcagatccaggtaataatttaagtttaaaaaaaaaaaagaattttggcatgtcaaaaaacctgggtgaaaggcgggggagatgttctctaatacctcaaaataaggtccttggctttctcagagataggaacttctggaggaaaagtcagagtttctttccagttcatcaccttcttataggtctcttggggggtctcagaacagaaaggtgggtaccctgtaataagagagacacttcggagcttttactccccagaactttgaatctgagagtactctccttaataggattttatctttaaccctccatgacatgcacaggacttccactcattccagaaaacatctaaactgatttttcatttccccccaaacttctaagcccaaagtgaatttgtgcttctggtaccacaagagaagcagctaacagctgaagccgggaaaagaaaggaggacatacatagcatttcacaggtggaaatcaccacgcccaaagaagaaatgaaaagaaacaacatcattgaaaaatgactctgttccaggaatatccctatatgagtaaagtgccaaacaagctgaataagaaaaaagcctaggttttaaaggtgactaccatgcctctttttgagaactacagataaggggataagtactctcacaccacattactccacatgccctccacacagatctcatgcgcttccacaggcatccacccaatgttccggaagacaacacagccagaaaccattctagtcatccacagactcatgcactcggtactgccatggacatatttactctcctagtgctcttgggaatatggccacccacccctggagtgtcctctaaatacacagacacatcatccaaattagagggagagggagagagatcagaggggtccatgctttgaaggcttagagagaggaaggggacagcaaagaagtgaagagtatgtgaggcaatgcccaattaaagctctctgcaaataatgaatatttaagtgactgaaagagctgctagaaggagaggatgaaataggggaagaacaggataaatgatcagcaaagcaactacaggatgcaggaggccagagaacatagttggctctttgatggccaagagctttctgcttaggaaaattcacattgaaagacacaaggagaaaagtgcttagaccaccctcaactgaaatcatctattatcaatacgggactctcttctggttgcaccaaaatgtcctctgaaagcatgcaacttaccgatgagcatctcatacatgatcaccccaagcgaccaccaatcacagagcttgttgtacccggtctgcatgaacacttcaggagcaatgtagtcgggagtgcctactgtggagaaggcctgaaacatgtaccatacatcagggaggggggtggccacagccaggacggtgctcagagttctgttctagagacagaaagtttcaagcaccacctacggggacccacaaactaaccaagcagaatggatggccccagtagcccaatggcaagtctgatttgccagagcacttccaaaatgaacaataaagctttgtcagcaaggcaagagacccttcctaaatacacccaaagcccatggttgatcaggacaaaggtacccatctcaacaaccagcattgtgactgactgagcacccagtgagtgcgaggctccatatttcttacatgcttctgagcctatgtagtcctggcacaagtcagcaaaggactttattagcagataaaaaaaaaaaaaatctgacgcccaaaacagctttgttcataggctgagaactagttaagtggcagaggccagtttgaaaatgaaataccttgtctaaatcatccctctttctatcctaaatattccttaatttgataaaacctaaataaagggaagctttattattacaaggtagtagtatcctacagattagagatttatgtccatttaccaaacatattcatttatgtaaatagttcttacgggaatattttctaaactcaagtaatctactctcataatgaggactatgatactagggggatgtgcactcaaagccttccagtgtgctcagcatttgaggatttaccacatagaaggctctaatctaagtgcttttgacattacagaacttctaagatagaaaataacatgtgttgtcttttgaaaatatttattatggaatactgcaaagatacagaaaaaaaacaacagacaatacaacacacaacacctactgcccatattaaagagaagttaataatctcccatatttgtctcagatcaattgttttttaaaagacataaaactatagaaacgattaaaaccagatagcccttccctcttcccctactgaagtcaaaaccactctgaagttgctgtgccatgcttatatgcatatttgcataaataacataatatgatctcctgaatatttcaacttttaataaagggtttcctttggcacttcattagtctacaatgctacaacttgttttaacttaacattatgattttaagatttattcatgtagctctgattcacccatttcactactgcaaatgtattctgttatacaaatgtcacagtgttttttttatccattcttctattgcttccaatgtttcactatgacaacacccgaataaacattcctgtgacacctcctgggcagtacagcaagaatttctctaaaggaggagtatcactgggtcttgcattacaaacatcttctaatttaactagacatcttccaactgtcctccaaagtggttattacctattgcaacacccccaggggggatgagttcctgatgttccagatctcaccaacacttggctctgatagactcttttaaattttcgccaatctgatgaatatgaaatgggatgttttaatttgtatttcctttatttctagtaaggttgagtatatattcatctactaataagccattcaggtcttttgtctctgaattcccatttagatcctttgcccactcgtttttcagttgcattactttttttttttaattggttcgtaggaattctctatgaatccaggacattaattctttatagttttacatattggaaataacttatcccagtgtgaggattatcatttttattatgacctttaagtgatgtaatatttgttacataccaaaaagtgtgtaattatcaaattatgaagcataataataaaaatgaataaccacgagttcaactgaagaaatgaattattaccaatgtcattagaactaaacatgtactcctgtcccttccatcctcttacctctcctaacccctatggttcaattttgttatcattcctctgcttttaaaaagaaatttaattttgccccatatctgcctctaaatgagatcttggttttattctggggctttgtaaaaatggtatcacactacatcagtcttctgctgtttgatttttcttctccatgttttgctcctaaaattgatccatgatgtcacatgtagctagaattcattcattttcactgctgtaaaatattctatcccaaaatgtaaccactttcctgtcaatggggttctgacacggggttatttccagtttcttgctattaaaaaatgcaataaacgttcttatatatggctcctgctttacaagtgcaaatttctccagaccatatgaatagggaggggtagactccctgggttgcagggtatgcatatgaattgtaacataatcccaaaatagtgggaccatgtggcttattttttcatttgtttatgtctttcaatatactgaagggttctgtctttaaagtaaaatcaagttttcctttatgatctgtacttcttgtatcttaacaagaagttaaattttcctttaaaattaaaggattttttaaaatccttccttactccaagatcatgagcataccaccctatactttcctctaaaattttaaagttttattttccatctacaacttattgttatgtatactataaagtaggaattcatttgttccagatagaattgtatacggttttcttttaaatacatgtattaacaaatataaatgccagttgttgtttttaaagctttaaagtctgagacatggactgtggtctccccgagaagtattttcggtctaattataaaggttaagaaactacagaaacgcttccacttagaaactagatttattccagcaaaactgaatattaagtatatcttatttgtcaaaaaaaaattcttttttttttgttaaagaaatttctattacaaaaccagaaatgactggctcagtcggtagagcatgcaactcttaatcttggggctgtgagtttgagccccatactgggcatagaaatcactttaaaaaacaaaagtaaatatactagcactgtagccaaaggttaactctggcttactttaaaaaaagtgtaggggcagctcgggtggctcagcggtttagcgccgcctttggcccagggtgtgatcctggagacccgggctcgagtcccacgtcgggatccctgcatggggcctgcttctccctctgcctgtgtctctgcctctctctctctctctctctgtgtctctcatgaatgaataaataaaatctttttttttttaatttaaaaatcggaagatttttttacctttcattagcttccaaaacacaggtaaatatcagtttcccaataatgcagaagctattgagaaacagtctcttcagtggaggatcttaaccttcactgcacagtaaaatcaccaagagtcctctcaaaaaaccagatacccagattatataccccaatacaactcaatctatctctgggagtaggacccagccatcaataggttctaaagtcccccaggtcattctgatgtgcagccaaggttaagatctactactctatggagagacataatagaagcacctgaccaaatttgttcctgacatttcctaaccctcaacaagctatgtaaacagtttttcaaccacatacaagattcagactcttaaagagcatcagagttcctaaggaaaggagatcatgatgtgactgacataccaaccataagtatccccaagttaatgttaggacaagatctcaaagatgaatttcagttactacatctctagaagtgtttaagataatgcctctcccaggaccaaggttgaataaaaaaatcatcatattcaaaccatggtctggtctgaggcccaccaatgggcctcaaaaactgcaagcctttcttttgatgctttcttcaaacaaccctacaggcatccattttcactaggacggacaactacttaccagtgacttactaaatactacagagaactctaattcagtattttactaagaaggctgacccaaataagtatttggcaaacccgccaagttactactgtatacaccaaccaacaagcagaagtgccaccatttctagaggatacacgtgcatgaccatcattccaagttagtcatcattttccacagctgctatttttgctttctatgaccaactgttagtttagctttacgatcatttattccattcgctatgggcttctagcaaagtctaagtatgtggtgatacacacttctattatctctggtcaataactagacatttggacacaagattatacttcagatataatccaatgaatgagaataaaagtttgcctagacatcaatatttcactggtgactttgcatatttaaaatcacttccaacatatcatcaaggtaaatgcaataatgttacttatttttaagcttatagctcataattttgtgtatatatttatacagtaagttataagcactttccttaaatttctctccaatttttatcactaagttctcttttctaccacaaagtaggatggggcaggtgaactgaagagtcttcacttgcctaagtgaatcaaaattttaaaagtatgagaaccgcggccttaaagctctgggtaggtatctgtaacttagtttcattttgagagatctccaattcaaaaataacccctttacaacaccgtaaaaatagagaacagattgaataggaaggaatggggttgtcttgtaaaaggtcaggatgaggtcccccactaaaaatgtcacaaccaaaacaacctaaaattatcttcccttcatcaaaatactacctttggtgccactggcaacacgacagtgttctgtcaaggtaatcttaaaagcaaggaatagatatgctgtcaacatttattggatgcaaatttctgtgcctatttttaaaatttactcatactcagtttgcagcaatttaggaagccacagatattacttactagctgacgtctatttcttttccaggtttctgctttccttttggaattcatgttctggaaagctaaaagtagagagaacaagttctagtcaaagttcagacaggtatgtttaatattttttcaggctctgattcaagccacatgagacttcggtcttgcttttccagcttgtacatcagtaactctagatctaacacacctcccagcaagtctataaacccaaatcaaagtcactgaagcattagctcgaagaatcacacagtcacatgggtcatgcggccatagaggatacaggccttcatcagaattacaggaaatacagtttcatcagaagcgaaggtcccaaagtagacctaagatattcataatttctcaaaattaccatcaagtttccaagagtaataattagcatgtattcaaagacttctgaatttagaatacatttttggcataaccttctccaggatgaactgtaattgtactgcatagttttaatagtttaacggtgctggagtgaaaataacacttacaaagatcaatttctttctgccatgacagaaagaagcacctaggataaatctcatccagagctggtcccaggactttttcctctactgcttgcctgccccatatacatcccccccttctcagtagaggtccaaagaaggctcttcccaaaatccaccttaatatatccggcagcactcatcttgcctctccatacaataaaaaccacaggcacacctgggaagatactttcattctctagactcaggttgtgagaatctcctaatccgtcctggatattttggttacctggggaacagctcttctaggcccaggtaagggataaaaaggctaacaccactactgacacttactgaaatcactggggaggctgtggttcagattcctataaaattctgtcctatgtgctttcttcagtcctgtgcaaaggccgaagtcagaaagcttcacatggccctgtggggaagaaataaggtaacggaagatgaacattctcagatgtggaacagacgttatattttctggctcttcaaaatatctgtttctaattctcattctcatgtgatgtagattataagcaccgctgtgatagaggtacagaggatggtttcaacaaatgattgttaaataatgaataaatgaacaagtctttgttcatgtaacttttactcttgaattgtttcattaggctacagtccaaaggataaattattccaaaaacagagaatgaatgttattacatagttcctgacaaatgttgctatactatattttaatcataagtagacacttatgatttatcattctcttcaaggaacactcacacctcctctgagccaggcctcatgctttaaatgtatcatctcatttataactcttaagccgcacttcactgactcagacttgttaaatggcttactggtgaaatgggagaaccaaagccagaaatcaatccatgttccttctccccagaccaggattacctaccctctccaaccccctgatctcatctggaaaatggaaataaaggtatcttcctggtaggaatgatgagaattaatgcacataaagctccttacctagtgcacataaccagtcctgagaaagaggtaggtgtccttggagtagtgaaatttcaagtggataaggaaataaagccaaaattacgggagggaatcctgatgtgcagggatctacacactgctcaaggtcgtacaattagaagtggcatggcaagggttaagccccagtgatttcaacatctgtggtctttccaccaccttccttcagacatactttaacatacaaacttctcaggatacaaggaggcaacagaaaccctgccaggtggctcaagttttattttgaagaaatccccttaggtttggccttgtgtgtgttgcatacacgtgtatgcatgcacaataacgtaaactgccaaacgaagacagccttgagcttgctaacttggtaccacttgtttgagatctgcaaatatgttatacaagtcaagggctagagtttaatttatagttctcaaaactacattttacctagatacctctaagacaggaatggaaaaagcagtactggagcagatgctaatcaagcctaatttcagggaattttgtagcttttttaagtatgcagcaggaactcaaaacatccagtttcacttctagaatctgtatggctgaacacctaaatgagcttgttcgtgagaacatttttctacaagtttgggctagcatcttgtagagagcaaatgtgcacctacaagggttcctcactcctcagttatattgaagccccaatgtctttcccttcaatatgcttgctggacctcaacacagactacagggttcaactaagcctgcactaattcatttggatacaggaccaggggatctgaatccaaccacagaaagtagggccagtactctattaaaaatatatctgaacataatgacatagaagaaaaatctgaggggcgcctgggtggctgtcagttaagcatccaccttcagctccagtcatgatcccagggtcctagggtactgggattcagcccctaatcaggctctctgctcaatggggagcctgcttctccctctgctccttcccctgctcatactctctctctcaaataaatcaataaaatcttttttttttcaataaaatcttaaagaataatttatacacattaatatttttaaagtacttttaggatattaactgtatataaattacagacacaaacagaaaaggtactgaggcttttataccaaaacagtaattatctttgaatgatcagattataggtatttttcttctttataactcttggtactgtccaaattttctactatgtatatactcttaggacaaagaaaaaagctactaaccagaagcaattatttggtaaatctcctgccattttgaaatagaaagataaaaattttttaagataaaagttttttaaagaaagtataccaaaagttcaagtttttcaaagatcccaagaaaattatcaaaagacaggaagaggggcacctggctggctgagtcagtggagcatgtgactcttgatcttagagtcgtgagttcaagccccatactgggtgtagagatagataacataaataagtaaaacttttaaaaaaagatagataacataaataagtaaaacttttaaaaaaagaaaaatataagaatcacattcactgttctacttaaaagttcagtccagacaactgtgtaatagaacaaaacatcctaaaattttacagctggaaaagattttggagcttctatggaacaatatatccactttataaatacgtgagttctggacagtggggaagacgtgccaaggagcagccagcaatctagcagcacagcgattctcttctcatttgctatgagtttaagaactaagcgactgaactcatttgcatgtctgaagaacattacaaacagagcagtacagaggttaagcaggactcttctttacacagaggacaaaagatctggaacctgaactttgggagagacttttgttgtttttgtttgtcttacttcctggttcctagctggttcctcaactaataaggtttgccaacagaggggttcccaataggtgatgcatttgaatagttaattatatgctaggaaaagatgactatctttggctttatcataaaataagcttctaagtcaattttcctcttaatcatttttgaaaatgtcctttacttttaaaaagaatattcaatcaaattataaaatcatacgtatttcagagaaaggaagtaacagcaagcttactgcccacccacccccaccccaaaagtcagtgcccagcttccttactgtgattataaatggtacagttgtgaaagcagagactcctcagatgaggaaacacacatcaggcacgcttctcccctaccacagtaccttgctgtccaggagaaggttgtctggcttgatgtctctgtggatgaatccaagttggtgaatagagtctatggctaatactgtttctgctatataaaactgagtctcctcttctgtcagggtatcttttttcattaatagggtcatcatgtcccctgcaaacaagaagatataagacaccacacacacacacacacacacacacacatacacacacacacacacacacacacaatacataagtaagcgccagtttccagattggtcttccctatcagcctacataaggcagtaataaacaagcctcttttgtgttccagaaactgaccccacactgccaatatgggtggaaatggtaaacagtctctaagacttagacttaaaagtaaaattcacagccacggagagaaaaatgtttttaacctaacctgatgctgaccactgagcattgatttacattgtaatttagagagaaaaaggaaatccctttctctctctctctctctcacacacacacacacagacacacatacacgctcacacacacacacacacacacaatttgcttacagtaaatttttggagtgggaaaaaattactttacttttcattttgcctgccaacttctctataacccagaaccaaatggcatttccacacaggcagtactgccactattatagagagaggtcgaaatgccaaacaaaaactaaatatatgagaaagctgaaaacaaggtctccagtctctacttacaaaacacttgaacataaaaaggtgtgatttaggtagcagagtttaagtcaacaaaaggtaaaaaggaactgaaaatgctatgtactgagatatgtaatggctgcctccccaaagtgcaaagtgaacacctcccgagatcagtggagtttcttctccagagttttattataggtagttaaatatacaccgataggctttatgcaacttttatgacacagtatcagtattctatcaggtaaaaggtaaactccctagttttctgcaaagtcaaaatttaattatctctgcttaatatcagcaacataaaatggaaaaaaaaaaagattctgatcctaactcaatggttagacaaaaagcaaagcaaagaaaaaatatgtataagtagtttaaagctaagagaaacaggaaagattcagtttagattccatataaagccatttatggtcagaaaaaaggaaaagagaaagaaacctctgattttaatacagcatcatgccactttgtgaatttcatttataactttgggggaatttcatgtgttcttggaagagtggatattttatgctcaggcaaaaaattaaaccatttattaaaatgctctcttttttgacccaagacttgaaaaccaggataccctaatcactcctggcagctacctattcaatctggaggcacaacagagacatggtgcactcaggctagctttagggtagctatgtgaccttagtgctgtggcccaggagaatagccaatggcctcacctgtgcaagtttgcccagatgatcagagagctcaagtcagatggtctatggctctgcaggccagcttcaccaagtgcaaagggcagggtccaggagacatgagaagctatggaagatggtgtacttaaaagcttgaggagacatgtgtcaaggggctggtggctgagctgggttttattcctatttaagaactggcttctaaatgttcaaaagtttttcctcattctactacatagactcctaactttctttaattgttcattaaaaattgatgaccctagatctaattaaaggttctcacaggatcaaaatattatactacagttgcattttgctttgctatagaaccaaagagaaaaaaagttttcttttttggccaccagagtttgctcacagctcatcagctcactggcaaacagactgtcttccccagaatagatggtatgttctgttatgagtttactttggagcagtcttaggagatacacatgctgggttatataaaacttgaaatctcaaatatgagaaattgattctgactactaatataatgtaatgagagattcattcattaatagaagttacagaaaaagaacaaaaaagttgaagcaaaaaaagtaatagcttcaatttggtcacttgggtactgattatacatgattcccattgacaggagagcaagcagagtccctattgtattcctatattgaaaaagaaaaagaaaagaaagaaatgtccatctgaaatcatgagaatgaatgaggttacttttatggcactaagaattgtaggaaggcaccccagcacaagacaggttactgacctcctttacagacctaaaaaagatatagaaagcaactttgtgagcacgattaaaagtagaaaggagggttaattgacgtgagagagaaaccacagaacaaaaaggaaaaatgacctttcatcgtcaagtaattacctccaggcaggaactccatgattaggtagaggtttagcttatcctgaaaactatagaacattttcacaacccacaaactgtctgcctccactagaatgtcacgctccgcacgaatgtggccaacctggaggtatacgcatttgattaatgacaagccttgctctgctttattcgactgtatatttgtttaaacaatttaaatactgtttgagtattaaattgtgatgatgcaaaagaactaatttctgctcaggcaaacgtatgaactcaaaacagacaacatttgacttgaaggtattcagtcatgaacacctgagtgatgaaaggcttaaaaaaataacacaatgaatggctataatgcaaacggcaactttcacagtgctataaattgaacctctgattaattaaaactaccattctttgcacagctttttgttccaataatcttttatgacaaaaataaggccccgagatgagactctctaaataactaagtcctggctcgggtctgcgatgagatcagcaatgacaatgccctagttgacaattctagaatactattccacagcattcagttcactgctattcacagagttaagtgctcagttcttactgaattgtaatataaggatacctaagaaaagttactgattcaaatttctattgccagttttctgctcttactaaacttacctagctaaggagaccaagtcaccaaaggtttgggagaaccagcagaattacttcattaaaacaatgcttcattatcaaatttaccttatctactttaaatatgtaatagtaatcaaaacactgttgtgtgttatcaaatcccactccctctcctcttatgtgtcacaaaatgtaaaactgagttcaatcagatctatgtttattaagacccagtccaattcttgagtagagattttattcttaacatatgttgaagggcttgagttctactccatgttaggaggtgaagatttaccatagctcacaaactggcacttctgtggcaaactcagcccatggctgttgttttgtttgatacagtgttctatatgcttgttttattggaatgtctttagcaaagccaggcacttgctcctccagtaagacacagctctcattcctctctcccatcttacatggaacctgccccattcttcccgcgggcctcagagcacttgagtttacagatttcggtttcaaggctctactaatattgtttgggaactttttaaaaagcttcaaggtggcagaaaactttccttttgtacatctctatttagggtacaagggtggggaaatggaagaagggtggtaaggaacagtgctaggaaatcacaaagaagctgtgtaggagcagatgcttttcctcggctttcctacagaagcaaagcttgtggaaaacacaaatgtcacttgctcaactgcagctggggatatgcccctggcattagcagatgtgaagactgcgcaagtcaacctccacctgcctctgctctcctggctccagagaagagcttctacttggtgtagggagtcaaagaaaaagcaaggcacaaccactcccactcatcactcaccttggaagtgagtgaaacattcactgtttgtcaagcggaaagctataggcaacctgtgcacatcttgcccttctttcctggggctgaaacagcagctaggaacctcaagatccagatagtagtggagtcaggtaaatataggatcagggagggaagaaccagaggtgcaattcacatcagagattccttttccttgttccataaatatttaatggagtggacagttacatgctagttgctatcctaaacactaaaagaaaagagcagagataagtctatcttttgttccatcctaatactatactggcatcacaactggaggttttccttttgcaatgtaagagacacatgaaaaaactaagtgctggtctcttatcctttaaaattttccagatagcaaaatttctatcctaaggatgagaataacaacctgaactctcagcgagtagctttaattcctattcagtttagtaaaagcaaacaaaaaacttttcctatggataaggtactctacctaacaaaaagttaggctctgaatctaaattttgtcagccctacccaaaagtaatggatttgcactggttggtctacctcccctcacaccctagcacaaactatgcttcttcaagatggctgatccaggccatgtctacagccagaaactttaactagaccacactgagactcaacccagggagcagagtccagcagcaaggtgagctaacaattcagttaatgcactgtttaaaaaccctaattttgggcagccctggtggcgcagcggtttagtgccgcctgcagcccagggcatgatcctggagaccttggatcgagtcccacgtcaggctctctgcatggagcctgcttctccctctgcctgtgtctctgcctctctctctctctctctctctctctctgcatctctatgaataaataaaatctttaaaaaataaaaaataaaaataaaaaccctaattttcacaaagtccctctactctcatgtaggaaaactttcgaaaatgatttttgaagaaagtacaacttgaaaaaatattttacaccatatgtttggatcaccatctgtgactatgctgggcaactggcacgaactatgaaggatcaataagtgaaagtcatcatgcacacttctttttacaatttgattctgaacactctttgataaagaaacatttcgagcgttggttaaaactacaggaaataggtcttgtaaaaataaagcttacttgtgaaatacaaagtatagtgactaatccataccgttgtacttttccctttccaagactgaaactctttcagtgcctatacccatagtgcacactaatttttagataatacacaaacagggctcttgagcattctgaatgaggttggtattagcataagctatggtgtctgaaggttcactgccagagtatttgatactctcaatcaaaattcccatgagtcgggatccctgggtggcgcagcggtttagcatctgcctttggcccagggcgcgatcctggagacccaggatcgaatcccacgtcaggctcccggtgcatggggcctgcttctccctctgcctgtgtctctgcctctctctctctctctctctctctctctctgtgactatcataaaaaaaataaaaaaaaataaaaaaaaaaataaccatgagtctaagcttatggataatacatgaaaattaaagagaaaataaaaactccaaatggtgactggcacttaaaagaagggcagagaagccttagtgattatgcctcctttcatgaggcagaaagggattgggcgtggggctggtctccattcctgctcttacactctatacccagagctctccttgccacagtctctctgttctctcctagggcatctgatcctttacaggacctatgcaggcatcacccactacaatctattcttaagcaaactgctgatgatattagatttacagaaaggctgcatttttgtttttaacatactgtccaatatttaacattttattttgcataaagtatttctgcatcttttaaatctaaatgcaaagtaggtttaggttttagaaagcgttcttactccttaaaggagaatttgcactgctctgccgtttgcattaggttttttcaaattcactcagaatgaagactggtctcctctcttgggtaataatgagcgggtctcctctcttgggtaataatgagtgggtcagaagacccaactttggttcgagtgtacagaatgaagcgtattaagacacattttagattgctaattcctaagtctcagttccaaggtatatatatacaatttctctcagcattcagtaggaacacggtaccacagcaagggtgacctcaaaaacaggctcctcatgacaaccacagcttgtgatcaaatgggagacacgaacagcagatgcttctaataggtttacaacgtttaaaagaccatacaacataaggcattagttgtactaatgtaactgcttcttcgttggggaaagaaaagtaattatatgtacattcatacatgaatcagtgctaaagaaaactgtaataaaatacatttcaaataaacaaaaagaacagttttacatgacacaaaatttatcagctgactaaaatcactcctacaattgtggtttacctgctctttttcaagcatatctgctttacggagtattttcattgcatacacatgccctgtatctttcttctgaacaagccgcacctaaaagttataaaagaaatgtcaagtcaaaagttcacaatgccatgctaacgctttcatgtgttttaagaaataatttaaactgaaaaagtattacactattaatacaagcaaccagcaataacaaagcagaaaaaagcgcttttttaatgttccagaatggatatatttattaatatcatgaagtcagccctgaaaacattctcaaacatctccacatctgaacaggtttcactccttcgttgaataaatccatctaatttaaaaccctcactttcaaatttaaggattcattatacccatgccacatatccatccagtcagctcagaaaacctaaggaatcaattacaacaatgtttaaaacaacagcaaaagcttatgggtagaaaaaacatcaagaaggaaaaaacctaaaaggtataattagggaaatggagttttatgcagttttcctttttctttatcttccaatgtttttagaaagaacagataattttatgatgaaaagaaaactaatggtctatcaacccaaagacaaatctcttggcaagtccccacacatcctccccctaccctcataagatatgtatgctttctcccccctgtacctttcttcctgtttttcctgagtctgatgtcccttcctcactaaacagtccttccagagggagtaccgtacctttccctctccccaggagccaacagggattctgaacactgagggatcaatttaattttttgacttgtgcttctcagtaggtactcacatttcccctaggtatgggtttttaataatatgctactccttttatacaaagttaatgaaactattgcatcagtaagtagtccactttgggtgtttaccattaacaatgatgacctcacatgggctcattcaaaccctccccaccagactgcccttatgacctagcaggatgcatctacgagaccaggtaggacaaagctgcagatgctttcagctctctaccactatctgcataacctatttctataaattctgtctcctggaactattttcagagcaatagcaatctgggggaagaaatgaagggtacagatatgctgttagtttgctcttagagaggcagtgtgatgctgggaaaagcaagagcttatgtaagatcaggaactcctttaagatacaaaaagaatgggtcaaggaggaaaaagagagagacaaaccaagaaacagactctcaactacagagaataaactgatggttaccataggggaggtgagcaggaggatgggtgaaataggtaatggggattaaggagagcactttgtcatcatgagcactgggtgattaaaaactttaagaaagggatgcctgagtggctcagtggttgagtatctgcctctggctcaggctgtgatcccagggtcctggaatcaagtcccatatcgggctccccgtggggagcctctgcctgtgtctctgcctctctctgtgtgtgtctcacatgaataaataaataaaatcttaaaaaaagaaaaaaaaaaaaactttaagaaaaattcaggaattcctgggcccaacttctggggctgctgctcaatggccatgtgacaacagaacattatatatcccccttgagtcttaatttcatcatccataaaatgagttcttgtaggagagaagcactcagtaaataataaatattgatttccttctacctttcaactctccctctagatcaatacttagaacatcaacatcatctctggcaaaacagaagaataatcagagatctgggacaggggagggagaaagaaagaaaggacagagagagcagttaaaatgtggggctggcatgcctgacctatctaccccatatttcagttctattaacaatcatgaatcatgaatatgtcagcagcttcaaagttctgtggtgtttttatatctgataagtagctgtgtttttttttacctcaccaaatgctcctctgcctatcacttttaaggactcaaaatcttccaatccaagtcttgttctcttcaaacgaagaaactctgtttccttccgagcatgcgcggatctcctcagtcgtttctaatgtttaaataaagggaaagagaggtgggaaggggaggaactaaaacactgcaactccttaacagtcttatttgtgattggaaagcagggccacacagactaagcacaaccttctcacacgtgaagaacccttaagaagggttcttaagaggaacagaagaacccttaagaggtcaaatctcccctccccagcatttggacacaataaccaaaccatagagaacagatgggtgcctgcctcctctgaggactctaccaactttggcaatcaactatttgaacttttctaatgaaggaagaataaacaatcaatgttttcctttaatttctgcatataaaataaaagggtatgagcttttttaaatttccttctgggtttgttggggttttttgggttttcctggattctatgattcattcctatttttcttttcattcctatttttgaaagcatttccactctcatttcagttctttgcacagtttaactgtattttttcctactgcatctgtaggcattgggggaagagctgatttgatattttgccttgataatgatttcagaaattggcactacttcttaaagactttcccatgatttctgtaaatatgctataatttgcttttttaaattttaatgtgatctcatctctttcttagaattctaaatctagttaatttactataattgtgcctagataaatattcttctccctggtacttagtaattaatttctccctttgcataaatacctaaatccagaagtacaccagctctcataagttcttctgttactaagccaagaccctttccctatgctccaaggctaacaacttgctgggcaagatctgccatgctgggttcaaggaaaaatttcccaatatgaattacctcttcatcttttaggccttcttcttccatcactttttctaacttcttttgtctaaaaataaataaagatatttgaaataactgaatacttttctgaaaagtctatataaacatagtatctttttaatgatataaacaggtaaatctcaaaatgcctcattaaaacaattacagggctgcctgggtggtgaagtctgttgggttaccaactcttggtttcagctcaggtcatgatctcagagttgtgagacagagccccacatcaggctccaccctcagcaaggaatctgtttataaagattctctgtctccctctcccctgcccctctgccccagccacccccaactcccccctgccctctctacttatgcatacacaccctctctctcaaaaataaatcaatctttaaaaaaaaaaaaattacagttactaagacaactaaaaagatccccaccctttgttagttctacattttgaaaaagactatataagacattaatgcaacaaagaatcctatttcaatatgaaaagttctctctcttttttaaaagtatttcctccttagcaaaccacaaacagctggtgtttgataacctcttctatcaggatgtctctctgtccctgactgaaatctacttcctttatttttacatcttcctccccctccgtacacaagcaaagagtgataaacaatagtaaaggcagaatttagagattcaaggggggaggggggggcaggaatgattaaaacaggcaactggcaccactgttaaaatgtaaggctctaaatccgtagagtattaaactttaaaaactgcatccacgaatatttttttaaagattttatttatttattcatagaaacacagagagagaatgagaggcagagacacaggcagagggaaaagcaggctccatgcagggagcccgaagcgtgactcgatccagggtctccgggatcacgccttgggctgcagggggcgttaaactgctgaaccaccggggctgccccaggaatattttttttaaagattttatttatttattcatgagaaacaaagggggggttgggggggggggcagagacacaggcagagggagaagcaggctccatgcagggagcccaacgtgggactcaatccggggtctccaggatcacgccctgggccaaaggcaggtgctaaactgctgagccacccaggaatccccatccatgaatatttttgatctatagtctcatactgacttgataaaactcaaagacacaagaaaaacttccttataactgattccacctgtatttatttagcataataaacgaaagcatattgactgggatctctatcccttatcagcattccagataacaggcaatgtggacagagcagggaagaatgtaagtaggaaatatagggtgctggggtgccgcagccagttgagcgcccgactcttggttttcagctggggttgtgacctcaaggtcattggatcaggccaagtcaggctccagctaggcacagagtctgcttaagacttgctctccctctccctccccacaatctgtgggcatgcacattgttactctctcaaatacataaataaatcttaaaaaaaaaaaaaaaaaaaaaagaaaagaaagtaggaaatacatgaagcaacagcctgtagtctaatgtggcagaggcacacagcacttcaaatgtcacactaagagggctggctcggtctgtagacaactaagggctacagaccgagccaggggttggtgtgtaaaggagtgatgtgatgagatttctgttttaaaatgacagccagcagtaaggagctgatggattggctgggaaagcaacaaacaaagactaaggcaaattgaaagctctcctaatgattcttcagagtcaagatctggaccaagagctggaaacccagaatgaagtaaagggggttactacaaagatgactaactggtagtaggagtcaaaggaaaaatcttagactttctcatgggcggggggataatgatgccaccaaccaagacaggaaacacagagaaaggaccatgaaaggtaatggaattaattttggtcaatatataattattgcaataatagtaattaaaatttgtattgtgttagaaatcatattacaaatccacaggatcatggggatccctgggtggctcaggctccctgcttggagcctgcttctccctctgcctatgtctctgtcttctctctctctgtgtgtgtgtctctcatgaataaataaataaaatctttaaataacaaaaaacaaaaaaaccctacatggttcccagtctgcctacttcacttctctgagttcccacaatattttatgatacacatctttgtctgcatgcgagctaaaaggataaggctatactgctggtacattcaagagtatcaattaattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaagggtgaaagggagaaaggcagatagggagaaagggagaaagggagatagggagacagcgagatagggagaaagggagaaagggagaaagggagaaagggagaaagggagaaagggagaaagggagaaagggagaaagggagaaagggagaaagggagaaagggagaaagggagaaagggagaaagggagaaagggagaaagggagaaagggagaaagggagaaagggagaaagggagaaagggagaaagggagaaagggagaaagggagaaagggagaaagagagaaagaaagaaagaaagaaagaaagaaagaaagaaagaaagaaagaaagaaagaaagaaagaaagaaaacatcatggcaagaactataactccaccatggtcagctctttttgtgccttgaatatcaaacaccatcatactttctgactatattttttttttgaatgaccataccagagtgggaagtccaatatgctatcatacaaagtatgacccagagacagttgcttctgactatatttaaatcttaattcaaactaagaagttttccgtagcttgagtatacttgcaagagtaattaaatgggttctgtagaatacctacctgagggtaaagttattagaatcaactccttgaacacaatcagattctttcattagaaaaagtatccagaaaaagcctatcatgcagaattctccatggtaataatttattgggcccaagccaatgaagaccttaaagacccccaaaatggcaagcataacctaaaatgaggcttactagtgacatcctctatgagatgacatgaagaaattactgttaactttgttagattcatggtggcactgcaatgacacaagtaaatggcctatttttagagatgtacactgaaatacataggattgaaatcataaatgcttgggcagccccggtggctcagcagtttggcgctgcctttggcctggggtgtgatcctggagactgggatcgagtcccgcgtcgggctccctgcgtggagcctgcttcttcctctgcctgtatctctgcctctctctctctctcgctctctgtcccaaataaataaataaataaataaataaataaataaataaataaataaataattttaaaaaaagaaatcataaatgtttgaaatttgctttaaaacacacagcaagaaaaaataaaatggaacagatgaaacaaatttagcaaaatcttgataattactgaatctgagggatgaatatacaggggttcattgtattaatctttctatgtgtgtgtttaaaagtgttcataacaaaaaagaaaagcaggcccctccactggtatgtctctgattgaagagccagtttagctaacactccaagctttggtgaagtcactcttgcactcaactgcaatgatccagagcagaaccccgggaaagagattggccactttcacacttacaggccacactcaacctaactccatcatggccttccatgaactccatttacttgcatgtgagcccacctctcatgagacagtaagttcttttgaagggatggcccatatctgaatccttcttttccactaatagtgctttgtacacaccaactttataaaatttatgtttccaaatggtgagaaaaagaaaatcagagtatgtaatgatgtgcagacacattcatgactatgtgtaattagctccctctgctaagatttcagttcacctcacagcacatcttgattcagaggttccagggataggagaaaagggctagtccattctatgagagttgaccagacaatatttctaatttctgttgatgagacatttgaaaatccagtaaaaatagtatagaaataagcactagttgttatttctatgattaaaattgaaaatattctcaagaaataccctaaaaataaatattacacagattttttaaaaatctcaacaaattggggtgctggggtggtacagtaggttaagtgtatgactcttggttttggctcaggccatgacctcaaggccctgagatcgagccccaggtcagctccatgctcagcactgagtctgctatccctctttctctgcccctccctggtgtgtgctcaaaataaataaataaatacatacatacatacatacatacaactcaacaaattactttggtttgactgatacatctaatcagtgaacaacattcaaaggtcaagacttactcatccctaggacttagataaaactgacacttgtaggcacctaggtggctcagtctattaagtgtccaccttcagctcaggtcatgatcccagagtcctgggatggaggcccacttcaggctccctgctcaggaagtctgcttctccctctccctctgcctttccccctgctccttccctctcaaataaataaataaaatcttaaaaaaccaaaaacccccaaaaaactgacagttgctcactaaataatcacatattgcaactccgtatcagatcagaccaaatacacaggaaaacctgggtaagaatgaatatctaaaaggagtagcagacagtgctggttctcaaagggtaaaatgtagaaaagttcttatttgatttaggggcggaaggtgagggaagcataccattacttcctattaaattgggtttttgggatccctgggtggcgcagcagtttggcgcctgcctttggcccagggcgcgatcctggagacccgggatcgaatcccacgtcaggctcccggtgcatggagcctgcttctccctctgcctgtgtctctgcctctctctctctctgtgactatcataagtaaataaataaaaattaaaaaaaaaaattttttttaaaattgggtttttgtggccttaattaatccaccaaaacagtatttatgaaaaacagaaacaacacagaatatttaataagaaaaaatgccagcttcctcagttttgatttcaggctgctataatcatattttttatatgaaaaactaggcaattatcaatatttactgggtacttagggtcacatgagagaatagaaggagaactgctattcttagataaccttaccatcagaggcaaaacaaagattaaaatagtatgtatacaaaaaaaaatagtatgtatacaaaaaaaatagtatgtatacaaattatatacatatatatatatacacacacacacacacacacatatatatatataaagaagataaacttgcattcttgaggggattcagcttatagcctaccagtagcattaacaggagaccatcagacaccagactcagggggtttaattgtttttaaatccattagtagaacttgctgtaatgtttccaatcccagccaatgttctcacattttacttttatacagaaaaccaatcctaaatgatttttattctttcttctacctctaggttttggtttcatctcccctgccgttaggtactttgtttcaaatataacctactgctctactacacatggaacaatgcaaaagtgcatgtatgtggcagaaatactagagattttaaaggcatccaagggaggaacaaaatgaaaatttgttacaatctgatctcaaaatttactagcaatacttatttcaaaccactcatcatcacatattagtgatatactcataataaaagtttctttaaaaaaaataaataagggatccctgggtgacgcagcggtttagcgcctgcctttggcccagggcaccatcctggagacccgggatcaaatcccacgtcgggctcccggtgcatggagcctgtttctccctctgcctatgtctctgcctctctctctctctgtgactatcataaataaataaaaatttttaaaaatatataaataaacaaataaataaataaaagtttctttatcaatgagtgtctcatatcacttaaactctgcttatttctcaaggttctatgacatttccacccataacatcaaaaagcctgaaaatccatttctgatagggtttttgttgttgttgtttccaagtaggctccacacccagcatggagtccagtctgaggcttgaactcacaaccttgggatcaagacctgagttgaaatcagaagtcagacacaactgactaagaaactcagttccccatctgacagtccttttttttttttttaagattttattcatttattcatgagagacaaagaggcagagacaccggcagaggaagaagcaggctccctgactcgatcccaggacccaggattcacgatctgagccaaaggcaaatgctgaaccactgagccatccaggtgcaccccccatctgacagttctttttttttttttttttccatctgacagttctaaatgtagttctaaatgtggtagtaactcctgccaatcgctgttttccttttttaatttttaaaatttctagcaataaaacctaaatagtcttatcaattggtataacaaacccacaacaaagatcaactcatttcccaaaaagggggcaccaaaaaaagggggcactaaatgaaaaagattagcaaggatatctgagaccttcaacgtatttactacttttttttaatgaaaaataatgatttgataacaaaaattaccaaaaacattctaatcctcttaaatgtttaatattcccttcttacgatcttttaattaatttggtctttaagaaaagcaaaaccaggggctcctggatggctcagtcaaccagttaagtgtctacctttggttcagatcatgatctcagggtcctaggatcaagcccccacattggactccctgctcagtggggagtctgcttcttcctctccctctacccctccctactgtcccgtctctaataaataaattaaatctttaagaaaaatgagtatgacctgattgtttacacagaaaatcctaaggaatctacaaaaaagctagtagaataagtaaattagcaagttgtaggatataaagtcaatatacaaaattcaattatatttctatatgctagcagcaaataattggaaaaaattttttaaacatccaattaacagctcaaaaaaaactccaaaatactagtaacagatgaacaaaataacacgtaagatccccacagtaaacactacaaaacactgctgagaaaaattaaagacctaagagaatagagagatacaccatgttcatgcatcagaagattcaatactgatgtcaattctcccccaaactaatctacagactcaatacaattataatcataattccatcaagcttttctctagaaattgacaatcagattctaaaatgtatgtgaggaacggctgggtggctcagtggttgaaagtttgccttcggctcaggacgtgatcccagagttttgggatcaagtcctgcactgggctcctgcagggaggctgttcctcctccctctgcctatgtctctgtgtctctcattaataaataaataaaaccttaaaatacaatacaataaaatgaaattatatgaaaattcaaagaacctaaaatatccaaaacaatcttagggggaaaagaaaacaaaacaatgtagttgaagatttacactacatgacttcaaaacttaccacaatgctacagtaaccaagtcagtatgataccggcagaaggacaaatgatcaatgaaagacagtagaaaaccatattagggttcaatttctggttcagttggtagagcatgtgactcttgatctagagtcatctagatctagtgttctcatctcatacacttattaactcaagatggatcatagaattaaatgtaaaaactaaattataaaagtttccagggatccctgggtggcgcagcggtttagcacctgcctttggcccagggcgtgatcctggagacccggaatcgaatcccatgtcgggctccccgtgcatggagcctgcttctctctctgcctatgtctctgcctctctctctctctctctccccctgtgactatcataaataaataaaaattaaaaaaaaaaaaaaaaaaagtttccaaagggcagccctggtggttcagtggtttagcgccgccttcagcccaggatgtgatcctggagaccagggatcgagtcccgcgtcaggctccctgcatggagcctgcttctccctctgcttctccctctgcctgtgtctctgcctctctctgtgtgtctctcatgaataaataaataaaatctttaaaaataaaataaaataaaaaaataaaagtttccaaagaagatacagaatatctttatgacttggggggcagcaaaggtttcttagaggtcacagaatgcaagaactataaaagaaaaaaatgtcaaattagagttcatcaaaatttaaaacttctgctcatctaaagacaacaaacaggagggaacctgggtggctcagtcggttaagcatctgccttcggctaaggtcataatcccgaggtgctggcatcaagtcccacattgggctctcttctctgcagtgagtctgtttctccctctgcccctctccctactcgttctctctctccctctctctcaaataagtctttaaaaaaaagaaaagaaacaggaggggcacctgggtggcacagttaggcctctcttgattttgctcaggtcatgatctcagggtcatgagatcaagcactgcattgggctgtgagctcagcaagggatctgctgtagattctttcccctcccactccctttccctttgcttctccccccagctctcatgagtgtgtgcacatacacactctctctctcaaataaataaatgaataaaatcttaagaggaaaaaaaggctgacattttgttagcaaaaatgtaaagcaactggaactctcacacattgttgttaatattttagaaaaaaaatctagcagtttttcataaaactaaatatatacttatgtatatttatgatccagcaattccactctgaaatatttacccaagaattgaaaacacatgttcacaaaaagatctgtacacaaatgtcagtagaaacttattcaaaacagccaaaaactggggatccctgggtggctcagcggtttggcacctgcctttggcccagggcgcgatcctggagttccgggattgagtcccgcattgggctcccggcatggagcctgcttctccctctgcctgtgtctctgcctctctctctctctctgtgtttatcggaaataaataaatctttatttattattttttaatttttatttatttatgacagtcacacagagagagagagaganacatatgcagagggagaagcaggctccatgcccctggagcccgacgtgggattcgattctgggtctccaggatcgcgccctgggacaaagtcaggcgttaaaccgctgtgccacccagggatccctaaataaatcttttaaaaaaaaaaaaaaaaaacagccaaaaactgagaaaagcccagatgtttattaacagaagaatgtaaaaacagaggtatagtcagaaaacagaatggtactcagccaatacaaaggaacaaactactgatacaagagcaacatggatgaaccttgaaaacattaggatgagtgaaagatgccttactcaaacgagtacttactatatgaatccatttacatgctccatttgcatggaaccagcaagagtaatctaatatagaaacaaaattacaacagtggttgcctggggttgaaggaacatctccaagaataaaagaactttctgggacgatggtaccattctgtcttgataggactaagttctacaggtatttccatttgtcaaaacttgctgaatggtacccttagattgtgcattttggttggaatcccaacgtgggtatagagattacttaaaaagacagaaaaaaacaatgactgtgcatttcattgtatgcaaaatttacactctcttaaatatatacgtatatataaatattgaacttgttatataagcagacatcatattcagaagtaaaacatactgacatctccatcataatttgaagtatagcaaaaaatcaagatggtttaatgaatgaatagagggatggatagatgaatatgtaataaaatgaatgataaacgtagaatcttgatgtatataagggtattcagtatattattccttcaacttttctgcacttttaaatattttcataataaaatgctgggaataaaattttaattacaagttaccacatgaatactctacaccagatcaataacaacaggtgccaagtgattaagtgattactacgtgagaagcactatggtggttactcacatatgttatatataatccccatagcaatcctgcaaagcaagtattatctccactttccagatagggaactgatacacaaaaagactaagaaacttattccagactcagacagctaataaatggtaaaagcatgactctatacgcagctctgattccgtaagggctgctctttccgttacatcatactgttttaacaataaatccaaggatttgacccaattaatatttttatactatggaattctgcattgttctttttcctaagagtttaagtaatctctgcacccaatgtgagctcaagctcacaaccacaagatcaagagtcacatgctctaccaactgagtcagccaggtgtccctgtgttatgactagtagtaaaaatgagtgggttaaatagcaagggttttggaaatcaatgaccctgtccttccactgtaatgggatagctactgcatggctgctgctattcttatctcctttcaacaatattatgaatgtgttttatgatactagacatgaatgccaaaaccatgacacaattttctcaaacacagttctttacctcatttctcgttcttcatgttgagcgataaggttgctataaaaattctccagtgtcactttggtcatggtcactctttcctttgtgtgattactcatggaggaacaaggtgttgagcctgtcattgccatggctgctagaaacaaaaaaagaagaggtattagttttggattagaacccaccaactagggatccctgggtggcgcagcggtttggcgcctgcctttggcccagggcgcgatcctggagaccccggatcgaatcccatgtcgggttcccggtgcatggagcctgcttctccctctgcctgtgtctctgcctctctctctctctctctctctctctctctctctgtgactatcataaataaataaagaaaaaattaaaaaaaaaaaaaaaaaaagaacccaccaactagggcagcccaggtggctcagcggtttagcgccgccttcagcccagggtgtgatcctggcgacccaggactgagtcccccatcggctccctccatggagactgcttctgcctgtgcccctctctctctctctctctcatgaataagtgaataaaatcttttttttttttaagattttatttatttactcatgagagacacagacacagagagagaggcagagacacaggcagagggagaagcaggctccatgcncaagatcgcgccctgggccaaaggcaggcgctaaaccgctgtgccacccaggctgcccaagtgaataaaatctttaaaaaaaaaaaaaaaaaaaaaaagggatccctgggtggcacagcggtttagcgcctgcctttggcccagggcgcgatcctggagacccaggatcgagtcccacgtcgggctcccggtgcatggagcctgcttctccctctgcctgtgtctctgcctgtgtctttctctctctctctgtgttgtgtgtgactatcataaataaataaaaattaaaaaaaaaaaaaaaaaaaaagaacccaccaactatgtactctcttactccactggtaggaaagtaaatttgtttaagttttctggaggacaaacatataatatataacaaaagccaaagagaatatttggtgaaaataagtatatattaatgtcctatgacccagaaataccattgctaggtataagacctaaagaaattgtcacacgggctcttatgaaatgcataaagggggtgcgtgggtggttcagtcagttaagcgtctatcctttggttcaggtcatgataccacggtcctgagatggcgccccacattgggctccctgctccctgctctccttctccttctgcccttccccctgcttgctctctctctcatgctctttgtgtttctctctctcaaataaataaataaaatcttttaaaaattaaaaaaagaaagaaatgcacaaggatgtatataatacacaatgtttattatgccctcatttgtgttataggaagttgaagccaattcagtaaggaaataaagaaaatgttgtggatgcacataaagaaataacatgcagcagtcagaagcaaatctatctgtacctaaaagtgacatgaatatatctttaaaacatatgctataactttaaaaaggaagagaacaagatcacaataccataaatgtatactaagaatatataatatagacacagaataaaactttgccatccaagaatctaccttgaagaaataaaatctttaaaaaaaatttttttaaataaaataaaatatgtatcaaatgtgactaatggtttaactttaggcagtaagaatgccattcttttgtggcataaagatcatttatgtgggcttttccatattttatatattttcttaaatgagcatgtactattgctactaaattaccaataatttttaaagatttttttaaaaaagatttatttatttatgagagatacagagagagggagatgcagagacatgggcagagggagaagcaagctccatgcagggagcccgatgtgggactcgataccagatcctgggattacaccctgagccagaggcagacactcaaccgctggagtcactcaggtgtccctaaagattttatttttaagtaatctttccacccaacgtggggctcaaacttacaacccaagatcaagagttgcatgctctactgactaagccagccaggtgccccaaattatcaataatttttaaatttataaactttctacagttaaaaatctataacaaatgctcatctacaggggcacctgggtggctcagtggttgagcatctaccttctgcccaggtcatgatcccagggtcctgagattgagtcccacatcgggctcctcacagggagcctgcttctccctctgcctatgtctctgcctctctctgtgtctctcatgaataaataaaatcttaaaaaaggacagcctgggtggctcagtggtttagcaccgccttcagcccagggcgtgatcctggagacccaggatcaagtcccaggtcgggctccctgcatagagtctgattctccctctgcctgtatctctgtctctctctctgttcctcatgaataaataaataaaatcttttttaaaaaaaatcttaagaaaaaataaaataaaatgcttatctgcaggtatagatgtactctgacatgtcttatagtatttgataaatgcatgctatttggatttataaattaaattaaaacctatgataaaaacaatgttacaaagaaaaaacctgaatcataattttagctataaaagatagattaaaaacaagaaaccctaacttcttaatttacatatgagaaaactgataccaacacggtttaaacaacttacagaacatttttccctaaatttatttattttaaaagattttatttatttattcacaagagacacagagagagagaagcagagacacaggcagaggaagaagcaggctccatgcgaggatcccgacgtgggactcgatcccaggattccaggattccagggtcacgccctgggccaaaggcaggctctaaaccgatgagccacccagagatcccccattttttccctaaatttaaatctcattttccccagcccatactgtcacagttggccaaaccattcaccactctggacttgctccagggttgagaataatgctagatattttaaccttatcatgccttcctccaatatgacctgtttctaagtttgtcctttcatcccaatatgaagctgagtaaaaatcagaagcgaccaagggccattttcaaaagtacatttgggacgcctaggtggctcagcggttgagcatctgcctgctttagctcagggcgtgatcccggagtccctggaacttgtcccgtagcaggttctttgcagggagcctgcatctccctctgcctacttctttgcctttctctctgtgtctctcatgaataaacaaagtcggaagaaaagaaagaaagaaaaaaagaaagagaagagaagagaagagaagagaagagaagagaagagaagagaaatataacaattttttttaaaaagtacactttatggaaagtttccttaaggttcttcccttaatacttagcagcttcgggcagcccgggtggctcagcagtttagcgccgccttcagccccaggcgtgatcttggagatgcgggatccccacattatgagtcccacattgggctccctgcaggaagcctgcttctctctctgcctgtgtctctgcctctctttctctttctctgtgtctctcataaataaataaaatcttaaaaaaaaaaaaatacttagcagcttcttagattaaggctatttaggagtgtgcacttattattactaagacaaaaggcttaacataaaagatattcaggcaaaagtcacgtaaaagaataatcctttcagagcaaagagattcaagatcaaggctctacttcaaacatttttattcatgatgtgccaaaatgattagtaatcacaaattcaagaaagtgaactcagctctaccttacaatgttattcgttactgttactttttatgggcggtttctgctaatagcaacagctaacccaaatatttttaggataacagtagaattttttaaaaacctctggtttatgaagcttgggtgtggttccttatttgtcagcctgtaccccctccacccacaatgaaaaccacatgcactctaagtctggtgaagaaattttaaaccaaatttaaaaacaagtctgaagcaagggagtgctttgtactcctcccttgcctgaacacttctagagacccttttatatatatataacacatacatgtggttacattctaacaactgaaattatttcaacataaaaatgcaactagtgtttaaacctaagacaaacaatgtctttcatataataggttgttaataaatataagttgagcaagttcatgattttttggttgtcaaaaaaactaaagaacaaaattacatttacattgatctgtatataaatactggggtgaagaaagttttgactcatttaagtcattggcatggctttctaagcttttaaaaagatcgacagataagtgtattcaaagatgctcatataacagaccaacaaattttctagtagaatgatagtctctaatgtaatggcaaaggtggcactgcccttccctttgacctttcttcaaaacctcctcctcctccccttcctctactcataaaaggaatagccttttctaataacctttcatcaaaagatacaatcactattgccctatagcaatttatagctttactgggtcaaccaagtactttttataagacagggatcacactcacactttttgatcattcaagccttcatgccctgacctacaagccaatggaggcccctgtcctatttgtttcattctccaactctgcaggattagggaacaggtaggtaaaaaatccttaaaggtgttaaaagtttaaaagaatgtgatcttcagaagttaggggtaggtagtgtaaacataaaagtagactgaatgaatgcattgttttattcaacccagatgattatccttggttgactggctctaactctacaatggcactgtcatctctaatgaagaccccttctctcaccaattctttacttacttctttgtaacagacaatcctgtatctttttttttttaatattttttaaatttttatttatttatgatagtcacagagagagagagaggcagagacacaggcagagggagaagcaggctccatgcaccgggagcctgatgtgggattcgatcccgggtctccaggatcacgccccgggccaaaggcaggcgccaaaccgctgtgccacccagggatccctaatcctgtatctttcatttgggccaatgaacacggatgctaagactattccttaagaatcatgtatctgaatttctcctcctgaactgtaagccaaggcaaagcaagcatctgtcttacactactcttaatatccttctcccatctcatgctcaatgtacttagtaagcaccttataaaagatttgccaagaaagcactcatctttcctcaccattcctgggagctgagaatatgtatgtaggacaggaacggtattgggaggtgaaatggttttctccgccaagttgggggatgaagttctggtcctcttaccagcggagcctgttagcctgatgtcgtctgtttagggaaaccacagctactgcctggctaattctaattcagagccaaggtgagctgaaagggagaggaagcagcaggtgtgcctcacatcaacctccctctgcacatttaaaaaaaaaaaaaaaaaaaaaaagcttctctttgtgtcttttagtcgattcaaagtgcaaactgggagatctgatctttagtagatcagctagtagctgtttctgcacactttgtgatacacactttccttttccattatttctttaaaaaaacaacaaaaaaccgtcactcaattttcctgtgattttaagatgatctgaagccctgtaccctaagactcgccgtggggaagggggcacactcgaaggagccacaccccagcgtgggctttccacatctctgcctcacacaacagctcctaggttctcagaccccagaaaaaaaagaaaaaagaaaagaggtgcaaaatggtaatgactgagatcccagaggagacctgagctgtagcagcgagcaaagctggcaacacggaaaaagagaagagagcccggctccccaccccaaccgcacaaaaagaaagaaagaaagaaagaaagaaagaaagaatggggtggggagcctgcgacgggggaagtgtggcgaggaccgaccgggagagcagccgggcgcggcggggtgccaggggtgccaggggtgccagcggctgaggagagccgccgagggccggcccgcacaacggctggaaagagggcgccggggggagggagagcccctaaaggagggggcagcctggggtgggctgaagactcaccagagccccgggaaagaagggctggggacggcggacggccgcggacgccgcccggccagcgacctctccgaccggcagacacgcgaagccccagcggcagccccgcgccgaccagccacgaccgggggacgcgcaaggggctccgaggctgcggccgggggcgggagcgcgtaaggacaacaggaagcgctccaaccgccggaaaagacggcagcgcggaggggccaaggcagcccagtcccccgccgcggagaggggctggcgcgggggccgggggcccgcactgcgcaggcgtgactgccccgcgacgcggcggggggggggcttcgggactgcgcgtgcgcggccccgccgcacccatcctccccgcctcacctgggagagggtcggagggagagggaggcggtgcggagggcggcagcgcgccgtgtgcagtgggggtttcggggtgggctaggccgggctcgggggaggtgccctgtgttttctggtttctttgtttgctttatttggagataattacagactcgcagaaggctgcaaggctaatacgaggaagtcccgtgtacccatcacccacccagttccctcaccatcttgcacaactagtacatgatcaaaaccaggaaattgacatcggcacaacacaactaactaaaccaatacgattgactagattgcagaccttactcggattttaccagtttgccatgcactcgttggtgtgtctgtgagtgcttgcgtgctcgcattcatctgtagttgtattaaattgtattacttgtgtagtcgtcatcccccgccttcccctgatttttgatcatcgtagcaataagtcggctagaacccctgaccccaccccatcttactcttccttaaaataaggactaacactaaggacttacttgggatctggagagctttcgtaacgtcaggctatggcgtggggggggggggggagcatcccagtctgcacagaagaacctgcttttcaaggcaacgcaaccgcttagtctgtgcaaccccgagtaaagaagccccaagccttcaggacgctcattcttttcttgagaaaggagcacagagctcttgactagaaagcgtcaggctcctggaaacattatagatgagtaagatagggtgcctgcttgccttcaaaaagaccatgtaggtagcaaaatgtgtaagtcattcattagggtattttgtgctagcttggtgcctcattcttgggttattctaagactataaagcttggttttgccgttcaaacttggggtcctgggctttgtttccttaatggtcttaaaaaacgtaggcattccgtgactgcttttatcttcctagacttcaaagccctgtttcctttgtgtcgcctcaaactaaaaagaattcatccttcattctctctgtccaaaggcccttctccaccaatgccttttgtcaaagtcctaccagtccttaatgacttaatagcagtgcaagatgtttgcttagcgcactttccagtttagaaaccccattcgttcatctgatctcagttcatcctcgcaagtctttggcaggtcacataggatgagtaactttacacataaagtaactagcactgagagaagtgaaggaacttgcctgaattgtcacagctagtaaagcaagaggagcctcattctctgattgcaaatccaatgttctttctgctttcccctttccccagctgaaaccttatcttttccttggagccttcccaatttcaccagaggatacatatcccatcctctattctctatagttctatattaatttatctataccttaactctaataaacactaaaattttactcaaaattgctcaaccagaatatgctgctcttctctacttccagcaaatagaaacaaaacctaagtgccaccagtcacttatacccaccccagactgtgagttggaagcagaagcaagtgtgagctgacccttacacccacaggacggggccttatttgcctccctataatactgtgtcgttggatcctgcttttattttaaatgccatttgggcagccccggtggtgcagcggtttagcgccgcctgcagcccagggtgtgattctagaggcctgggatcgagtcccacattgggctccttgcatggagcctgcttctccctctgcctgtgtctctgcctctctctctctctgtgtctctcatgaataaataaataaagtctttaaaaaataataaatgctgctatttttttatcatgcattttttgcattaatttttatttttttaaatgttgcattaaaatgttatcttgattactgattcttttgctactctcataaatcttgtaccaagggaagtgtcttgctcacctcaccctactccagaccctggaacgatcactctgaatccattctggtcagagtggtagctgctacatacagtttctagagaccttcatagagatctcagaccaggatggtcatgtgtaacacggccaccctttctgggaaagcaagtactcagcttttgttatattctgtaatggaggcagacagaaaagaaaggaagtgaaaatggatgttgagtgatccagccaataatgactgccatggagtatacattactttgctgttctcttttaatccaatttccttttttttttttttaagattttatctatttattcatgagagacacagagaaagaggcagagacataagcagagggagagcaggcttccacagggagcccaatacaggactcaatcccgggtccccaggatcatgatctgagccaaaggcagacactcaaccactgagctacccagttgcccccttaatctaacttcctaatctttttttttttttttttttaatgataggcacacagtgagagagagagagagaggcagagacacaggcagagggagaagcaggctccatgcaccgggagcccgacgtgggattcgatcccgggtctccaggatcacgccctgggccaaaggcaggcgctaaaccgctgcgccacccagggatccctctaacttcctaatctaagtgcagaatggcatattgcaggatgctttatttttaaattttatttattttctttagtaagctctacactgaacatggagcttgaactcaagaccccaagatcaagagtcacatgcttctccaggagttccatccaggtgcccctacaggacccatattaattgactactggttaatgggaacatccctttttattttctattttgtattatctctgccctcatataattataactacaatacaatccacctattcaagattctcagtttggggttttattttggggggttttgttttaggttttggttttctgacatctttttgccacaaagtacatgttattttcattcaccatacaaataatttcctgtaatatcccagagcaaggtggagaatttagcagtctgattgggagtcccctgagagacccacaggccagtgggatcagcacagaatgcccgggttcaccatgcacttacgtccatcttgcaggtgattcttcttcctccacgtcaggactgaggtgtcttgaagatgactgggggtagagaatcctaaaggttcttaggaaatttcactccacttctccattcaaccatctcttgggtccatcttcagcttggggacgatttcccccatgcctggcttgtctgccattttcttaaaacgatccatgaaattccccttcgagccccgtggctgatgcacccactcctgttgctgcagcaagagacctccattttggttttggttttgtttttaagattttatttttaagtaattgctacacccaaaggagtgagctcgaacttacaacctccagatcaagagtcacatgctctaccaactgagtcaaccaggcaccctgcaagattctcggttctataacagatatctttaaaagctgttggaaaaccaacaaccttatagtatactaagttattcttcatccccatggatttgaattacttggtcagaatattagcactttttttttttaggtaagctctatgctcaaagcaggggctcaaacttacaaccccaagatcgagagtagcatgctctgccaactaagccagccaggtgctacaggtgctacaaatactaacacttttgtcttgctcttttccccagtttcagacggactaatcttttccttctgcttaaaagttgccccaggggtgccgggttgctccctcaattgagcatcagactcttggtttccgctcaggtgaggataccagggtcaagaagatgagccctgcctcaggatctgctcacagcagggagtctgcttgagattctctccccctctccctttgcccctccccacccctagtgagagcaagtgaactctctgtcccttactttttttaaaaaaaaagattttatttatttattaatgagagacagagagcgcgagcgcgagagcatgcgtgtgcagcagagatacaagcagagggaaaagcaggctccatgcagggagcccgatgtgggactcgatcctgggtctccagaatcacttcctgggctgaaggcagtgctaaaccactgagccacccaggctgccccatctccctcacctttctcaaaatataaataaatagggcacctgggtagctcagtggttgagcatctgcctttggctcaggtcccgatcctggggtcctgggatcgagtcccacatcaggcttggagcctgcttctccctctgcctatgtctttgcctctctctgtgtgtctctcatgaataaatgaataaaatatttaataaataagtctttaaaataaaataaaggttgccccgaattgttctttgtcccaagcaattcacctgtttctcatccatcaggttgatctgcaattgcttcactggctgaagctcatcctctagtcaaagaccacaatcctctgaagaataggcgtcttatcgcctgtcagtgtgtctcacctcgcctgtcaatgtgcctctgaatattcctttagtaagaagacaggaactgttcttggtgcctgctagcccagggttgctccaatgttaacaagcacacaaatccccgaagattcgattaaaatacagattctaatttagaaggtctgggcagagctaagagtctgcatttcaaacaagctcccaggtgatgctaatgctggaggtccatgtaccacatttggagtaggaaggaacttgaacatacacccaagtgaaaaatatggagtaagtgcccatgatccagcagccctatgtcccgaccatggccagacttgagtgaggcaagtgaggcacctaggctcaagttcagcaacttcattacatgaccatgaggtgagtgcctccttatattgtgcatacaagcaccttgtttgcccaccctactcactaccaagtcacattttggtgtgactatccctccggactacttttttttttttttaagattttatttatttggccaaaagaaagcacaagcaggggggagtggcaggcagagggaaagggagaagcaggctccctgctcagcaagactcaatcctaggaccccaggatcatgacccaagccaaaggcagacacttaaccaactgggccacccaggcaccccacctccaggctactttctaatacacatatcaacaaatggggattatatggtgtatgattatattgtgtgtaattatacctacaatatcacacagtattatactgttcttattcatttacatctaagttgtgatatttggtaaaccgcaagctctgacaatttaatctcaaattcatttacatatttttaaaatatttatttgtcagagagagagcacaagcaggggagcagcaggcagagggacagggaggagcaggctccccactgaggggggcggggacaatgccagactccatcctaggtccctgggatcagaacctgaatcaaaggcagatgcttaaccaactgagccacccaggtgtcccaaatctcagattcattcaataatcctactcctgtaaaatgtacattgttgctttctgtgagtgaaagagttatgaatgactattattttctacttcatacatttctctttcaaaatgttccacattgtacccatataacttttaatttagtttatttttatcaaagcaatacacatatagacctggggggaaaaaacgatctacaagacttatgttaacagcaattccttgccccatccactcctagttcactcagcagaggcagctacttttgggcacgtggatggttcagtcagttgagcatccaactcttgatttaggctcaggtcatgatctcaggggcctgggattgagccctgcattgggctctgcactcaaactttgcttgagtttctctctctctctctctctctctccctctgcccctccccctgtgcgcacacactctctctcactctcaaataagtaaatctttaaaaaaataataataagcagttgttttcaacacatagttgtttcttctgctttttacctccttgcttctaaataacattgctgattctgaaattttcagtctttttaaatttttttaattttcacagtgaaagtgaggatagaactcacaacacaactttcaccactgcttttctcaagtcaatattcagtgtttaaactaaaccaaacaaacaaacaaaaaaaaaactaaaccaaacaagacagaataattactctgccttcttggaccattttttgttttccctaaagttaataattgcctcagtttttttcctttgttcagttttgttttaaaatatttatcatcaggccacctgggtggcttagccagtcaggcatccaactcttgattttggctcgggtcatgattctcagggttctgagatcaagccccacctcaggcttcattctggacatagagcccacttaagattctcgctctcctctgccctcacatctccctcccactcactacctgtgcacacattctctctctcaaaaaaaaaattaaaattaaaaaaatgtatcactaatttagtctgcaatctctcttgtcaaaactggaaaacttttttcatattatggtcaaactcagtctatcagctccagttttttctctagggtcatccttcatggagctctctgtattagagttctccagagtaaccggagaaataggatagaaagatttgttttaaggatctggctcatatgattgtgggggctggcaagtcctaaattggtagggcaggctggcaggcaggaaacccaggcaagagttgatgcttcagtcttgagtctgaagtccacaggataggccagtaggctggaaactcaggcaggatttctatgttgtcatcttttttttttaagattttatttatttcttcatgagagacagagagagagagagaaagaagagaggcagagacacaggcagagggagaagcagtctgcatgcagggagtctgatgcgggacttgatcccgggtctccaggatcacgccctgggctgaaggcaggcgctaaactgctgagccacccgggctgcccctatgttgtcatcttgaggcagaattgcttcttccttgggacatctcagcctttgcttgaaaggccttcaactgactcgatgagacccacttaccttatggaaggtaatctgcttaatttaaagtcaaaggattataagtgttaatcacatctaaaatataccttcatagcaacatatagactagtacttgtggccagattgaaccccatagcctagccaagttaaccctgaaattaaccatcctcctaagtggtctctcccactatggttttattttctcattagtgttcccctcccactcaatttcatagccgtcccctttcaatatcaaccataatatataaatattgaaagggtcatggtgccagggtgactcagtcggttaagcatctacctttggcttgggtcatgaacccagggtcctgggatagggtcctgggatcgagtcctgctgcatggggcttctgctcagtggggagtctgcttctccctccccctctacccatcccccttgcttgcatgcatgctctctcttacaaataaataaaatcttaaaaaaataaataaatagataaatattgggagagtcactgggcacctgctccagccccatccagctgccttctcttctccatctctttcccacagtcctaggagagcagaagagtgcagagctcacacagcatatatgctctggtaactgccaataaccatgcctggccaggaggagaatttatttgcagctgcagtccttcagaagcataagtataattgactgggcctgccacagctgtcttactggtcttttttagcccaatgcttaggctacaaacctgaaaatctcaataaagaaagcactaaaggcaaccattagggcagcctgggtggctctgcggtttagcgcctctctttggcccagggtgtgatcccgaagaccggggatcaagtcccacatcgggctccctgcatggagcctgcttctccctctgcctgtgtccctgtgtctctcatgaatgaataaataaataaaatctaaaaaataaaggcaatcattagcttttcatattgtttattaggtgcagacttacaactatgccaatgcgtagtacaataatagttttgatcatatgattttgcctgcttagaggtttttattttctctaaactacttaaagatggggccaaaataattgtgaagtcttaagaaatacagattttaaatcatttttttccaagtgactgtgtatacccgtgtgtgtgtgtgtgtgtgtgtgtgtgtgtgtgtatgataatgagtctatgttttttgggggattgagggtgaaaaatctcaaaaacaaatgaaggatgtgaagcatggtaggttcagtaaccaaatgatgcataaacttttcccacctaacctttggtatgaaatattaggagggaagaaattatatgaaccttatggagcaaggaaagaaagagaataataactgcagaacaaaaagagtaatgaaaatgagttccttgggacgcctgggtggctcagcagttgagcatatgcctttggctcaggatgtgatcccagggtcctgggatcaagtcccgcatcgggctctctgcagggagcctgcttctccctctgtctctgtctctgcctctctgtatctctcatgaataaatagtcttaaaaaaaataaaataaaataaaacaggttacccaaagcaaaaatacacttgatcttagccaaaaggccaagaagccatccctaaagcaaaaataaatcaaaaccagaagtgaaagggatgtcactgacttcattgtgtttagatgggaaacttcctgtaaaacaagggagttcctgaggctcccattattgaaaggttttcttttaactggttgggtggggggctgcaagaatcttaagattcccaggctctcttaggaatgcactaaattttccatgtttgccgagggcccagaactgtccaaactgccaactgatagctgatgtcatacattccctaaaagtggaggcatgtgaatcccatttgttccaaatagataagcccatttgttccataatagaacatactaaaatgttctatatccataagtttgaaactgggttaagtataatgatatgagtttctttaccgcaggccttctcaggacttttaatagcattgtgactctccattaggaacgtttattgtaaaggaatccatagatgtatctgagatgtttcttggagcactagttaacatatccctaaactagtgctttgaggaacacagaactagatagttaccaccagggtatgtgtgtgtggggagatggttatatgagatatatgagagatgggccaggatcacctgctagttcttgtgtagcttctgaccaaaggagcaagaggagacccaacagcctgttaccacctcctggctttgaaatatgatctcataaattcccctttggttctcaattgctaacatatgttttagaatccaacatccaagctaaaagggaacctagagatcacctcaactaatccttccattttacagatggaatcgggcctacggacaagaattaagttgcccaaaatcatgggtacattaaattgcaaagttcagttagagccaggtttcctgacttcctgtccattgatctttctcctgctttttggtgcctctctccatatgactgaatccacagactttcaatgggctgtcattgcacaattctgacaaatatgtctattatcaaaaatgagatctaaaccaactagtggctcatacaatctcaaagaaactgcaatatgataaaataattcagaccatcacagtcactggcatttgaagcagcaggatttgacccatgatttcagcaccagattcttcatttatctctgaggccatagcttcatgacgtctaccttgaaaactgaattttaagtcatgtagatgtcatggcccatctctccttataataaagttttaaaatagggtgggagcttctgggtggctcaattggttgagtatcagactcttgatttccactcaggtcatgatctcagggtcgtgagatagagccctgtgtctcatggagtctgcctgggattctcaatctcttctctctctgccctctcctctttgtaaaataaataaataaataaaatctttaaaaataaaataaaatggggttgtattgttcaaaaaatagatcaaagattatacaaatttcaaagtgaaagtctcattcctacctctgtctcccatgcaccttactttccatttccacattgttagccattgttattagtgttttgtattttcttccagagttctctcattttttttaagtaggctctacacccagtgcagagcccaatgtggagctcaaactcaccaccctgagatcaaatcaagagttggatgcttgggatccctgggtggctcagcggtttggcgcctgtcttcagcccatggtgtgatcctgaagacccaggatcgagtcccacgttgggctccctgaatggggcctgcttctccctctgcctgtgtctctgcttctctctctttgtgtttctcatgaataaataaataaaatattaaaaaaaaaaaagagttggatgctcaaccactgagccacccaggcaccccaagtgttctttttttaaattcatttactcattcattcattcatttttaataatctctacacccaacacagggcaaccctgagatcaagagtcacatgatctttagactgagctagccagggcccctccttccagagttctttattcacatatgcatatagagtcatttctttcccttatttacacgaatggcatgatctcttcatcaggcaagtctcttcctgttcaagccttaatttccctatttataaagaaaggatattgttccaaatctcttcgcctgccgctctgacattctcacaagccaggcatacattaagccccctgctactcattctgcctctcttggcaatgtttggtcttttggaaagtcacacttgcatggctagttttgtcagttgacctcaaatttagaacactcagggtgtggtttatagactctggtatttcatgctttaagaaaatccagaacacaaatgtcaacatttccaaagcaaatgagggagtggctgtttgtattacaaatgaaccttgcaaaatgactcaccaagtcatcttttaatgtatttatctatttaatgtatttaatattttatttattaaataaaataaaataaaattaattaaaattaaataaaattttatttattaaataaataatactttgtacaaaatacaaaagagtacacaatgaaaatgccccaccctcatctctggtcaccatgttctcctccctccccatgggtcatctttgttgtccatttcttgtgtatctttccatagtttttacatatgcaaacacattcatatatatccttttttgaaaatagcattctaaaaaaaaaaaaaaagaaaatagcattctaaacacactgttttgcaccttatgctttttcactgaaaaatacatcttggaaatcattttacatcaggacaaataaaactgcctcatttttttagggttatataatgttccaatgaccaatataccaaaatgaattcatctaaagggggttcttttcattattattattatttttttaatgatagtcatagagagagagagagagagaggcaggctccacgcactgggagcccgacgtgggattcgatcccgggtctccaggatcacaccctgggccaaaggcaggtgctaaaccgctgcaccacccagggatcccagggggttcttttcaatagtgagctcactattggcactatctgtgccaaacagaaactcacaagtgttttcacctcctaactgctaaggctgaatctcagattgcttcaagaacctcaagtcttaatgttcctcatttttggaataaacttatttccctctctctctccctctctctcccctactctctctctttctccatcccttcctcattactgaaagctgaacaatccaatgtagctttttttttttttttttttttttttaacatctagcttttgaaacctccctcattctccaaagctctgaataatcctcataatgaccactggcagtttttattccgggtggttcccagttctgccctcacaacaataaagcttctctaccatcatattcactataagaacaagaaaaaccttgatcaggggaccctgggtcacttagttggttaagcatctgccttcagctcagatcctgatactagagttcggggaaggagccctggaggcattgggccaggggctcagtggggagcctgcttctcctctgcccctccccctgctcatgtgcaggtgtgctcactctctgactcacgctctctcaaataaataaataaaaccttttaaaaaagaaagaaagagggcaggcccggtggtgcagtggtttagtgccgcctgcagcccagggcgtggtcctgaagatccaggatcgagtcccacatcgggcttcctgcatggagcctgcttctccctctgcctgtgtctctgcctctctctctctctgcgtctctatgaataaataaataaaatcttaaaaaaataaaaaagaaagaaagaccttgatcagaggcaggtaaagggtgatggcatttcccagccttcagtgtagccaaagggacccaggtggccttggaagcctcatcatccatttaccacaagagatgtacaaatattattgttttactttttaagatttttatttatttatttgagagagagagaaggagagagcatgaggggagtaggggagtaggggcaaagggagagggagaagcagacttctagctgagcacggagcctaatgtagttgtgggaaggggggcgatcccaggaccccaagatcagggcccaagacaaagccaaaagcagattcttagccgactgagccactcaggtgccccaaatattattgcttttttaatgtgtggccacaagaatggttgaggagccttgatgagcatgagaggaaacacgtccttagcacagtttggcatatgatgtgttctggtaaatatgactgattggttggttgaatgatataatcaggggctgggactcaataaagagtgggcattgtggttactatatatcttatcacttttttgtgtgtgcccaatctcaaagaaagaagacgggacacccacagatattttataatcctaatcctagttgacctcttatttcacttacttaaaatattcactttccttagctctgagatatgacgttcttctgctttgcttcctacctctgccatctcctctgctgattcttcttcctctactcagcctttagatattagagtttttccaagtctggctctttcctcttttctctccctgaaatatgtcaatgactcctgggcaaaccatgttctgatgaaatccaaattgatgttttcagcccatatcccttctctaagcttgaatccgacctcctgtcagccctgcttaaattgactgagatgaagcatctgccacctagaggaatgacagctcaaaataggagtaaaagtactgaaatagaagggggtttgtgtgcatctgaaatttgtacccactctactagctatttcgaatcttttctaccttcctcaattcttagattttgccaaccttcccacccaccaacccatcccaattagcagattctatcacttcccacttttcagggaccattagacagctccctcaccttctgccgccaaatctacagacacccaagccctcaaccttttctcttctaaattcaggcaatttcctccagggctttggcttatatcacttctagttccttggggatcctttgctactaagtgtccacccccaactccatcccctctctcctaaccagctcttcttgctgcttcctagcaatgtgtatgcatgttcaaaggctccccaacttaaaagccccttcctttgaccccatatctgtctctcacctactgccctttaccattcctttcacagccaaatttcattagagttgtctctgtttaccatccttagttctacatctcccacacatgtctcagcctcctgcaattttgtttttccccctgccatctgctgagactatacttgacaaagtcaacaccaatgtcttctgtattctttaaatccagtggtcttcacattgcttgacctctctgcagtgttcaccactaccaaccactccctcctccttgttttgttgctcttttccttatgacaacatttcataaatggttctgggtggctcaccaagtaaatgccagcccagagattatatttggtttctcccttcacaaacacctcgttatctctaactcacccttcagatctcagcaaaagcaccttcccttttccttcagacctgtgtgcacagttttctgtgttttacctgagtagcaattatcacagattgcaattagatatgttagggtcattctacaccccagccttccccctgagttgtatctactatccagagactgctgtggtgacaagacacaggggagggtggctttctgctcctgcacatttcttcttgtgctctccagccgaaacgtaccaagagtttacagtcctcatgaatactagtttaaaaggatctgaatactctccttcattctcctcacacatttaaattgtttttccaggctttatccaaagtgatcacgggaaattattaaagcagcagtccctgagagtggcctgatggtggccacacagcctcttcgtatgaaattatgcctaacaaccaccactgaggtcaccgatctcacctagaggatctcacctagaggtcgagtagactcttccaaaccttgagtgttgtcttttcacatgagtctcttttgtttcccacagggtcctagctcccaagccccagaaagagattcctctttctgctgggtccaccctgccctgaattgagacaacaaagatttagttcaccaaatgggcaaaaaggccatgcagaaaaaaaatatcctggggacaaaagccatgagttgatattccaaaggagcctcctgatgcagtactgtggatattgagaatctagagaaatacgggtttggagataatagatgtatccagaactgcctgatgtctttaggcaataaacagatatggcaaaaggaaaaaaaaaatcattttgccagagagtagaaaaagaagggccctttgatctccggcattacacagagaaatttttggaggaaaatgtgaagattttgtgattgttgaatcacagagggtatgagtcatttgtaaacattaaggaaaataaaacatgtacttgtgcctaaatgtagctagcaagaaagttaatcatcacccacatatctgcccttaattatctaattaatctaattacctcctaccatcttctgacctttctcttcccacctatctccatttatggtgtattacctaaatgaaacagcatgatcaccccaaacaaaaaccccacagatagccaagagaagctgcatggttgagaaagactcccattatattttattttcatgtaattctgtattagcatagttttttgttgttgttgttgttgttgttgtttagaacctcaaaccctgggaagatgcaagttgaaggcaaagtgacctcatgcttttcttcaaatactgcttgttttccaggggggcaggaagccagctccagaagcctcttggtttatgataatccttcaggacacaactgaacaacgagcacaaagtgtctgtctgctggtggctaaaacttgatacagaccaggatagggtctatccagcttcctcctctctcaatagcaaagtataccttgaagtctaccatttttcagctgattgagaaagacttaaaatggttaaatatcttttcttcttgttgacatccacacagtggaaatctggcctttgggggcccctacagatgactttctcccatgatactctatctgcctttgtttttagatgccctgttttcttattcttacttagacttctctttagagaaaccagaataattggactccagggagagctgagttgcagagctgaggcttaaatgaactgacaaactaattttctccacatcatgtttttaatttcaaaaccctggttagaaactggcttttaattgaaatattctagttttttttcttttttcttttttcttttctttctccccccgcccctttggtcagcagcaaagcaaggttttttgagcaatagtaaagtttattgaatgagagagtacaaagctcccaaagagggaggggaccctagagggttgccctatttttttaatcattattattatattattgttaataatcagttattgcatacctactcataaacattgtgttagggcctccggcgaatcttctggcatccataagaaataagcattgttaaccctatttaagagacctaaaaactgagtgtcagaaagatagggccaatgaggggcagacacaggcaaattaacaggaagctaatcaaactaaggagactgaaggtaccctctcttacatggagctccttccagacactgcacctaattctgtatccataagctttattcttctccttaaaaggagctttcaatatcttttaaagtttagtccccaccaaatctgaatctgcccctgctgtggagtcactgtgtgaacccagaattatctgactttgaaatctatgctcttcatacagaactcttattcatcacaaaatgcaaagtcagaaaatatgcttcctaaatctgtataactgtgaataatacaccaataccctttacagagcactctgttcaaatattacgtgaatcacttgtttggagaatcagagacatgtaatagcagatactcatttctcaccatgtgtctggtgggatgagaggaatgtaagagattggttcaaaggacaggctttgggcctgactccctgggttagaattcttgttcccccacttcatccttagccgtgtgtgcttaggcaagttattttacctctctgtgccagaatttcctcttctgaaaaataggtataaaaatagttcctactgcacaggaatttatgtatgtctgtgtgtattaaataagttaaaagggtttttcaaactgtaggtcatgacccgttggtagatcatgaaatgaatttaatgcgttaaccagcatttttaaaaaatatattttttatttatttattaatgaaagacacacagagagaggcagagacagacagagggagaggcaggttccttgcagggagcccaatgtgggacttgatcccaggactccctgcccaggcgtccctaaccagcatttttttaatgaagtaaaatcagaatacatttttcaaaatgatattagaatgcatcacacatagtaggggaaggttatattttctgagagcttttgtttccattgtatatggcctaaaagtacatacgtatgaatgtgctgcattgctttgtaaaatgttactgtgagtcaccatccaaaaggtttgaaaacccctgaatgaatacaggcaaagcaattaaaagtagaggggtcacccttgtggacccttaataaatcttagttatgatcatagtggtagacctggtgaagtagccataggtgtacctaacatagtccaagtgctttatctgtattacctgttgtctcgtgtaatccgaatattcctttaaagatattgttagtgggacgcctgggtggctcagcggttgagcgcctgccttcggcccagggcatgatcctggagtcccaggatcgagtcctgtatggagcctgcttctccctctgcctctgcctctctctctgtctctcataaataaataaataaaatctttaaaaaatatatctcctttatattattttgcaactgtttttcagtcaccaatcttttcctattcacacttgaaacttttattttatctaatatccaaactaaattcaaatttcccccaaattgtccttctcagagagtaaatttgtagaaactgggacgggtgcagtactgttcattgatctggctgttacaacccttaacggcttcttctccttttgtcatgaagttgactttcagagagaacaggctcagtgtcctccagaatgttctactttctgatttctctgtctacttccttgtgccagtgtttatcttgcaccttgtgtttacagtaaattacaagttgtatctaggggcaccacgctggctcagctggtagagccagctcttgactcagagtcattgagttcaagccccacattgggcatagagcttactttaaaaaaaaagaaaaaaagaaaaaagaagaagaagaagaagaagaagaagaagaagaagaagaagaagaagaagaagaaagggcagcacaggtggctcagtggtttagcaccaccttcagcccagggcctgatcctggagacctaggatcaaatcccacgtcaggctccctgcacggagcctgcttctccctttgcctgtgtctctgcctctctctctgtctctcgtgaatgaataaataaaatcttaaaaaaaaaaaaaaaagttgtacctaaggggggaagaaactcaatttaaacatttggctagactacagtttaagtagtgttgtctattcatactatatcatcaaaagacacctaatatctagacccacaactgatgctaaaattcaccaatctcaggggaatgacagtctgattctctcacaatatgattacgtctattccatctccaatctgagactaaaaatgaaccaatatgggattaactgatgctattagtgcatccagttctcgatcaatcatttatttttttatttattttattttttagattttgacagagagagagagagagtacaagcagaggagcagagggagagggagaagcagaccccctgctgagcagggtgccccacttgggactccatcccaggactctgagatcatgacctgagccgaaggcagatgcttaactgactgagccacccaggcgcccccaaccatttattttattttttttaagattgcattcatttattcgacagagatagcaggaaggagcacaagcagggggagtggaagagagagagagggagaagcaagctccctgccagtgaggggctctatggatcctaggacctgagcaaaaggcagacacttcgcagacaatggagtcacccaggcacccctcaactattcaatttttaacagctttatttaggtataattgacatgcaataaacggcacatttttaaagggtactctattgattttctattgctgctgtgataaagtatcacaaacgtagtaggttagaacaatacaaaatatattatctgggatccctgggtggcgcagcggtttggcgcctgcctttggcccagggcgccatcctggagacccgggatcgaatcccacatcgggctcccggtgcatggagcctgcttctccctctgcctgtgtctctgcccctctctctctctgtgcctatcataaattaaaaaatatatatatatatatatatattatcttacagtactgtaggttagaagttcaacatgggccttatccagtttaaatcaaggtctcagcaggattgcactcctgtgtgtctctcatgaataaatgaataaaatcttttttaaaaattgccaaattgttttccaaaatgattgtacattttacattcccaccagcactgcatgagagtcccaacttttccatatcctcactaacacttaatatgatcaggttcttaattttaataccagtggacaatccttgcttacattgattttattagaacttgcaaaatgctgattttatatttattttttttaaagttttatttatttgggagagagagagaatgagtcaaggtgggagggagaggtgcagagggagaagcagactccccgaggaacagggagcccagggagcccaacgtgggactcaatcccaggaccctaatatcatgacctgagccaaaagcagacacataaccaactgaaacacccaggcaccactggttttatatttctaacattacttctacattgattatctggtattcgtaataaaatagagctttctctcatcaactgaggttatgtacttatcctaaatatagttcccactagaacggagcttaaatgtttgattcttaaaatctataaagaatttatcaaactcaacacccgaagaataaataattcaatcaagaaatgagcagaagacacaaatagacatttctccaaagaaggatacaaataaatggccaatagacacatgaaaaaaatgctcaatatcacttggcatcagggaaatacaaatcaaaaccgcagtgagataccacctcacaccagtcagaatggcttaaatgaacaagtcaggaaacaacagatgttgttgacaatgctgagaaaggggagccttcttacattccctccttggtggaaatgcaagctggtgcagcctctctggaaaacagtacggaggttgctcacaaagttgaaaatagagctacactaccactcagcaattgcacttcttgggtatttaccccaaagatacaaatgtagtgatctgaaggggcacctgcaccccaatgtttatagcagcaatgcccacaatagccaaactatggaaagagcccaatgtccatcgacagatgaatggttaaagaagatgtggtctatatatatacagtggaatactactcaccgatcataaaaatgaaatcttgccatttgcaatgttgtggttgaaactagaggatattatgttaaatgaaataagtcgatcagagaaagacaattatcatatgatcccacttatatgtggaatttaagaagcaaaacagaggatcctagggaaagagaagaaaaaagaaaagaaaaaatcagagaaggagacaaaccgtaaaagactcttaatcataggaaacagggttgctggaggggaagggggtgggggaatgggataactgggtgatgaacattacagagatcatgtgatgaagtgagcactgggtattatataagactgatgaatcacagatttctacctctgcaatcaacaatacattatatgtggggattcctgggtggcgcagcagtttagcgcctgcctttggcccagggcgcgatcctggagacctgggatcgaatcccacgtcgggctcccggtgcatggagtctgcttctccctctgcctgtgtctctgcctctctctctctctctgactatcataaataaaaatttttaaaaaatatttaaaaaaacaatacattatatgtgaattaatgggatataaataaaaatttttaaaaagaataaaaattatttatttatttattcattgattcattcattcatgagaatgagagagagaggcagagacataggcagagagagaggcagagacataggcagagagagaagcagtttcaatccagggagcccaaggtgggacttgatcccaggactccaggatcatgccctgcaccaaaggcagatgcccaactgcttagccacccacgcatcccagaatacaaaatttttaaaagtgtattggttgatctaaagatagctctttcccaaatattcaccacactggtaaaatagtaaaaataagtaaaataaatttttcaaatgaaaaaaaaaagttcaattctctccctttagttgccaatttttaaaaaagattttatttatttattcatgagagacagagaaaggtagaaacctaggcagaggaagaagctggctcctcgctgggagcctgatgcgggactcaatccctagatctgggatcccgccctgagccaaaggcagatgttcaaccgctgagccacccaggtgtccagtcaccaatttttaaaacaaagagttgttttacttctcacacaccctttttattcaggtcacctttttattcttttcccattttataaaatgaaagatgtgacagtgagactcaaaagaacttgagactaaaaagttgctgaatctcagccagcaatcaagaattcctaatatgactttgcctttagaattaaaagcctcggggccccctaggtggctcagcagttgagcacctgccttcagcccagggcatgatcctggagacccaggatcgagtcccagatcgggctccctgcatggagcctgcttctccctctgcctgtgtctctctctctctctttctctctctctctctctctctctctccctgtccttcatgaataaataaataaaatatttttttaaaaaaagaattaaaggtctcggttgctaaggtactttgaagatttgtcatagtatgccagtactgggtgcctgcttcctagcaacatggtcagagtctattgagaaacatttcatctccttgctatgaactccctcatttacagcagggtcattaccaagtgtctcacgggctgctgtgctgcccttccccgaacctgctagtgtggcacagaagctgaaaccgtggcccaacaggcctggaatacattcctttgccgttaaaacccccttcattgacttctgtctgagcataaattagaattaattagaagtgacctcctgggctgttttccaagcaaggatgaaacagaatgtagcaagaaacagaaaagacaggagtccgaaaacaagtttagatggtggagtcagtaaggaacacagaagttaaaggatagacagggggattcatgggtggctcagtggttcagcgcccgccttcggcccagggcgtgatgctggagaccgggatcgagtcccacatccggctccttgcatggagcctgcttctccctctgcctgtctctctctctctctctctctctctctctgtctctgtctctcatgaataaataaaatctttaaaaaaaaaaagtatagacaggactgattttcagctggaaggctctggaacagaggtaacagttgttaaaatattgagtgctgggggacctggggagctcagtcggttaagcatctgactctgattttagctcaggtcatgatctcagggttgtgggatggagccccatgttgggctccatgctgagcatgggggaggtctgcttaagattctctctccctctaccctcccccatccaagtgcactctctctctctctctctctctctctcggaaaaaaaaagaaaaaaagcaaatacttctgtgtttgttgataaatagccgctacttggagaacccccatccctaccctagtgcttatttcctacctaccttgagccctagtctcttctcttgccaccctctcaggactgttttgattaactagggtccaggctgaactagggttaaatattttgaataactcctctgggtgtggacacaaactggtttagaattctaattgctataatctggcactcatatttgacttggatatgaacatggtgttgttaaggtaggcactgctccctatccttgggccacgtacttgtgggtactgggttgtattgtccaatgtattttttacttttggaatcaaaagtttgaaaaaccctggttagggcattccagacaaaggggaccaaatacagaggtacacagtttgtttctggaaaggaaagacaagatgactaggaagtaggcaggcagggccaggtatagaggccatgaggttccaggtcaatcaagagtagcctggatattgtggtgcctgggtgattcagtcagaaaagcatctgactttgacttaggtcatgagtaacctggaagcagtgaggttcaaatgtaaggcatagaatggaaagaataagttggagatctaaaaaatgtcgggaacatagggcatatataacatttggatgtatgggggttttttttattttatttttaggtaaactctatgcccaacatggggctcaaacccaaaatcctgagatcaagagtcacatgctccactgattgagccagccaggcatctctcgatgtgtgtgggtttttttttttttttaagattttatttattcatttatgagagacactgagagagagaaagagagaggcagagacacaaacagaggcagaagcaggctccatgcagggagcctcatgcagaaatcaatccagggactccaggatcacaccctggctgaaggcaggtgccaaaccactgagccacccagggatctcctcttgatgtgttttaagcatgaaggaataagtaccccaccaatgataaagcaaagaacttgagtcctgaaactagacaagctccctcctggagcttgacatacagagagccaggaagagattataaaggccacttttggtcaacaaatttgagcactggaaatctgaacaaggtaaaagagcccattgtgcccactgggctgactgcaaacaggcccattaggtaacccacctcaaatcacccatagggggatccctgggtggcgcagcggtttggcgcctgcctttggctcagggcgtgatcctggagacccggaatcgaatcccacgtcgggctcccggtgcatggagcctgcttctccctctgcctgtgtctctgcctctctgtgtgtgtgtgtgtgtgactatcataaataaataaaaattaaaattaaaaaaaaaatcacccatagaccctaactgactaattacaaccaggcacagttcctaagattaccaaaaaagggaaaattccatttgttgtcatacttcctcactctgtcctataactgtggcctcactaccactgcctcagagcaggcaatctctcctttgctgtcctgcctgctgctccctttcagagtagtcaataaatttctcttttattttgccttgggtagggatgcctgggtggctcagtggttgagcatctgccttcggccccgggtgagatcctggagtcccgggattgagtcccacgtcgggctccctgcatggagcctgcttctctctctgcctatgtctctgcctttctctctttctttctctgtgtctttcattaataaataaataaaatccttaaaaaaaagaaaagattatcttgccttgggtgaattccttcaccgcacacatcccacatttggtggttcccccatctgattggagtgccccacagagactgaggggaaaccatgagggctccctgatttagcaggcagtagaagaagcactctgaagggcactgagaatgaggagccagatggttggaaacttataaaactaagagagaaaagacagagatgcaggaggaatggaatcaatctatgatggattagatagaatgaggattccagatactcagagggtcagaggcagggtgggcctgtggctagtatcctgactcagaggtcaaacctggctctggtaattctgagctctagggccttgccttgggtaagcaatgtaactttctgtgtttcagtcttttcatccataaaatggagataatgaaaacatctacctcagcgaatttcaaggattaaatgagtgggcggggcgcctggctggttcaatgagtgactctatgtgactctagatctgagttgtgagtttgagccccaagttgggtatagagattacttaaaaatgaaaaaaaatttaaaatatttatttatttgagaaagaggcagaggagaggcagagtgagagagagaagcccaagtagtctctccactgagcacacagcccaacatggtgcttggtctcatgagaccccgagataatgacctaagcaaaaaacaagagtcaagagttgaatgcccaacctactgagtcactcaggtgcccccaaaataatgagaatgggaggaagagagagagagagagagagagaccctctaaacccactttaaaaaggctgtttaagagctacacataagcatatgctaaattatgacgacagttatggtaccagctacctaaaattttttgcactttctaggcctgtgaatttccttggctataaactagagattggtgtgtagaccctagaagctcagaaaagaaggggaaaaagacagccatgaggagctgaaaaaaatgaaaaatctctttccaaacacagaattatgcacacattagaaattctcaatacctctactggccctcctcagttgctttcttgtagttgctttttttttttttaagattttatttatttatttatgagagagagagagagagagagagaggcagagacacagggagaagcaggctccatgcagggagcgggacatgggacccgatcctggatctccaggatcccgccctgggctgaaggcggcgctaaaccactgagccacccaggctgcccttgtagttgcttttgatcaaactcgtttccctattatttgtgatttcctgagcactaagcagggtccgtaaaatagatttctcatctcctagctgcataagcaatccttttactcaggcctggatccttttccagacctctctgtgggtctgagaaccaaataaggcaatatacttgaggcaggcattgacgttcaggcaccacccagggagggtagagggtggagttgaaattaggaaaggaggctcaggaactgaactgccagagggggctggcacagcagcgaaggacatgtgttcatgtaacatgttgttccttggagctgaaaaaacaaacacacacacccagatatgtcaaaggcagcctttccaaatggccataatttgcactcctcagataatcatcaggctccagagcctgacctgaggtttgaatcccatctccatcccttaaaagctgtgtgacctcaggcaagtgacttaacccttctgtatccacttgtttcaagtgtacaattatatttcataagccagataaattccagagaaaaccaaggtgaaagattagtgcatgtgctggattaggggtagggagttgttatgtgtagagaaaggtatgtggtgggtaggcagtgtcaggaaagtggaattactcaaattagctcttggctcactcccacacttccatggtcatgtgacaccacaaagtaggagaaatcggagccttaagtgatgattattggaaactatgaaccaacttaaaatgagagtctgaaagcctgaaactcagtgtttcccatactttttgattctgtgacaggctttgagaggatttaaccttctccagacacagaatggtgaatgagaggaaatatgacttgaatagaactatcaactataacctagaatgaacagccctcattttctggccctgttccttaaactttaaaacaaaaacagggcagccccggtggctcagcagtttagcaccgcctttggcccagggtgggatcctggagaccggggtccagtctcatgttaggctccctgcatggggcctgcttctctctctgcctgtgtctctgactctctctctcaatctctctctctctctttctatgtctgtcatgaataaataaataaaatcttaaaaaaaaaactcataaaagaagttacagatctttgcctagagaataaagcctcagctagatatacatgtcatttaaattctaaaatatgtggcaagcagctggaagcaatcatgttttgtcaggccagaaagagaacaggaccaagaggtggtattgttaggggtccctaccttacagtctgtctttgctttaaggccaagcttgagagggctgatcactgtagagcctgtgggtaagtgtgggcagtgctgggaaggagagcttttttactcatttctgatgaacatgtattgtcttctatgtgtcaggctggcttggtcttgagactggcagggctcttgtggctggcagggaaagggtttaagaaaaagttgggagctcacctgtctcttctgaatgactgcatgtaaatatgccataatctataaaatgctacactatcagcagcaggataattatttctttttcttcccactcttctcatacggcttctctccttttttttctttataatagaaaatatcaaacataacaaaagtagactgaacccagtatccactatccagcttcagctagccattctcagcttgctttatatgtgcctccatccctgtattatttttttttattattttatttatttattcatgagagacacacagagagaaagaggcagagacaggcagagggagaagcaggctccatgcaggaagcccgacgtgggatttgatcccaggtctccaggatcacaccctgggccaaaggtggcgctaaaccactgagccactcgggctgccccatccctgtattattttgaagcaaatctagaacatcttttatcttttttatttttatttattttttttatttatttatgatagtcagagagagagagagagagaagcagagaccaggcagaagggagaagcaggctccatgcaccgggagcccgatgtgggattcgatcccgggtctccagtatcgctccctgggccaaaggcaggtgccaaactgctgcgccacccagggatccctagaacatcgtttatcatttcatgtgtatctcagcatgtacctttaaaagatagggactttaaaaatcataagcatagtattgttataattctttaaagattaattggaggggtgcctgggtggctcagtgggttaagcagctgcctttagctcaggtcatgatcccagagtcctgggatggcactccacatcaggctccctgctcagtgggagcctgcttctccctctccggttccccctgcttgtgctctctctctctctgtcaaataaacaagtaaaatatgtaaaggtaaaaataaatttaaaaataaagattaattgtaattccttcatgtcatcaaatatttattcagatcccacaatctggaccagaataaaaaccctgatgtttcatatttatagacttgacttattttattttttatttattttttattttttatatatatataatatatatatttatttttatattttattttttatagatttgatctattaatttattaaatttagtaaatgtcctagcttgggctgtgctaacaaagtaccatagactaggtggtttataaaaatataaatttacttctcacagttctggaggctagaagtccaggatcaggatgccagcatggtcaggttctggtgagagtcctctttgggttacaacccacctgcttctccattggtcttcacatggctaaaagaactctagataaattgaacttcaataaaaacaaataaaacaacaacaacaacaaaagagggctagataggtcctttagtcttttcttataagggcactgatcccattcctgaggactccaccctcatgacctaattacctcctaaatacaattgccctgggattagcatttcaatataagaatttggtgggggtggaacacaaatattcagcctattaggtttataagatttagagatttaaaaaaaaaaagacttgtttagaggtttagagtacttttgtttgtcaattttcttctttcatctttttaaaaattgaatggaaggggtgcctgggtggctcagtggttgagtgtctgccttcagctcaggttgtgatcccaggatcctgggatcaagtcccgcattgggctccccacagggagcctacttctccctttgcctctgtctgactctctctctgtgtctctcatgaatatataaataaaaatcttaaagaataaaaaaaattaaagaaattgatgtgaaatttacataacacaaaattaaccatgttaaagtgaacaattcagtagcagtatatttgcagtgttgtacaaccaccacctctacctagctccaaaatgttttcatcatccctaaaggaaaaccagcacccattagaatctgctccccactcatccctgataatccccaatctgcattctatgtccgaatttactcattctgaatatttcaatatcaatgggattgtacaatggtgttattccatttcaactccaactgttgcaacactaactggtgtactacaattcagtttgatatttaacactcagagttagcatcagaaactagaggtttattttttttaatttttatttatttattcatgagagacacagagagaaaggcagagacataggcagggggagaagcaggcttcatgccaggagcccgattcaggactcaatcccagcactctgggatcaggccctgagccaaagccagacgctcaaccactgagcaaccctagtgtcccagaaactagaggtttaaaggcatggtttccaccaatattgtttccacttcagacaccagcctcagtatctggaggtctccaggccacctacactcaggaacatgtggctacaaatgtaagggtttccatgatccctacatttgataattcacaagaatgacacagaattcaagaaaccactatagttgcagttccatttttattataaagaatgtaggtaatgggatgcccagttggctcagtcgataaagcatgttactcttgatctcagggtcctgagttcaagccccacattgggtctagagattccttaaaacaataaataaataaaaagatgtaggtcagtaagagccaaatagggagatataaaggggaagggtccccaacacagagctgtgctctcacttttcaagcacataaatatatttaccaaccaggaagctccattaagcttcagtctagaggtgttttgttttgttttgtttttaaagattttatttacttatttatgggagacacatagagagaggggggcagaggcccaggcagagtgagaagcaggctccatgctgggagccccatgtaggacttgatcccaggcctgggattccaggatcacaccctgaaccgaaggcagacactaactgctgagccacccaggcatcccagtctagagtttttaatggaagtttgattatatgggtttaattcattaaaccactggctacatgattggctccactgccagcctccacccacactcccctcttctcaggagtagggttggctcaaagtaacaattctctaatcatgtggttgctcaggaaattccaagggttttagaagtgcaatgtcaggaacctgggacactgactagataaattctttattacatagcagctgccttttcattttttaaataatgtcctttaatgcacaaacatttttaatcttgatgaagttcaatttaactgttttttcttttgttgctagtccttttggtgtcttatctaggaatccattgccaaatcctaggtcataaagatttaccctcatgtttttgtataagagttttatggtttggaatctaatactcaggtcactgatgcatttgcagttaattcttttctgtatagtatgaggaaggatttcaacttcattatttatttatttatttttacttgtggatatccagttgttacaacatgatttgttgaggagactattctttcttcattgaatactcttggcccttgtgaaaaatcagttgcttgtaaatgtatgggtttatttccagactttcaactctattccattggtctataggtctatctttggtctaatgttacaatctattgagtactatagctttgtagtaagttctggaattaggaagtatgagtcctccaaatttgttcttatgttttaatactatttttatttgggcctcttacaaattcatatgaatttgaggattggcttattcatttctgcaaaaaaagatctttggaatttttatggggattacattgcatccataggttgctttcagtaatatttccatcttaattatattaagctttccaatccatgaacaccagagatttgcttgtgagaattataagtctgctgtcatagatctttgcaatgtttcagaaaattaagcatattaagggatccctgggtggcatagcggtttagcgcctgcctttggcccagggcgcaatcctggagacccaggattgaatcccacatcgggctcctggtgcatggagcctgcttctccctctgcctgtgtctctgcctctctctctctcactgtgtgcctatcataagtaaataaaaattaaaaaaaaaaaaaaaaagaaaattaagcatattaaatatacaaatgttgctggatatatttaaaggaattaaatcagtcaagtgtgtaaataagttgcttagggaaattctgattaacttattatttttttaccttctctctcttttttaagattttattgatcttattaagaagcattagatttttagaaaataaaataacaatgattgggagtttttagcttaacaatattaaaaaactggattcaagaatttgaaacttaataatttaatattaaacaaaacaccagaatcgatcattattcttttccaggcacaagagcccctctcttcttcaaaaataaaaaatctgttgtcatctggaatcttctatgtagaggaagggaaagtctccagggtacacatacttcttttttatttctggtgcatatacttctaacatagcattatagcagctcttagcccaccagagagaagtacaagtactcaattaatttgatagactgaatgaatgcaactgatctttctaaaaaaaatttatatgagtatagttgacacacaatattacattagtttcaggtatacattatagtgattccacaagcttacacattatgctatgttcacccccaactgtagctaccatctgccaccatatgctattacaatatcattgactatattccttatgctgtgctttttattcccataacttattcattccataactggaaacctgtatctccaactctcattcacctatttcacccatttcctcacctccttcccttttggcaactaccagttcattctctgtacttacaggtctgattttttttttttttacaggtctgattttgctttttatttgtttattcatttgagtttgtttgttttagattccacacataagtgagatcatgtactatttgactttctcagtctgacttatttcacttaacatacataatactgtctaggtccaatcaagttgtcacaaatggcatgaactcctctcctatggctgcataatatttgtgactgatttactttgccttttttttaaagatttttattaatttatttgagagagagagcctgtgtgcaaaagaacatgagcaagggagaggagtagtgggagagggaaaagcagactccccactgagcatggagcctgatgcaggactccatcccgggagtctgggatcatgacctgagtggatgggagatgcttaaccgactgagccacccaggtgcccttaccttgcttctttgaaagcacttaataggcacttggtaaatacttgtatatatatgagtaaatacatgtataaaatgaacattttacatactaacaagatttcaaatatattcctcactttgtgctgcagcatactggatttatctttttaactttagctttctacaggaactttatacattctgtaccctcttccgggaacattctttcattcttcttacaagttgtggcttcctgcttttgctcaatcataacttctttgggaagccttctttggtttatttaatcaggccaatctctcctatgatatattctttttttctcctatgatatgttcttcttcttcttcctattttttttttttttttaagattttacttagggcacctgggtggctcagatggttaagcatctgccttcagctcaggtcatgatgggatcaagccccgagtcagggggggaggggctgggggttgtctctgctcagcagggagcctacttcttcctctgcccctctgcctgctcatgctctctctctctctctcaattaaataaaatcttagaaaaaataaaacttaaaaaatatttatttatttactggagagagagagaacaagcagaggaaggagaagagggagagagagaatctcaaacagactccacgctgagcatagaacccaacatgtccttgatctcacaatcctgggatcatgacccgaactgaaatcaagagtcaggcactaaatggattcagccacccaggtgcccatcttataatatatccttaaggaatcttttccttccccaaaccattttcaacataaataattttacaaactgcttgtgtcattctttctgtaattccccctatattagaacttagcccaatgatggcagcagtctgaggctctgtttggaattattattttttcatctaaatccatctcagtgtttagaaaatagaagttacctaataaatgccttttaaaaatattttatttatttattcataagagacacacacacagagaggcagagacacaggcagagggagaagcaggctccatgcagggagcctgatgtgggacttgatccggggactccaggatcatgtgctgagctgaagccagactcttaactgttgagccacccaggcgtccctaataaatgctttttgaatgaatgagtgattgttagatatgtaatatgatccaaaaaaaaaaaaaaaactgtttcagggaattacattagaaaaaagcatggaaaagttatcaagctatcaaaacaattaggtttaaaaaaagaagcttagggcagccccggtggctgggcggtttagcgccgccttcagcccagggcaagatcctggagacacgggatcgagtcccgcgtcaggctccctgcgtggagcttgcttctccctctgcctgtgtctctgactctctctctttctcccctctgtgtgttctagtgaataaataaataaataaatcttaaaaaaaataaaaaaaagaagcttaaggggctcctgggtggcccacttagttaagtgtcagcctttggctcaggtcatgatttcggggtcctatgatcaatttctgcattgagctccctgttcgcggggagtctgcttcttcctctccctctgccactatgctcacaggttcgctctcttctcaaataaataaataatatattttttttaaaaaataagcttaaaatgacataattcccagaaacactactttcattttttaaagattttatttatttattcatgagagacacaggaaaaaggcagagacataggcagagggagaagcagactccctgctgagcagggagctggatgcagggcttgatcccaggactctgggatcatgatccgaggcaaaggcagacacttaaccttctgagccatccaggcactcctaaaaatgtaattttaaatgtgctggtaggcccagttaaaaagtataaagagatgaagttaattttaataatatcctgtttttgtttttttttttaagatttatttatgatagacagagagagagagagaggcagagggagaagcaggctccatgccgggagcctgacgcaggactcaatcctgggactccaggatccctgggccaaaggcaggtgccaaactgctgagccacccagggatccccaataatatcctgttgttaacccaatacatgaaaaaattatcatttcaacatatcatcaatataaaaatgagatattttttgttttttaatatactgtctggaatctagcatgtattttacagtaacagcacgtgttaattggaactcaaatagctatgtgtgtccagtggctgctgaattggacaacacggtcctaaatcagttttctggtttttctctgatctgctctgtccccatgaggctgattttgacctctaagcttgcatcactctgctctcttgcccttaggtttcctgagggcttttgggcaatagaagtcactgttaaaagaccaatctatgggaagagactagtccagttactccacttctaaccatctgtcctctcctcccagctcccccacaaattgggttgctacacttcctctacctaaggccatagtggcctctattcacagccatagcatctggctgcttcttgtaattctgctcccttccttgcttagttgaatctaagagctgccactgggagtaacctcttcccaagtgggtttccctagccctgtacataattatctcttcagttaactctttgttgaatgtgccatctgctagtcctgccaggacagtcactgaaccaagtagctaatgaactattgttatggcccatgctctgatgattttcctttatactggaagtcaatcataatatttaaagtatacattttttttttaagattttatttatttggggatccctgggtggcacagcggtttggtgcctgcctttggcccagggcgcgatcctggagacccgggatcaaatcccacgtcaggctccctgtgcatggagcctgcttctccctctgcctgtgtctctgcctctctctctctctctctctctgtgactatcataaattaaataaataaataaataaataaataaataaataaataaataaataagattttatttatttgttcatgagagacatagagagaggcagagacataggcagagggagaagcgggctccctgtggggagcctgatccagaacttgatcctaggaccccaggatcactacctgagccaaaggcagatgctcaaccactgagctaccagatgcccctaaagtatccattcctagggcagctctggtggctcagtggtttagtgccacctttagcccagggtgtgatcctagagactcaggatcgagtcccacatcagactccctgcatggggcctgcttctccctctgcctgtgtctctgcctctgtgtgtgtgtgtgtctctcatgaataaataaataaaatcttaaaaaatattttttaaaaaagtatccattcttatacatagatattaatgcctgcacaaaaaaaaaaaaaaaaaaaaaccaccccaaaaaaccccaaaacaaaacaaaaactcagatattaatgcctggccatcagtaatttttttcctaaaaaaaaaaaaaaaagtagtgaattagtaaggagtgaatttcagaatcagaagaaaactcagtgccttgattctcaacttgagatactgagaagtctgttagtcatttccgtatttggaatctttctgtttgcaagtgacaaggaaaaaaaaaaaaaaaactccagtggcttaggcaaattgggtgaagcattagggaatgtatgttagggaattccagaagtggaactgggttcagggcttcttaaataagagttccagggctctttattccctgtctttcagttctcccccttcctttaaattggatccactgcaggctgcatcttccgtcctggaaacaggttggttgtcctggctcacaaacccaccagtcagaggaaaggaccacacctctggttgacctagtagcagggttatcattagcagttgactggtctgattggattattcatccgttcctgaactaattggggtgcagggggtgctaagaactggaatgatttaattaaatcagccacacctgaatcaataccatggtctactatgagaaaggtagttcttcaaaggaaatcaagaggtgtttactacaacacaggattccccattccctgtctctaccaagaaatactgatatggtcatttttttttttaattttttttttaaatttatttatgatagtcacagagagagagagagagaggcagagacacagacagagggagaagcaggctccatgcactgggatcctgatgtgggatttgatcccgggtctccaggatcgcgccctgggccaaaggcaggcgccaaaccgctgcgccacccagggatccctgatatggtcttttgaagcttcctgtcattctagggtctagacaagagtggttggtggttgaataaatttaaagcaacattaaaataatccataatttaaatggataattcattttgcatgctattaccagaagatggaaagtatgtgtggatggccataggaggttcaaaatgtattctggaatatacttgaagggattaagagtgctccattgaaaaaaaaaaagagtgctgcattgaaagaggcatgctatgaattaacattatacatacaaactaaaaaaacaggaaaaatggtggggaagaataggatactctttgaaagcagaattttttgaatagagattgtgaggtgatttacatacatacttttttttaagtcattaaataattaaacaaatatgtttccgtgctgtatgccagatttgtttctaggccccaaggaggcaggagtgaccaccatagagaaaagctgaagttcctgtgggaggagacaacacataatgaccctgcaaggctagtattattatcccattttacagaagaaaataattctgagacagtttaagagatttttctcaagacactttagtattaagtagagggactgtggtagtccaaatccaggattgtctgccttcaaagcctctgctttgacagaagaagataacatttatttatttttattatttaaaaaataattgttgagcctcagggcctgatcctggggacctggatcaagtcccacatcaagtcccgcatcaagtcctgcatccagctccctgtgaggagctctaccctgcttctccttctgcctatgtctctgcctctctctcatgaataaataataaataaataaaatctttaaatccctggaccctgggatcatgacccagcctaaggcagacacttaaccaactgaggcacccaggagctccagaaaataaaatttaaaagaagagaaaagcttacacagaggaggggatcaaatcaaggcaatatacatgagccagaagagaaacacatttacagggatccctgggtggcccagtggtttggcgcctgcctttggcccagggcgcgatcctggagacccgggatcgaatcccacgtcgggctcccggtgcatggagcctgcttctccctctgcctgtgtctctgcctctctctctctctgtgactatcataaataaattaaaaaaaaaataagaaacacatttacagaaggaaaaaaaaaacgtgagaagagaaagcgtttgctaaaatcccccctcacctggggaaaaaaccccaggtaaagccagcacagatcttggctcaagaactgtagttcccattccctctctttctttgccttttttttttttttttttttttttagatcttatttatttattcatgagagacagagagagaggcagagacacaggcagagggagaagcgcacttcatggagggattccgacgtgggactcaatccgggactcgatccggactcgactcgcgactccagggtcgcgccctgggccgaaggcaggtgcccaacagctgagccacccaggcgtccccccttttcccagtcttatgaaattcctattttccagtgagaaaactgatgctcagagcgattacacctttttattcaccgctcccccccccccacacacacagataaatcttttagagccacactaggagataaggtttctaaagaaaatatctgggaacattatgtaaataaatggcgtatctttcaccttgtgactgaaaatacaaggttgtattattatttttatttttcttgagagacgaaaactttagcaatacgtcagacagcactgaaagaggatgggggagtaggtttcaggacacaaaacttcccagcttaactgtgtggccgagagggagatcttcaccgtttaccccgagcccggctgagcgatttccctcccggtagttacttatccttgttcctagggggaagcgcagaacaaaggaaggggtgagtggtctaaggacccgagctccccccactcctcaaggcaccaaccgcagcagccgggtggatgagaaaggctggaggtgcgcttccaggcattttgtttggggggcccaggatttaaagtaattcttcaggaagtgccttttactgttatttgctaaaggtgggtgtgcagggggcacctgggtggctcagcggtagagcctcggccttcagctcagggcgtgaccccggggtcccgggatggagtcccacatccggctccctgcgtggagcctgcttccccctctgcctgggtctctgcctgtgtgtgtgtgtgtgcgcgcgcgcgcctctcatgaataaataaaatctttaaaaagtaaataaaggtgagcgtccagatagcctgaccagtctcattcacctttgagtttctattagacatgttgagtccgagctaaggacgccgcccttctgggccacatcccgaggcttgggcgagaggcgggaaagcagccggggtaggccgacctcgcaggatcgggcttttccacagtacgggacgtggacgagcagtggtggcagcctggtcacacgccgcgcggtgaccttgggagacactctgggcacgtccgtaagcgcgagggtcttagctccggtctaaccgttttccgggatgaagtaattcatgaattcagctactatctaaacctcatttggagcaaaagggctgtatcgtgcttgggagggacgacagtgtaatatgaaaaagacgagggggaggcgactgaggggaactcgtaagtcagccccgcgtgaacggacacccgaggaagccccgggccgcgggcccgggaggccggagcgccgcgacgtacgtccccgcgccgcgagctgcaccaccgaagcgcgctcccagcgaccgcgattctcgtttcgtttgtagccgcaacgtcacgatctcctccgcttctcattggacgagcccattcaatcatgtgacttcggcgtagcgtataaatacaggcgaggagaaggcggtggtccgccatttcgtggacgccaggtcagcgagagcatctgcgggagccgggcgggaggggagcgggaagcgggaagccccatccgagagtgtgtggatttgagcgtccgctttctaacccaagatctcggtaagcgactggcgactgaaggagtgtagggggaaatggcatttcagagttgcgcggtgggaccgggcccaatggcggcgccagattgagacaaagagacgccgccgccattttgtgacgttcagcatggggcggtggcgggggcccttggcccatgagagaacgtacctcggcctcgaagtggaggtgttaataatttttccggggcgggaggtgaattgagaagtgggattacccgaaaattgagtggggtgggggggggagccgctaaccgaattgtactccgggccgcggcctttcaatttatggcgcctttttaccgccctccccccacctctcccacgttttctttgaaagcttcagaaattatttttccagtcattgatcgagatcggacctttcgattcatattacgtggtttttgtagtcgtctgtattttaatcttattttaattttttacgcatcggttttttttttttttaaccgaaggatcttccttgagtagcattgttcttgtagcagcttcccgttggtagttaactctgaaactgcttacggctaagtttttttaaaaacctatctcccgcgatgatttggcctcagaacttctgggtatagggtggagtcatgcagataggatgtgtcgagactagattattttagttgagtaagccctgagtgagaaaaacgtgctgtttatgaggagcccttaagccgggttactggattggctgttctttgggattgaaattggtctacaagttgattaaatcatccgactttttgaagattatcgaattaagcccctgaagtgcagtaaatacgtgcgctaagaaccccacccgcatcccccgtgaaatgaacaggagtttcctttattaaagagtgcgactccgtggtatttagtacattcccagtgctatataaccatcctgtctagttccaaaacattttttgttgctccctgtggagacctgtacccattaggcggctgttccccatttcccctgctctcccctggaccctgggaaccaattctctgtctttgggtttacctgtcggatatttcatatacgtagattattgatatgagtgcttatctagaatgttttcagtactcctgtttgaagcatttatcagcactttattctgaataatattccattgtatgggtaatatattctgcttgtccagtttttcatttggctactgagaatagtgctgcggtgaggtacatttttctaaaaaaaaaaaactaatatttgcctgcttgagcaaagctagttaagtttttgcttatggagacctattagtaccacttctcaagcggctctgccttaactactttctggttttgagcattctcatttgtttcttgtgtctccaggatttgcttctgagcaagttaccctgcttttctaagtgatttatttttgagattaattgtaatactagataaagtccctagttcagtgcccagatcatagtaaatggtcctagagtgtctcccctcccttagcttttcagggaggcatttttttttccttaatgtaatttatggtggattcctggtggatatcagtgtagattagagaaatgggtggtttgagggtagtacttgtttcatcatcatttcttaaggatctgtatttcactgtgtagattattgacataaatgattaatgtttggggtatttttatgttacagaaatgcatcgtgattcctgtccattggactgcaaggtttatgtaggtaatcttggaaacaatggtaacaagactgaattggaacgagcttttggctattatggaccactccgaagtgtgtgggttgctagaaaccctcccggctttgcttttgttgaatttgaagatccccgagatgcagcggatgctgtccgagagctagatggaaggtaatttgatgactaatttatactgataaataacgtggtttgtgtttttaatgtataaagttcttaggatttgtggcttttagatgggtgcttgcctgtcggaagtttgtcgttagagacataagtctttgctgtaacgaaaaagcacaacagttttattcaggtgaccagtgaggtttaatggtcaattcttggtgggtgggtttttgtatccaaaatgtgattaaagcattttaatctataccttccacatggtgtcctcttttgaattttctctgaaaccattggaaatcagatattcaaataataatgaccacaaacttggcagctgggtggctcagcggtttagcgccacctccagcccagggcctgataatggagacccaggatcaagtcccacatcaggctccctgcagggagcctgcttctccctctgcctgtgtctcatgaataaataaataaataaaatcttttttaaaatggccacaaactgacggttgtaagtggatggttacattggggtttattataacctctttaataaatgtgtttgaaatacttagtaagtgtggaatatgtagttatttcattttgtgtcctattactggctgatgagtaactcttagaggaaccaggtggctgcccttatccccctccttcctggtctttgaaaaacactggatttcatgagaccaagggaaatgatggatcttaatctttaagatccaaaaagttaaagggtttaggattggctttaaaattgtatgaaaggtcatttatccaggcagggcagatcatagagacccatttttccaggactccactttttccaaatcactgtccaaataatagtggtttatctaaacagatgtgtaacaatgaagaggtgagggagaactttcccaactattctcagctgtagtttcctgtcaattattgtggccgttgaaaggagatggtgatgtaaaatggccataatgctttggttccctgctgttgcttggagagagagagaggagaaagacaagcaaatacagtttaagattaataaaaaagtggtgggatcatgaagtcccagcaggatgtacagatgagctagttcttggagtccaggggttttcacacttgaaatgttgacaacactgaattctgattaagactaacaaagcattaaaatgtaaagaagtttttctttattagaaatacttgttttgctgttaggattttacagacattcgtaagtgtactttgcaaagaagctataagtagaaacactttgctttaatacacctcttagtctggctcttttaagtttaatatttcttttattcttagaacgctgtgtggctgccgagtaagagtggaactctcgaatggtgaaaagagaagtcgaaatcgtggcccacctccttcttggggtcgtcgccctcgagatgattatcggagaaggagtcctccacctcggcgcaggtacttgagagcgtgcttagaggtattggtgtaatggagtagctaatgggagcaggtatttctcttaaagtttgttggtgggttttaaacttggaagattggagatttttacgaaacatttgctgggtgtagtttggggtatgtgagttgtgctgagtgttggcttttgtctttaggtcactgttcatgttggtagtcagtaacttctatcttggatctatcttctagttcatcttctagttgcatctttccaagtcttcccttatacttcaattaggcctttttccatttcttgactccataatgacaaacattacattcaactagctcttcacaaaaatgtgttttctactattagcacgattgtagtatttatcaagcaggcagctgttgtaatgttacaactggtaaagtagaaatcattctgaaactaaagtcactgaccgataaagggggctacagaagtaatcccagtcatctgttcttcaaacccaaataggagagatttcagtttttttgtaattgaaaaatggcatcattcttggaccaggcagtattgtctggatgctaactccacatctcctcaaacctccaaaaatagtttctataaggactgaattttacctcttacaggtgagtgaagtccttctaggagataggagttcaaaatcttgccccttttgctattttgaaaaacaaaacaacacactgttgcccatcataataaagagtatttgttagctaaatagatggttgtactgatggcttgtttttcattttttttttgtgctttttggtccatctattaataaaaatgaaccccgttacagagtcaccatcatgtctcttctcaccaccctctgagtctgcattagccagtcaactagccctttcagcgtcatgtgaccagcgcgccccattcagcttggctggtgtcgtttcacatgacccaggcatggccagtcgtcaggttgcaccgccctttggttcccgagcatgctgttttctctcagccttctctccaaccttaaccaaatcggcagcagccacctcgaccgcccacacattcctggccaatcagctcagctgtttatttaccaaatgtcttcacaacaactacagcagcagccttcggctaacaaaaaagcaggaaaaatccacaacacccccttcgccaaccaactaaatccaacgcaacatctggcaaaaccttttcagcaaattcttcctggccgtcagtccggcagcctcacctcaccatttctagcttgttgaaacccaaaactagtaagtttttcctgcttatacagtttactgctggttaaaataaggagtaagcggcttaaagtaattcttttttctggatcaaaggctggctgtgcataattgaatggtaacgtacatatatattgcttgaataaaacttttaagggtgatagggaactcataatgtaactagaccttcaagtgaaacttatttgcatgtgtgagatgccaaactaaaaattttaataactctaacagatttagctttcctttctagcaaaaatttgttgaatcctatcacctttaaatggttttactaacagttttcaaaatttaaattttgggggtaaagtgggccaagctaaggtaatttttatgaacctaaacacactcttaaatgtgacgatcacaaatgcagttctaatgtagcacttaatggcatcagtatttacacctagcgcgttttcacaaaattacactatccacctggtacctaagtcttgtcatggacttataggtttgcatgggttccaaatactggtttatggtactgtttttggaactacttgtgggactatattttggcgtggtgtttgggtagtgaagttagtttgacatgaagttttgcattggacagatctgctgtgaagcattctttgttaaagtgagtccatggttggaatacctgcttttcacttgagcttttggttccttaatccttctgtgccttttttcttttctgttttttttcccgtttttttttttaatttggttttgttttattttgtttttttggacgatgggtgccagttcttcggcacgttcactgggcccaacagtgagattgaaaagttgggaaatgcctcacgccataaatactaattgacaattagcctaattttcctgtttctgcttttagatctccaagacggagaagcttctcccgcagccggagcaggtaaatagctctttttttttttttttttggccgtgttctcagaagtgacagcatttcctgttcttaaactgttttctaaatggcatggttagtggtaaaaaaaaaaaaaaaaaaaaaaaactttagctttagtaatgaatcaagtggtctacagagtgagccagtgttgtaggaatgagccaacttttagtttttgaagagttcttaagagaggtttgttgtgtataattctaagtgggtcctatttttcttctggttttaggtccctttctagagataggaggagagagagatcactgtcccgggagagaaatcacaagccgtcccgatccttctctaggtctcgtaggtaagacctttaatgacttagactgtttataaactattaaaaacaggaattggttatcttaaaccattttgattatttttattatttttcaaaaacaaaagtccgatacagttgtattactgagttatgtatgaaactttccttttttttttttttctttttagccgatctaggtcaaatgaaaggaagtagaagaccagattacaagaggattggtgtacaggaaataacttcatttgacaggagtatgtacagaaaattcaagttttgtttgagacttcataagcttggtgcatttttaagatgttttagctgttcacatttgtttgtctcttggaacagtgacacataaagatgtatttctctatgatttgaatggatcatatgaggcatgtaataccaagaattgttactttacaatgttcccttaagcaaaattgaatttgttttgaagttcagtcttacattgactgataataaacctctaactctgcccagctaaagcttgacatttaatattatgaaaacaaagccggcagaaattgaaagaagagtctctcacatagctgggctatattctgcagctggagttgaagaagcagtctttaaaagctggtatgagcacaagccagcaggtaaaaatttaagctgcactgttaagctagattagaggtttaaagaaaaactagttttcatactgggcaggcgttgtccagttggtgtagaattggaagtttcaagaaagttagtttacctttgcttttaggtcataagtttcttatgtgattgctgtatgtgaacacacagctctttgtaacattctctatttggtgatttgaaactactcaagataccagtgtcctgccagtttaagggtacattgtagagctgaactttgagttactgtgcaagatttttttcatgctgtcatttgtaatatgtttgtgaaaatccttgggattaaagttttggttacaaattgttgtttaacctgaaagcctatttttccttgcaaaactaaaatctgtgagcttggtatcaagtccaggtataacattcctattggaagccatacttatattttcttgtaaagtgcttttgaattaataaaatattagcataattgtgtaatagtcaaacccactattaccatagttcttgtcccacggaaatcagttggttacacagatcttagaagaaacaattgaggctgaagggaatttttggttgtcacctaagtgactattcatacttaaccatattttaggagtaggagccagttcaaagaccatgatactctgtgaccaacatttttaaagtagagcaaccctggtacattataactgaaagtgacccattaaaaacttttatcattagcatgagacttttccacaaagctttaaaaattgcttccattttatataatttgaggtgttgcatgggaattctaaattgatccatcatgatgtaaaattcactatatggttcaaatgtaacagtgcagaattgaacatggaggcatgcataaccttcctcttagaaatccagaggagttgtaatttcaaattcttgtgcaattagattaaatcataatgcaacagtcttgtggcttagtttccttaaatgttgctacttaaaggtagttttggattatggtgtactaagtttctttaatatgaaagatgagtcattgcattgagttcagtctaaagatttctaaggtgtaggttctaaagaaattatttccagtggtccttcttaacctttcatgcagataccaacaaaggagagtcattggtgtcacaaagtagaattatcaggttcaatatgagtgagccttcgagaagacattttttaaagactgttgatgtcctgggagctctggctttttgggcctttttgctttttggtggtctctcatagcctaaaactattgttcagaacaaggctaaagaggtcatggaagtaatatgctatatccataatcctactgttcttataaatggacattcatatgagtgtttctgccagtatacaacttgcagagtctttaagttgaaagggtttctgtgaaaagattagtaggttatgggtataatgtggctttatgtagaatttaagataaagttgacctcagggagttattctgaattacatgccaaatttataatcactttagtaaccagaagccctagcagatttttatgacttgtaaaaaaaaaaaaaaaaaggctagaaactattaaaatcttgcactgcacatttagtttgtggctattaaaagttgtggctactgcagtttctaaatttgtttcattagccacctgtccctggatctctgagttgagaagaatactgaaaggtcagtcaaaaacctgtagtgtagtgactacaggtaggtgttcacttagagatcactattaacgctggctgataattttaagaaaaccggattacagtttctgtgcttttccagagtaattctctggttctcacttcattgtgggttacttctgaccttcgtgtcttaagcagaaaggttaagataaattagggaaaattatctactgtttatatactttcacagttcagtagatagcatctccccttttagactcagccatatctggatgggaagtcctgaatccttattatagagttaatatggttcatattagtacagtgcttctttatcaggaatggtattgatcatagaagtttttcaaaatatacacagcctgattccaggcctgtgtaccttaaaaagttaacaagcactgttctataaagttctttggaagagttctaggtgataaacatccctgattaaataagaccactggtttagtactttgttttaatttgcttttattttcagtcttgaacatgatttagttgtcagatctagttgatggtaatgtcttccagttatgtatttttgtactagactgttgccttctgggttttttttcttgagaacatggaagatttttataattaaagtagctgaagaaaaactgggttggagtatatttctatcaaaatctggtagtgttaatcagttttctatgcccacacaaatgctcttcatcttatactaaagattctttggaataattcaaaggaattcagctatgcagcacacttgtgaggttctgaggagataattgaaaatttcttttgataaacctaatataactggttgattttcgttttttgctttattgggattgcagaaaatcaggataatatcaagattcatttagtattctatttccttcaggttatttagaacacatgacaacagccaaaacatttcccagaataacatgaaatacatgtatgtagcactagaattttatgtaggtcacagaaaatagaagaaaaactaaacattgagtagttaacaggtatgtatttagtcttgaagtgaaactttctggaaacattgttactttcctagtcattttgagagggccggatatggagaatatttatttacagagcaaaagttgagctttccagaaaaatcttctgtatgtgacattccctgctttctattttttaagtactctctacacccaacatgaggcctctcagcctggagtccactggcatgctctacccactgagccagccaggtgcacctgattttccctgctttaaaagttctattcacttgtaaatggcacctttgttttttcgttatgtatctcattcacatttcatatggggcaagttaggatcctttagggggtggtttttactgaacctgccccaaaactgcaaagccaaaggggaaagttgtttaatgctaccctttttttgggtgttaactatttgtattgatcatttgattttttttttttttttggggttttcttttttagattttatttattcagagagacacagagagagagagaggcagagacaggcagagggagaagcaggctccatgcagagagcctgacgcgggactcgatccagggtctccaggatcgcgccctgggccaaaggcaggcgctaaaccgctgcgccaccagggctgccctgtattgatcatttgaaaaagggaatggaaatgattaataaaagaaactaagttaaaaacagttttaaaagttcttgaaagaattttcagaactaattcttatttcttttaagcacctggtaactcttattccaactggctctctgccaccagaatttctttatatagtttaagttaaaaaccatattaagtttcactgagtgggctttattaataagcatttaagtaaattggaatgttgatctgtcatttgtcactttctcacatgggtagttcatgacacacggacttagtggaatgaggtacagggatgcacatcaccagcttggtatctagaaaatgtaatattttgagttcaagttcaggacattgaaacctaaacctcactactttcttcgtgttccatccattttaggttagggttatttaagtggtgttagatggagggctttacatcccatcagaaagattcttggacctgcctctggccaagttatctccaggtcctgggatccagccccaccgcaggctccctgctcagctgggatctgcttctccctctacctcccgcccgcccccagctgtgtgctcactcaaaaattatttatgctttagaccaagctaataggggcagagggggaatctcaagtagattccacatagcacagagcccgaccccaagatgcggactccagctgaaatctgtcactcaaccctgagccacataagtgcccttcataaaattttacaaagtaccgtaattagagaagttgagagagcagttgagtgtgtccccacactataagggcttggaggtaaagctatgaaggattcctcaagaattgggagtggttgcagttgggatttttttttttttaacttcagttgtacaccaaataagtaggtgtgggataacttgtttggcattagccctggcaggactcccagaagctggatgtaccagatggcactaacacctggctcttgggttcctagctgtttgaaggggacaagaaatttggctgggcttggcagtcttgcttggacttgagttggcagtggtatagaactgtctatctgatgtgaaactggctcccaggagtgagcttaggaggagaagcctgctcttttgtaagaagtagatggacgctgatcattggaggctagaactgaagctttgacagaagttgccttttggagtgctgaaagcttcagtgaagacagttggagtggttaggaaaggaagttttgtctttgagcaccagtctgccaaacattgcagggccttttttcttatgtgatgtttaaccacttgagaggtgaataaacactgttagggcagactcctcctactaaacaagtagtgtattcataacgcaggccagcctggactccaaaagccttgttctctgtttactacgcttcagctttctcaaccccatccaagatgctatttcattgtcattaaatgattatcaggatttggggccttttaatttttgttaagaaattttaattttcgtttttaaagtaggttctgggcaaccctgggtggctcggcagtttagtgccacctttagccgtgctgtgatctggagacccaggattgagtcccatgtcaggctccgtggagggagcctgtatctccctttgcctgtgtgtctgcctctcatgtgtgtgtctgcctctcatgtgtgtgtctcatgaataaataaaatcttaaaaaaaaaaaaaaaaaaggttccttgcccaacatggggcttgaacttagaatctccagcctttttagaggaatttgttaaagtgtttttctagaaaattaggtatgtgtgatgagcaagtatttgctagaaatggtaaccacatgtcccattttttcatttttccacacctggaggtctatatacaaaacagtacatgctgtcatctaggcaggtaccaccagcagtaaggtaagacatttcttggcaaaggccagtgttgtcagtagaagacaaagctgtgctattgtggatgggttgacattctgtatctgtgtttatgattaaccttgtgaacatgctttggctactccagtctcctggtcttaatatctctaattttaacacaggaatgtgagcaacattggtgagtatggcattttagacaagaaccagtaaactttgcgggggttttagcgagctgttaatagagtaaaatgcacacacaattcctttttttttttttttttaatggggtcttacagggagctctgtagaattctgtggctagacaaggctgttgtaagctcatgagagcacctttctggtttgaagaccaggtggctcaagttaggagcttatcctgcaactcctgttagttgcttgggaaacaaagcaggtatatgtgagtgatcacttaggttttgacaggacttgctgattaaagctgttcatcccccaggagctgcagtctattgacctggaagaatgctccattcctttcctcagatgattttgatgaattctcagtaggtggatgaaaggaaaggttttttacgtactcttcacatgcatcatccaagactggttcctgaaccagggtcaactttttggattggatagcagtcgacaggaagaaaatgattaatgttagttatagggggaatgtgatcatcttgctttattgagggggaaatcgaagtacagagaaggctaggcaagttgaactagaatgatgtaactcaggttgcagggccaggtgttggttcacaggaaggggtcttagcatccctagtcctggtcctgtgtagaagtgagaaggtggatttgcctgaggtcacaaggatccttttggcagtatggatatgaggactgctgcaacagctggctagttttagggagcagtgtgatgttaaggtctgcaaggttcttgaagcttgtagccagggtcttaatcctggtttccttgcctctagctcgtgatttcagatgagctgcatcatccctaaggtttcattttctcatctgtaaaacagggctagcaacagaaaacacttcctgttaatatcttgagactagtaatgcagtgttactgtggtaggctcacacttgcatgcagtaaatactcaaggaatggcttttaagtgaaattgattccttttggtgccaggcaggtaagagtgccccccaattcaaaaataaaagcaaagcagttttatatttatttctgtatgaaagtgtcctgtatgactgttagaagccataagaagtcaaatgcttgaacctgcttgaagccatttcatacttgtcctacaggaattaagaatgaaggcccatgtagaattaagaatgaagggacatgtagataccaggataaaaactagagccaggaagtgataatagatcagacttaacttgaatatggtgagagggggaaatcaccttagttgaagtagcaaaaacgtgccaagacaacaggctgctgaactggagaaagaggaagtacagtgttctcacagatacactgggcctgaacaataatgtcaaaaataacttccctattagaagacatggagccggaggaggggagtaaatgagtgcctgtcacgtggggttatgaggttttaagtgaattaatacatgaaatgtgttctaaacagttcctggcactgaaatactgtgtattaaatagtacatatcctttgatagaaggaataagtggcttaagaaaaattgagcagtctgaacgcacagggcattcagttatttctagacaatgtctttatttaatcattctttctataagggccttatgtgagcacttttaatactgcatacctgcagtcggctcagtcccacagacatgggcaatcctttgtgtgccagacatctagtatgcctgtccccgtactctaaagccggttatgttccatggctggtgtgaccggcataaaagcatcaattccccccaaatccactaggaggcagtgctgggtcaaattctttgcctgaggtcacacatttactgcttagaattaggtctccactgggacatctgggtggctccgtggttgagcatctgcctttggctcaggtcgtgatccccgggccctaggatcgagtcccacatcgggctccctacagggagccttcttccccatctgcctatgtctctgcctctctgtctctcatgaataaatcaaatctttgttaaaaaacaaattaggtctccatggactccaaagtcccttcaactgtaacaatattgaccataataaagattatagaatagttagcatctttgaactcgtgtgtcagcattttgctaagtgtttttagatagacctaccaccagctcccttaaacctcctcacttgagggaggtgctgctgtctcattttgcagatgaaacaggcttaggtccaagacccctgtgaaatgtgtagatgaggttgtttgtacttgagctaagtgctgaagagtgggatttggacataactggcttataaagaaagcctcatgcataaaagcaaaaggaaatttcaaggttgtatgtggattggcaagtttaagaccctatgaatcagttcagggttagaatgggagattagtggaaagtcagctagaggagagtttagaggttatcggggatggtgattttcaaagttgaaaactagccaaacctattttggggatgaaatctgaggaaatacataaaacaatttaaatggcattactataagaagttctagggatgcctgggtggctcagtggttggtccccagggtcctgggatcaagtcccacatcgggctccctgcgtggggaacctgcttctgcctctgtgtgtgtctctcatgaataaaaaaaaagctaatttctagtagataataatagctcataaagttaggaaaaatgtttgataaatgcagccttagattgaccttcaacccaatttttcccttattttctttgtagagaagtaaatgcaaatggttacattctttaatgcctcatgttgcagttccagaagtgacaggataggaaggtctacactaacataacctaagaacccagatttaatacgcatatgattgaatgggttattatgtttaaaaaagtaagttgtttaacatgtatatattttaagcacacgtccgcgactcctgcagcacagctgaggcttccttgtgcgcccacagcctgactctgcagatgaagagccccaagtgaaggtttgggggagcactggtcactccgattcacggagctcagctggagccatctcctgcactcagcctcctgacacgtggcccagggctcctcagagtgaccagtcatgacgtcttgtgtggcagggtgccgcagcctggctgttgaactcctgccccaagagggctctggccgctcgcccatctccctggcagataagcctcagacggagagcaaacagtatgcggctccaggagtccctgcagatctgattcagccgtaggtttgtgcccctgccggcccgacggctgtcctctgctcctctgttcttttgtatcacttcccttgctgtggccagattggaactctttttttttttttttttttttcctttttttccaagcttatatttagtactctaaacccaacatggggttccaaccacaactccatgatcaagagcacccattctaactgggtcagccaggcacccccagattggaagtctggagcaacaggcagacacctgtgtgagaatggtgccagctctttgaaggagggtttttcgggccacagaggccttgttggctctgttcctctgggcggctcagggcacggccccatcagccttggtttcagtatcagggtggggcagcgtgaagggtggggcactgtgttaccagggcgcagacaccctggcaacaggtggtggctcggaagctcgggagaacaggtgggcagccttttggggtttcaaaaacaccatttatcagtatttgccttttatttattttttaagattttatttatgagaggcacagacacagacggaggaagaagcagcctccatgcagggagcccgacgtgggactcgatcccaggactccagcatcacaccctgggctgaaggcaggtgctaaaccgccgaacgaccggggatctcagtatttgacttttaaaagaagcagtctgcttagaaatggcaggacgtttagagatttaacttgctctttttttttttttttttccagaaaaacatgcatattaaacgattataaggagagggtttctttttattttttttagagagggagagaggaaggggaggggcagagggagagaatcttcagcaggctccacactccacacagacggggcacgacactgggcttggtcccatgaccctgagatgatttgtgttgaaatcaagagttggacactaaactgcctgagccactcaggcgccccttaggagatgtttgtttcttttttttttttttttccattttttaaaaaatttatttatttatgatagcacacacagagagagagaggcagagacacaggcagagggagaagcaggctccatgcaccgggagcccgatgtgggactcgatcccgggactccaggatcacgccctgggccaaaggcaggcaccaaaccgctgcgccacccagggatcccggagatgtttcttaacacagtataattaacatttttgttattgcagtgaatgcagtgttattgcactgcagagaatgcagtgttagtcctgaagagagggagaatacaatatgcaagcagtgtttttatgcagaagcaaatattttagcagtaaattcccacgcagaagcctttgatggagcatgaggctgttacttaatctggtcttaacagggagcagggccccagaagtgggtttccagagtgtcgctctgatggggagggcttttcacacaggttctgtggtcatgttgcaggagagggagaaggttctgcttttcccagagctggaggtctgaccttgataatactgtcgcacatttgaacactcactcctggggcgcgccaccggggcctcatgacggccaaacctttgactgcgtggggaacccagtctttgcagctgagaaggggaagccacagggcttccattccaggcgtgttgagacaaacctgaggtaaccacgtgtaaagcatcaagtgtgcctggtgcagaggctccgaaagttgccaaactcagcattttccttcacttcggctctcttctgtcctctttaattacatttaattcaaaggtaacccatgaccatggtagaaaaattagagaacacatataaacaacaaaaaaaagtgaacccaaaagcttctggtttttataattttttttaatcctgttttattttgtgtgcctggagtgggaagtttcttcatttgtgtttagagaggtgataatcatggccccactttgcaaatgaggaaactgaattccagaaagaggaagtgctctccccaaggtcacgaagatataggaaggttaagctgatttttgtaactctgggcttctgagtccaagcccagcacttgtgtgtctggaccaggaggggcctcggaggtggctctcagatacctgtgcccaaactctcatgtgtgaggggagctgtgtccttgacaacacatttcccttgggaccacttgaggcacttaacattccccactggagacaaactcctgattcttggcccctagagtcccaggaatgggtgggttgttaaaacccaattacgtggggtttttaggcctccattttgctttcccacgttttgcattgtcctcaggcctgctagcacgaaagtgctgtcctgagcttctccctcactttattattttttaaaaagattttatttattcatgagagacacagagaagcagagacataggcagagggagaaagaagcaggcttgctggggggagcctgatgccggactccatcccaggacctcgggatcatgacctgagccaaagacgctcaaccactgagccacccaggtgcccctgtctctcactttaaagggtgctctgtactctgtgtttgcttttttctggccttcttttctagttggcagtcttggggttcccagtaaatatttccattgtttgctaagggaaacagacactgttttaatggctgaggtaacaaatatgcattgtttcaatggttaaaattgtgcattgaggtggaggtcaagtggaatgcgggcatattggttcctgaagcccactatcataatgctcaagaatgccaaaaagataaagacatcaccccatgaaccccaattgcgtgatgattctatgttatcacctgtgccataggccctgcccttacgctgatccgaatcagattgaggagccctgagggtcaggtgaaggatgacaagagccctttatatactcggtttgcccatctgtaggagagggcagttgggctagaggcagcatttacctcacgtggtggcctgcgcccccttgatgcctacctgggagcagaaggaccacactgttgttcatctgagctctgactcagcctcatccactgcttcaggcagaggtggtgcttgatgggttgccacaataggaccagcaggcagcccacaaggtcctgtccagcattcacatcctaggatctgggaactccaaaaaaaaagaataaggtggtttctttgtaaggatggcaggtcaaggcagtcatcttcctggagggggaagaaaaatgttaaatgcatatagtgggtgacaattcaaccaaggccacatcaggctataacaaggattttgttctatgaggataaagcaactgttagtatttggtcaagattgaagagtctcttaaaacttagtcctcatacaaccttgttaagatttactgtacccattgtacagatccatggaagtgcaagctcagaaaagggatacaatttagcctagaggaaatggcacagccagaactagaacccagggcctgactcctcagacctgtgctcttccagcacatttcagccaacgggggaagcaggcctgatattgggattcaggggggctcagaggcctcttggctaatgtgaatgcccctgaaaaccccagagggaagcatgttcttactcagagagggtcacggtgtcggagaaggatgccgatgaaggccgaagaccaccagggccagcagttgtctccacagtggcccctaggtcacctcgcatcactcaggtcagtagcaagaaagttttacataacaccctcagtttgcacattggggattgacgacctgcggctgcctgtggtgggaagggcacagcattcagagtctggagatctcagtttggctcctggcaatactattatgcaagcctgggcaaattactttgctccttgaaccttggtcttgtcatctgtaaaatggaactaattataccacttcatagggttattatagggtttaaataaaaagagcaataatttgctgaacgcttagtaggtgccaggcactgttcacctgtattaaactcactgaatcttcacagcaaatctcagagaggagatgctattactacctccagtttaggaacgaaaagtaatttgcccaatgttgcatagcaagtaaggaagctggaattggaacatagatactctggctgcagaagtgtaggtgttcagtagggatcttttttttttttttaagattttatttattcataagagacacagagacagaggcagagacacaggcagagggagaagcaggctccgtgcagggagcccgatgtggggcttgatccctagtctccaggatcaggccctgggctgaaggcagcactaaacctctgacctacctgggctgcccctcagtagggatctttgataaatacattctatggctggtgaatcctggacaacagcttttgtttcctcttctttttaaaaattatttgagaggagtgcgtgagcacaagttgggtggggaggggcagagggagagggagaagcagactccccaccgagcaggaagcccgatgcggggcttgatcccaggaccctgagatcatgatctaagccaaagacagatgtttaaccaactgagccacccaggcacccctggacaatagctttcaaagactatttaaggtagatggaacattagaagagccctaggttaccctgtttattcaatgtggaacccaggggtcagagagtgaaaaacctgccaaaagtctggtaggtctggcagacgcgagtgaggccccaggcctcctgacagccatgcctaatcagggggcctatggctcacagtcctgacgttctgttttaggaaacacaactcagaaagtgcattcacttccactatcattaatgcagagtctcaatgaactcttaaggtgccaccaccctcccacaccatgtgtccattaaccctgtcccaggacacatgaaataacacatgtctcaaatggtagtaaaagaatacggcactatgcagtgctcagtggtaatggctacagaaccctgcattctagaacacatacacctagaaagatactagaatgactgcctatggggcaggggactgggagggacccacagggtacaggggaacacataaaaccaggggactatccaggaccaatgttgactgtgtggcatagcctagggaatagttaactcatcccactgcaccaaagggccaaaaatcaaactgagtagaactaagaaacctaatgaaatcactttgcccgaaacatgtcagctctgggctcaaggaggtaaggtggggacacctcctgggctgcctcacacaggcagaggcctggaagagtgtcaaagggagagtcagtcacacctacctctgaggcagaacgtccacaaccccacggaaggagtgaagagcagcacgttagtgtcagaggtcacatggtcacctgccatctcaccttcctcaccgaggtttagccagatccagattcactgttaggatggttctgaggatgtcaggaagacgtggatctaagccaacaatcccctgattgtctgacgactgtagtctctgctgccatagggtcctgctgcacacctacctgtctcctgtgccaacggagtgtgcctgtgagcatcaggcgaaggaagaggcaggtttcaccgctcagcttgcccatctgtagtcgggggacagttggatggagacctcccttaagagcccacctggctccctctctgcctgtggctctgcctctctctgtctctcatgaataaaaaaaaaaaaaattttttttaagggacgcctttggctcagggtgtgatcctgggatcccgggatcgagtcccacatcgggctccctacgtggggcctgcttctccctctgcccgtgtatctgcttctctctgtctctcatgaataaataaataaaatcttttaaaaagaaaaaacagagcccacctggctgcgggcacctacctatagggagagctgggggctccctccccaccccagcctccgcgcggagcctgcggttccgggatcaggccgccaggtggcagcatgggggaagaaagcggggtcccgactccccgctgaggacgcccgcgtctgcccgcggacccaaggagggtccaccgaggtccttcgagagtggctcattgtcacacatgaactgactttctagaaagtaaatcactaaccaccgccgagggggtgactgcgcgcgcgtctacgtgggaaggtctggatgcggatgcgtgttgtgcgcgtgagggtgacaggagacttggtggacgtgagcgaaggtgcgggaagggggaagcagcagctcaggtgtcgccagccaggcggggaggaagccataaaacctgggcgatgtcctccttatcggagagccctgctcctggatggagaaggggagagtgcaaagttcacagagatagtagcgaccggctaatggaggcgtgggcgtggagcaggcccgtggtgctgcaggggggaggtggcgagagccaccagcgggccggaggggctgccgcagccagggactccgggggggactctgggcccagcaggatcacgttccaaccagcccagctttttttttttttttttttttaattcatgagagacccagagaaaggcaagcagacacaggcagagggagaagcaggctccacgcagggagcccgacccggggctcgatcccgggaccccaggatcacaccccgggctgaaggcggcgctaagccgctgcgccacccgggctgcgtagcccagctcttttccagttccccaagagagcccagcctcttgcacagagacagtctgtcctgccttcctggccgggtgtgaggattaagagagccgtgggtgtgatgcacgtagaaggcccccgtacgcgttgagcgtgtgtcttttggttgtggagaaaacccgagagcatgctcatcaagaaggcccttgtagggcccggcccctacctgcccctcgtaaggtcgggcccctgtcctccgcccatcccagccccccagacacgacctttctcatggtggaatgggcctcgttagaaagtggttgcaagtgcctgtctctggggaaggggagttttcagggtcaagcctgcctggaggcgacggttaggccaacaccttccagatcaaacctcagctctgacactgccccctccaggcaccttagagtactgactcacgcttagtcttgttcaagttggcccttgttttctctcctctttattaaggactgggtggggagcatctggtgtcatcagggattactttgaaactaccgcctcactttgggaaactggcttgagtcaactggtcaccatggaatttctttttttagtgcataaacagccaagttcgaagcagctgttaccccatccagggcggaaagcagcctgttggtgtggagctgcctggctcatatttcttgggcaaacagatgccatgtctctcaactcaccagttaggaagcccagaaactgtggtttggagaccacatgtctagttatgtctagttattcaggtggcttcacccgggaagccctccctgaatgtcaaagctacaagataaaggacatgtatagcagctgggtgcttcccttcctaggggccaccccaggaggcagtgagtgctaagtgccaagtcagtgaggaaactttgttttggagccaaagcataaaaagcccccaaccgcaaaccactgagctttttggtgagtgcttattttgtgcaggttctgagcccagggagggcctctgaggggagaggaaccaggagctggaaattcaaagtagtaggaagaattacactggatgggtaaggcccttcaagaggtgggaacagcatgaacaaaggcatggaaataggaatgtgtatatatatatatatatacacatgtgtaatgaagagtttgctggaacaaagtttacaacaataaagatttatttacttattttagagaagggggaggggcagaggacgaagaagagattcctcaagcagactccctgctgagcaaggaggtagaggctcaatcccaggaccctgagatcatgacctgagcctaaaccaggagctggatgcttaactgacagagccacccaggcgccccagcaagaaataaacccaacacacattaactgggtgtcttctgtgtgcttacaactattcaaatcaccaggatgaagtcggtgaacaaaagtccctcctctgtggactagtataacagatatacataataaatattatttgttataataataaatgcaaacgataaatataaataacaatgtaaataatgatggctcacatttattgagagtttactacatgccctttctgttttgttttttaaaggattttatttattcatgagagacacacagagaaagagaggcagagacataggcagagagagaagcaggctccctggggggagcccaatgtgggactcgatcccgggatccggggatcatgacttgagccaaaggcagatgctcaaccactgagccacccaggtgccctgcactgtgctgttttgagtaccttatatttatttattcatttttaaaatttttatttatttgagagagagacagagacagagagcatgagcagggggggagaagaaggctccccactaagcaaggagcctcatatggggcttgatcccaagacccccaggatcataaggcagaaactgactgagccagtgaggcatgccttatttactcatttaatcctcaaaacacccacataaaggaagcctgggtcttgtctctagtccatggatgaggaagcttaggcacagagcggtaagggcggaattcaaacccagagctggggctctgactgtcacacagcactactctggtagtctcagtaagaaggggtgaaaggtcaggttgccaagtaatgtggactggtctggagggtggcaaaggccaggcaggggagtggggatccaatgctttcagaagattaatctgggggtgtgtgtggagtcaattggggttcagaaagcagcacaacctcctggccttactgaagagcgggggaggagtgaagagaggaatcagatagggcttggagcattcttcaggcctcaccttgcctggaattaatgaacttggcagatccctccccatcccaggactgattgacagtttaccgtggattatttttattagtattaattgcaattcatgagggaggagaggtccattgtggtgggtggagccctgagcacacaaggaggagctccaaaggtctcccaggctgggcctgaagactggatgatttgcagcatccagactccttcccagcaaattcccatcagccaatccccaagctcagtgttcaggtgaggggcggaccggctcccactccccgcatctgtgctgccctcccagccctgccctgcaggacccctctagtttcttcatccgaacaccggccccatactggtgggcagcctgttggtcctgtgcatactgggacccccgcttccgtcgggggtgccctcctgctcttgtcttgcttcctgcccactgccctgcccactccggactcggaaagcacaagccagctccctgtttcaacctcttccagttttgttgttgttgttgttgtttttagattttatttatttattcatgagagacacacagagagaggcagagacacaggcagagggagaagcaggctcctcgcagggagcccgatgtgggactcgatcccgggaccccaggatcatgccctgagccgaaggcctatcctccaccgctgagccccccaggcgcccccaatcccttcgagtttcatccatgtttcctcggcaagatcccactgtggcttcagtaaaggcagccagcttgagtccctggctgccagcgcccctgcccacagctgcgagggcgccccgttggccaggggcggcgccaagccttcccctcgctgtcttcagccccagggaaaggcccttctcctgaaaccccagaggggcttggactctcaggcactggccccctgcacagcggggtccctgtcctctcacggtagtgtccctcttgcccctaccttctccctccctaactttcctcacaccctcggcaccctcaaagccaaggcccacaaggcccacatgcccccgagggcggtaggggccaggcctcaggtctcccctgccccggcagccttgttaggaacgcaccttaggatcgccctttaagaacgtcctgggcctggcagggcccttgagggctggggattcccgcccgggaatttctccaatatcctaccagctgtttctgctctttcagtggttttattattttcctttctgttccaacctctcctttcgctttcagtacggcaggtcaggccaaatggcggtggagggtggggacctggcatctgcggaggccggagctgtggccgggccagctgtgccaagggaggggatgggatgaagaaggaaacagggaagtgagagcagcagcagggtggcctcctgtcttcctggggatctgcacgtcactgggctctgggcacacggcctcgtcttcttctggcccccagtgaaaatgcacatctgccctttgggacagtgacacattaacccagtgacaccaatccgccagtcagatgtgctcgctgctgcctggggaggagcatccaaggagaggggcgcgcaggacacatggttgtgaagagggtaggaagggccggggacttgagcacgtgcctggggatgtgccttggcacctctgagcagcaaggaggtgccaggcagccagggattcgggcaatagcggtgtacccctgcctaggaggacttttgttttccccactgcatgattagactctaagagggtgggatcgggtgactagggtcccttggcgagctcatttccctggtgtgattttggcagcacatcgcagtacctgcccgtgtcattggatctccatgggtccaccgggcaacttcctgatgggacaggcctcccgcttcagataaggatgaaactcagctgcgtgtaacagaagattgaaccaagtggcttaaataagagaagctttcttttcctgtcatgcaatggaactgtggaggcagatgatcctgagcattttaaaagcaagactaaaggaatagatagccaggtacccgtcatcttcctgactctacttctaggcattttcccaagcaggcagctcattccacttggagcttgattgatgcacccagtgtgggcttccttccctccctgtctcacgtccccatggtcccacgagtctcctgagctccccttccaagtccttgttttggggtctgcatctccagggaccccagccagaatactaaatttttgagtgcttactgcatgtgaggcattctctcatttcctcctcaaccctaagtgatgggattcaatggttaagcccgattttagggatgaagtcataacttgcccagggtcactgaccattggggccaagactcaaaacaggctgatcttttttttttttttttaagattttatttatttacttgagagacagaaggaaccaggggaggagcagagggagagggagaagcagactccctgctgagtaaggagcccagtgtggactcgatcccaggaccctgagatcatgacctgaactgaaggctggagcttaactgactgagccacctaggcaccccaggccaatcattttgtgcttatttccttgggatgggttcctcaaccagaatcatgggtcagagagtgcacattttcaggcttttgacctgttttgccaaactgcctctgactaaagtcaagtccaagtgctcctctcaaccagcagtgtggggatccctcacttctcatgtcctcactgccaagggctcccgagtctttccaacccagctcctgtgagggcattcctcccacatttgacttttttttttttttaattcagaaggattaagttttttaagagtgggagagagagtaagagagaggcgaggggaggggcggagggagagggagagagactcttaagcaggttccacgtacttcggggagccccatgtggggctcgatctcacaatcccaagacgatgacctgagccaaaatcaagagtctatggcttcactgactcagccacccaggtgcccctagaaagcattaatattaacaagcctgttagccttatgctcacagacaggcagcatgtgtctgtgagttgaactgaaaagggatggagccaagttcctgacccgagcagaagagtcgcttcctgcctgcccctcagctttcctgggagggcaggttatgcccatctccccgccctggagcctagagccggtgggcggaggtgtgcgggtgggcatacaggaagaagagggaaggatcgaggagggaagggcccctggggagggagtctttgattgcacagccttggactcctccagaacattccttttcttaacagaaatactggtgagcggagggtggcagtaccccagcccccatctcatccccttagatgtttgaagagccaaccagccactccccaacctaggcgtgccaaatgcctgagggtggcaggcaggcatgcaggcagctggagggagacacaggaatccctccctccccagcgtgtgaacacggttcagatgtcctcgcttggctctagtttcgggctgtgcctgcctgacctctttccaataaaactctcctactgggctttatagtatcccaaacacgttcacatcagggaactcctttgatccttccactaccttaaaattatccccattttacagatggggaagctgaggctccgattaaaatgatggttcaaagtagtatgctatcgctcaagatttctgtcgcctcaccgactaatggtcacaaaatagtagtgatgacaatgtccattcaaaattatcacacgcaggtactgtgtgaggctctttgccttaggaaggttgttttccggtcttcacaaaaccctctcaggtgagtagtcacctgcctctggcagagctgggatttgaacctgcgatgtccaactccagagccagggcttctcaaagtgtggtccccagaccaggatcttgtaagacatgcgcattctcaggccccatcccagacctatgttctggatcctgggccggagcctggcaggcttgggtttaacatgccctccaggtaattctgatgcactctcatatttgagaattgccgtcctaatacattcctttaactcagtgcatttcaaccctgactgcacagtagaatcacttgggaactttaataaataccaatgctgtgccagaccagaatctctggggtggggctccggcatgagtattattagaagctccccatgtgcactcctcagcctttgatatgtgccggggtaggtgggccctgggaggctccacattttaccagaaggttctagagtagagttaacagggcagcctgttccagaaaatcctggagggaatgaaggaagacttggagtccaggaaggagagactttgggggctcagcacctccttcagatgactccatgcaggcccaggaagcctgcagccctgctggggcccagagcgccacaactgtttgtcttggcctttgcccaagcaggcggttctgtgtggagctgcagctcttttgtttgtgtggtttaactgttggcccagtttttccagggctgattagatatccctgtgagcagtataaccactctgggggtccacaggattcccgaaaaggggccagagtggcagtttccccttagagcccaagcaaggtggggtctggggagcagtctcctgcttctaactatatgactctgagcctcaggttcaaggatgcaagagtttatcagtcagggtccatccaggagacagaaaacacaccagtgcttttcccagagagaacctaatatgaaaaattattaattaggttctgagggattgaaaagacagagagagaatgctggagggtcccagggtcccaagcacaagaagcagtagggtttccttggggcctgaggaacaaagagaaaagtttgcaaactttagcagcatggaggaccttttccagagctgaaagtcagatgtctggggaggagatgcaagctgggaaaccatgaggctggttccacaagtgttagagaaaaagcaaagctggaattgggctcatcgctcttcttggaatgaactgctgtcatcaggtggaaaaagccttgctcgggtcagatgttggggcagctgggtttctggttgcctaacttctctctacctctgtggaccctccctcttcacctcaggctcactctctcatctctcagtttacttcttttcaggaccaatcccaaacgttgctgattcaaacaatgaacatttactgaacagctattatggccccggatctgtggactggatgcctgagatgtagcaatatttagtaatagtaatagcacccacattcaccggagtgcttacctgcctggccctgctctaagcatctccctcccatacagtaacttatttctagtgccctcatcttacagatggggaaactgaggcacagagccacttggtaacttgcctaaggtgattatttagcttgtgagtggcagagcctgaatatgaatccagtcagtgggattccactacccgcattcttcaccaagtcacctcatcacctcaagtcctagagagctagacatgtgcagtcagctgactgcagcacaggtacagaatgccacatgggggggcctcccagaggtgggaactcatttcacccattcattcaaataaatctgtagattggggtgtaatgatgagcaaaaacattctacctgctgttgggaagcttttagtgaacacacagatgttaatcagattttcacaccccaaaaagttagctcccaaacacaggttccctttgctataaaaattgtaatcagagatttgttgcaaatgtaaaaatgagagggccacttcatggagaatgtgatgatggggctggggcagaaaagatgaatgggagttaatcagataaagaacagaaagaagggcggtccaggcagagggaacagcatgtgcaaagcctctgagacatgggggcagggaggaatacaaagacaatgagaactgtaagtcaggcccttgaactctgaccagccgaccatggccagcgctcccaggcatggagcccacctgctgggacccccaccactccagtttggggtcctatggccaacccttcctgcatcacgctgaaggctggccatggcccagttgtgtgggtaccagcctctgtccacttcaagtaacaggctagcctcaggggcctctggagggaggtctgaaaaagcaccaaagctggaagttggtcaagaaaccaacagggacagtcctgttggatagggagggggcacatccccagggagtctgtgaagagtgagtgaatgggggcgccatccatataaatgacctctgtaaaaagaagcctgggcagctggaggctcgaatgaaaggtgatggctccctcccacagccaccagagtctctactgggggtcttggagcactcagctcataccacttaactcctactccttgactaggtggggaggcaatgattaagcccattttatagggcagcgtaagaaaaggcaaggctagagaggaaggaaagcttgagcttggggctgcttctcagcctgaccctttcgggagggagctgggcctttaagaatgagattctgagaagccatgcagaggtttcaggcgagatccagaggctctgggataagcaggcaagactctagctccctaatgggtcagaaagggggccagacagacgagagcagagggagacacacttcctgtccccagggccctctctgccctgtttacagaaaacaaagtgcctttggctgactctggactggtttccctgaagcaattagagcaaccactgttcctggtcctcctccccctcctgtgccatctgagggagcggctgtcagcccaactgggggccccatgctggcatctgttgggatctgcaggcctggggcccccacaatcctccacccccaccccaggcagcactgaatgttgcctaaagccgtccaagtttccatgggcccaacctaatagagactaactgaaggctgtgtcatcctcatctctgggaatatctgatgggaaggcacatcattgaatgggctcctctggttcccaataggaaagcaagcccctcccttcctgactccccttgcctgcctgaggtaggtctttcagcagaaccatctgaccagaggccctgaacaaagacaatttgaattctctgagcctcccttcagggcaagggtgagggcatatgctggaatccccctgctgtgccttgttgggttggggggccctacgggatggcaccacccatctgccctacagactaggccctgaggctactggaagacaggggaaccacctgacagcatgacaagggccagggcctagggtcttgggcagaggctcatttgctaacagaggagcagccctcattcatttgtgagggtcccctgaacacctgacatcatctttcctaccagcctgatgtattgcttaggtggcagaggcggcttctttctccctcctctactttgctcccaccaactagcaagagtccgttgttaaatattcaggaattctgtgagctgattgttaagcagagccattactgaaaattaaattatgtaaaccagtgtttctcaaccgtttgctcattattgcctactaaacagcctttccaggcatttccccccttaatatcctaccaccctacccataaaaatttaatgtcacagacaagctgtttatgcactgaatgtataactgtacttttattttatttatttatttttaaagatttttatttatccatttaagagagagagagtgaaagaaagcatgagcagtggggagagggagaagcaggctcgaccccaggatcctgggatcatgacctgagccaaaggcagatgctcaccgactgagccacccagatgcccctatctatactttatacataaaaagagtaagattgtttctggcctccaccaagaacccattttcaaccctgttgtgaatgcaggatataaactcacaattaaaaaattcatattaaaaacaaaagtaatatatactcaaaactcatcacttcctagttattttactataatttttaaatttttgattctctcaaagttattgatatatcttttttttttttttttttttttcctggaaagctggttgctcaacatttaccagcaaaccaccaggcaggtcttttagcaaaataacaaacacttcgagaagtgatcgattttaattttttaagattatatttatttattcatgagagacacagagacataggcagagggagaagcaggctcccttcaagaagatgtggggcttgatcccaggaccccgggatcacaacctgagctgaagccagaagctcagtcactgagccacccaggtgccccagagaggtgatcgtttttagtctaagaaagatcagtttatctagaaaaacctcacttgaagaatcatgggaggacctggagaatttagtggatgccaggagaagggggagagaagcccgaagacggaaacaaacctctgatgctaactctatagtggctgcagggtatgtctgggtgaaaagtctaaaagggaggaaatgtgtgtgtaatccacaccctcaagctccaggagtgtttgtgattagcaattgcttgcttctacctcaggtgtggtgcacaccttgaccccctgttagaggtcaggggcataaccctgagcctccccccccccccccactgtcccatctcctccccatgtccagtctagagtgttctgtaaatacctgaattgaatcttggctccaaggggagcaccgagaaagccatagtgcggcctggtctgaggacagggaggacacgggacattcagacacagacgcacgtggtgcaagcttcactcccgtcccctctgagtgccctcgccatgaaacaggagaacagcctgagttctcaggagggccttccagctcagcgcctcagcctggaaagccgtctcctctccctccctctggacaaggctgctaggtccctccctcccaggcactgcctcttgtcaccctccagcctccttcatctcccttctgatgcaggcagccttagaatgctcagcctggctccatctgcttcttggaagaaaggccacacatgagaaggtggcctgggaactcaatgctctgccattacttgtcatctggcagacccctgtctcaacaccagctccctgtttttaacacagtacaaggggcgcctgggtggctcagtggtttagcgcctgcctttggcccagggcgtgatcctggagactcgagatcgagtcccacgtcgggctccctgcatggagcctgcttctccctctgcctgtgtctctgcctctctctctctttctctgtgtctctcgtgaataaataaaatcttttaaaaaaaaagaagaagaaaagaaagaaaagccaggggcagcttagagaggggcgggggtggggactgggccctcaggggaggacctgagtgagcagagtccctttgccaggccaatggcctttggctcccttgggttctttcctgtcttcgtcctggaacaagtgacatgactgcgcggggcctctgtttccccaactaaccaaactcacaggtgctgcggagattaccagggaaccaaagaacctgcaggtacacacccactgaggtaagaggcagtttcttactttatcatttcattcgggtctgtctgccggagtaggcagattgtttctttgtctgctatacgtcaggagaaaggaatgaggaatgcccgtgcccctcagcccgcgggaatccctggctgggggtgggccaggggctgggggtgggggacatccagaaaggcatttcagaagctaaatcccaaggagagcctctcttcaggattttatgcagataaagccaaattctggtaaactcttaagagtttccaaaggtgagtcagtgtccccagaggtcaggaggagtagcctgacagaggggtctggccctccctactctggctgggttcccgggaacatggcctgcaagtcctgagtcactgctagtggccatcctgggcccccaggagcgtgggctgggacagaactcccctccccgccaggcagtcccaggagcccgctgggcgggcaagccgtccctcagccaggccccttctctgcgcagcacacctctcttctctgggccaatacctttctgaaatgcatgttggcaaacctacttccaagcagaaaacttggacgtgagtggaatatctggaattcctggaggatttatagcccagcaactgggacacgtgtgggtagttgaccccagcccttccccagctctgaccctgcctccagctctggcagccggctcccttctctggccccagagccccatgtcggtcacctggcctgcatcccccggttcagagcagacagtgctggatgcacttcctccctccgcagctctgcctcaaactctctgtgcgaccgcggacagtccacctcccctctccagacctcggctttctcaccgtaaaacagacaggctaatcagaggcgggttactgctagactgttcgggaagagtcagaccttcccctgttgtctgtctaaaattctaggaaatggagaccgtgctggttttctccctaaacagagatgagcccctgtgttcctggggatagagcgggagcttctgaactgtcagaccagcttccggggctgggaatcttcggtgggacaggaggcaggcatccccctgcgcccccaccagcagggcgcgggctccgggctgcacagggtgtgctcaaggccagggcccagaggagggaacttctgcctcgggctgtcctccctggctatactcctttctcctcctccgcctccgtgcagacacccctcccttgtgctggggatgtccactgtcctgggctgatcggagggacccccaacctttacccactcagatctgtccccagaaagttgctgtcacccgccactcccactccccccgccccccgcagcctgtcacccacctggccagctgtcctttgtgagtcaggagaccaacagatattcaggccctgtggcttggaattttacttggtaaaattaatccgcgggacaccggggtggcccagggcctgatcctggagtcctgggatagagtcccacgttgggctccctgcagggagcctgcttctccctctgcctgtgtttctgcctctctctctgtgtccctcgtaaataaataaataaataaataaataaataaataaataaataaataaataaacaaaatcttaaaaaaaaaaattctcaaaagagttgccctcaaatgttcttcctcctctgtgaaacctgtcctgcccactgccccggttcccatgcctctccccacttcctccaacagcagacattcaattacttaatcatttacccattcaagtgcattgagtgccagctacctccctggtgctctgctgggtgctggggatgaggagagcaaaaccagacccagctccccctctgtgggggtttaggggccactgggcatgggcaagggctcttcttacatattccttctcttgccccgccccagccctgcctgtagccccagcccagctccccaggacagcaccctgtctcacacatctctgtagctcagcacccagcaagtgcccaacatctaacaggccttctgtatattgcagattacatttgagtaccctgaagggagattggtttgtccctgaagttggtcctgactctgttatttagggataacagaggatagggaaagtaattaagactagacactgggttaaatcatatgttgcctgctgcccagagggtgcagtttggctacagctatcaaaactagaaaatgcatctacttttgggctcagcagttccactgcaccaagcttattggacagatggatgctcacacatgagaaatcatacagatacagtgtctgcccctgaagtattgtttgcaacagattggccacaacttaaatgttcatcacctgcttgatgcattgtgttaagcccatatggagcacaatcctatgcagtgtgggaaaaaagaaaaaaaaaagaataaagaggctgactctattttcttatttaatttttaaataagctctacacccagagtgggtctcgaattcacagccctgaaatcaagggttgcatgctctactgactgagccagccaggtgctctgaagagctttctctggatataaataggaagacctgagaaaggtgtagaaagctgagaaagagtttagtagtttatttagtgtaaaagctggagtgatggggaaggaatgcatttaaatatacatattttgggaggcacctgggtggctcagtggttgagggtctgcctttggctcagggtgtgatcccggggtcctgggttggagtcccacatcgggctccccacagggagcctccttctccctctgcctatgtctctgcctctctgtgtctctcatgattaaataagtaaaatcttttatatatatatatatatatatacacacatattttttcaatatacatcgaagggtcctcaggcaggagtcataggaaacaggtaacagcgagcaccatggcagggaaaataggcaagtggggaacaagatgggaagagatctttccactgattagtcttcaaatccttttttataaagattttattaatttatttgagagaaagcatgcatgcatgcactactggggggaggggcagaagaagaggggcagatggagagagggaaggagaaggagagaatctcaaataggctctctgctgagcccctgtagtagggcctgatctaatcaccttgaggtcatgacctgagctgaaaccaagagctggacactcaacccactgagccaaccaggcacccctgcctttgaatcttttgaatattgtactatctaaatatgtgacctgctaaaaattaaaatacattataaagactataaggtaacatggaaaaaaagtttgtaggacaggtgggaaaaaagctaaagaaaactcccaagccctatattcagtagggttataaatgggtggtaaaataaatgcaggttaaaattcccatctgtagggatgcctttggctcagggcgtgatccccggtcctgggatcgagtcctgcatcgggctccttgcaaggagccttctccctctgcctgtgtctctgcctctctctgtgtatctctcgtgaataaattaataaaatcttaaaaaaatttttccatccatagaagaaacagtctgggtaatttttatttccttccttttttttttttttttggaattttcctcacaaatgttttattattagaaaaaaaactgaaaaaaaagaagaaaaacctgtgacaaaagaaaatagatatttgctaagagaattgtgaattctgtataatctcaattatggaaacaaggttgaaagaaactggaaggaaatatgcaaaatgttcacagtggttgtcatgagatattaggtaatttttaaacatgataatatttttgtattattttcatgacgaaaggaatttaggaagaaagtgagggagggagggagagaggaagggtatctagtggaagagagttcttcaaaataacagttgtgttagggtagtaagattatgagtcatttttgttgttttgttcagttttccaaacttttcattatgtggttttgttgttattttagcaggaacggaaccctcattgctgtagagtgggattttcctccccaaggtcctgctgacttgtgctaaggggctagagttttctaattgcttgctattcaccccaagtcacaaagcaagggtttgctctggatggtgggagattgctaccggtggacatgttgctggagggggggtggggggggagagagagagaaagagagagagagaatcagagcaccttgcacctttgggtcctttaaatatcttagttggcaaacatttaaggaactctgactgctaggcttggtgctgggagtatagggtaccaatacccagtcccttgcccttcctgggctctaggctctttatggcatccaggatgtttcaggcagatagaacaggggtcctcaagaagaacctcctctgatcttaccaggccttgtaggcagtatcagacttggacaatggacaaaattaggcctacaattagtcctgatcaagggttggaccctcactagtcctgaactgccttgccacagtgagacacttgtcttcgcagaatcttataatctactagacatgataaagcaaactgcccagcaaagattgtggtaatccaaactggagagacctggattctgattctgggtctgctgtcaaccagctatgggatcttgggtgggtaatttcactttatgagcctcagtgtccttatctgcaaaacggggagaatcataataataatgaatagtacctgccctgactacctcccagagttcttgtgaggatcaagtgacataatgtatataaaagcacttaagggcagcccgggtggctcagtggttttgcgctgccttcggcccagggcatgatcctggagtcctgggatcgagtcccacgtcgggctccctgcatggagcctgcttctccctctgcctgtgtctctgcctctctctctgtgtctctcatgaataaataaataaattttttttttaaaaagcactttaaaagtataaaggttgggggtgcctgggtggctcagttagttgagtgtctgccttcagcttgggtcaggttcctggggtctggggatcaagccccatgtcaggcttcctgctcagcggggagtctgcttcttcttcttcctctgcccctccccctgcctgtgttttctctctctgtgtccctctcaaataagtaaagtctttaaaaaaaataaagtataaaggatgtccactgatgaatggatacacaaaatatggaatagcgatacaacagaatactattcaatcttaaaaattaccaaagtactgatacatgacaacatggatgaacctcaaaaacactatgctctgaggcacctgagtagctcagtcagttgagtgtctgactcttggtttggctcagtttatgatctcagggtatgtgctcagcagggagtctgcttgaagattctctccttctgccttgccccccactcatgacacacaagcatgtgcactcctgatctctctctctctcaaataaatacaaaaatcttgggaaaaaaaaaaacccacatatcatgctcagtgaaagaagccagacactaaaggccacatattatataattccacttatgtgaaatatccacaataagcaaatacacagagaaagaaagattaatggttgccagtggctgggggagggagtggtgtagagtgtctgcttgttttttttttttttttaagattttatttatttattcaggagagacacagagggaggcagagacacaggcagagggagaagcaggctccatgcagagaacccgatgcgggatttgatcccaggtcctcaggatcatgccctgagccaaaggcagacactcaatcactgagacacttaggtgtcccaagagtgcctacttaatgggtacagggtgtccttctgaaaagatgaaaatgttctggaactaggtagaggtgatggttgcacaacaccgtgaatgtactaaatgccactgaatcatacacttaagtgcctcaaacagtaaattttatgttacaattattttaccacagttttttaaaacttaaaaatggggggggggcacctgggtggctcagaggttgagcatctgccttcatgcccgggacatgatcctggagtctcaggatcgagtcccgcattggtcccacattgggctcctgcaaggagcctgcttctcctttttttttttttttttttaatttgtatttatttatgatagtcacagagagagagagagagagagagagagagaggcagagacacaggcagagcgagaagcaggcttcatgcaccgggagcccgacgtgggattcgataccgggtctccaggatcgcgccctgggccaaaggcaggcgccaaaccgctgcgccacccagggatcccccttgcttctccttctgcctatgtctctgcctctctctctgtgtttctctcatgaataaataaataaatatctttataaaacccttaaaagctgtataaacgattcaaatctgaatttatcatagttattattttcataattagtaatcaaacagatttgatgtcccgaatttcagagttttgcatctgaaccagagtagggtgagaagcgactagaaaaaacaaaaagaaaaaaaggaaacccccttcgcattgtgcagagcctcagggacatgaaccattcagtccaggagtggtatgaccagcggggaaacccagaatgccaaggccagaggagcacaatgatctgggaatttcaaaatccatctgcgtgggctcagcctttaatttggtggctgtgctgtcactgaggaaagatttatcccagcctcctgcaccccaaactgtttcccagccagactggaagagtgcattctggttcctgctctgaggaccaagggcagcttcccggaggtaaaggggcccaaacctggcttagtgcccaagggaccccagatccgcaggctgaaagcctgagagactgtccggagaagacttcttgatgacatcgatgtgacacttcgacgatgtgatgtgttgttaacaagcacaacgattcactgatgggacactcagatgtgcaaacactcagatgtgtttctttttttgttgttactgatttaatcggtctcaggagccccagctcagggaatggggggcagccagcaagggaggggacaccttgccagttaggcaccttggtctgcttccatttaaacagcacctaacagatatatattcagtctactcattaacaggggcacttctgctctccttccaccccccccccccaccctgccccatgccaccttgggaaagggtcagcaggcacacaggaaacccactgcttctcccgcccctttgcttctcctccccccacaatgcactggagttccaggggcagacacactctctctgccaggggttcccgagtttctctgacaagaaccggtacttgggtactggtttaaaatgcccattctggggatccctgggtggcgcagcggtttggcgcctgcctttggcccagggcgtgatcctggagacccgggatcgagtcccacatcgggctcctggtgcatggagcctgcttctccctctgcctgtgtctctgcgcctctctctctctctgtgactatcataaataaataaaaattaaaaaaaaaaaaaaggaaaaaagtctcccaagccttgctttcaagattattgtcttgcaaggagcccccttgccctttccaaatccattgataaagggaacttgttagttgaaagaaagcaaatgtgcctttgccatacaaactggtatctgctcctcttttgccagtccagaaatccgtggattctgacctggagaaccccagaggtcaacatgattaatggaactgtgcttcttctttatttaatattttatttatttgagggagagagagaaagagagagagagaacacaaacagggaggaggtgaagagggataaggagaagcagactccctgctgagcagggagcctggtgtggggctccatcccaggacccggggatcacaccctgagcccaaggcagacacgcaactgcggagccacccagtcatcccttatttttaatttttaaagattttatttatttattcatgagacacacagagagagacagagacatagacagagaagaggcaggctccctgtggggaacctgatgcgggactcaatcccaggaccctgggatcaccccctgagccaaaggcagatactccaccactgagccacccaagtgcccctgtaagggtttttttaatggctaagataccccttccctccttgagtttgaggcttcttggaaatcacctagtccaatgttctatctggtaggtgtggagacggaggcttggagagtgaatgacttgtctaaggtcacacagctgatcagcggggctgggaatggaccccaggcctgggactcccgatccggggctgctccccaccactcagtgccagcatttgatgtgcgatgttcgacattcagctgctgtatagagatgctgctgcacttcctgaggaccacgggtcttcaggggacggagatctgccccatggtttcataatttcactgagtgctgaaaatgagaggggctcacccaaaagcgctgcttcagtgttgtgcatcataaatttctattcattgatttctaccctgcatggtttttggctatgactccaaagcatttgcagcctaattgttctgcagatttttaggcatcaaaaaaacagtgaggctggtagcccgatagggggtggggggcatctccagacccatgcaggcttgtttcacttttgcaaggtgttaagccctgaggcagggaactcctttgtgggaggtgagtaatggaggtgagaagccttttgaccgccagtcacaggatctttgtcccagcacatttcacaaactggaaggggaactccaactccaacagggaggaagaaaggaagaacacgtttagtgagcagctgtgataagccagaccctgtgttaaatacttaacagatgtaatttaatccccaccgttgccctgcaaggctggtacgattatccccattttacagatgaagaaatcaaggcttagagaggataagggtaatttgcctgaagtctgacaggttttaaatgagctgacatgggatttgaacgaagtctgctcgactccagagactttgtatataggaggccacagagccttcaaggggggaaatgccacttgcagactttaccaaagctggcagctcccatcatctgctcccagacacagttcctcttcctccttccctcgttcctgatcttcccctgggctggcagttcctttttttttttggtcaacagttataattgtttttttttctttatttgaagaataaataaatgacaaataggttaagaaatctcatgaagcgttcctatatgccaatggttatatcacactgtttatctacaggaaaaaatcctgttactgcttttcctcaatgttaaatattgtaggaattctcatctttaaagctcctgagtgtagcactggacagctatcaacaacaggacaaaagtattcttttcctggtggaccctccacccaatggaaatgttcctaaagctcccctcttggcctcattccgcaggctgcagataacagggtggagtgttgggggcctcactgtgtaaaagatagatatcacaagggcaaaagctggggagatgctgaagttggctttagaaactaaaaaatggggatccctgggtggcttagcggtttagcacctgccttcagcccagggcgtggtcctggagatccgggatcaagacccacttcgggctccctgcatggagcctgcttctccctctgcctgtgtctctgcctctctctgtgtgtgtctctcatgaataaataaataaaataaaataaaacagaaactcaaaaatgcctgtgttgagaaggaatgacataagagaaaggcagggcaggcaggtggaggtgacgctggagaggccagtggaattgaagcggggagatgcgatcagtgacacgaaggccaccaccccattactccaaggtaatcattggagcaggagagctctgtcaacgggggggacgtttgggcaggcagctcctgattatgtgctgctctcgtctggagcttatgcttgtgcccagtctcagccttcatcttctggccggaatgagtgaacagccttactgaggaggtgttctagagacgtcatgcaccgcatgacccacagccttgggagggtgggacttccctgaaaacctgccctccaggatcccagctgattgctccaagacacacacccgaccaaggtcagctcagcggcgatgagcccagctgcttatactttgtgggaccttgctgagtaaagggagctacttcaatcagacgccttttcaagaactgggaactgagaattccaagaatggccactgaatcagtcacagcacctgaattacaaagctcgtggtgtagatagggactaggaagtgggaagaggtgatgaaacatttctgaactgatgagtaaataaaccaagcctacggaatgagaaaagagtagagtatgtgtgcagggtggtggagaaaccacagatacctatatatggcagtcgcagtttccacaaggccgagctgtgcagttcctgttcttggattcccataagcttgctgtatcctttcattaaaacccccttttcctgaggtaaactgaatgggttccttctttcttgaaaccaaagaagctttgtctagagcaggaggaaataacttctaacgtctgaacttcctgacaatcggcaaaggacgcctttggggtaaggctcccagagagctccaaccaacgcttggagcagctcttaagcagtgaataaaaagtaatcacagttatctattgctgtgaccaccagtccaaactgagaggcttaaaacaaccattatttatcttgctcgtgaatccataattgggccagggttcggcagggacgacttgtttccgctccccttggcatcagctgggactgggatcacctgagggctcactcgctcattcaggtggagattggtgctggctgttgaatggggctcagctgcctgccacacacccatacgtggcctccctgtgtgtttgccccttccttgcggcatggtggttagggtacaaggaccagcactctaagacgactgagtggcagcggtatcatcttttacgaccttgtaagtcaccctgcatcatagacgcactcagattcaaggggcgagagcatacacaatgggtggaatgacaacattacgttttaaggagaacatgtcacatgtgctatgttgtggtgcccatttctggaatgctttgtcacacagtgccatagagtgagctatagacattaagaagatagagaaagcccctgacccgtattcaaacaaatgcatattcagtgcagcaactgaaaggctcaacaaaactgttgtagtgacacagacttataaaaagcgtagagaagtataaagcacagctgtgtagggccgtttagtgcaggcacaaactagcagacctcagtaactcctaggagtctaagagcacactaatgttgaatgtgaaccttctgttaagaagtgaaggatggggtgaaatactttggaatgagttctgtctgaaattttttaagatttatttattttagagagaaaggcagctcatgtgcgatggtgggggagaggcagagggacagaatctttaagcagactccctgctgagcatggaccccaatggggcatgatctcacaacccatgaggtcatgacttgagccgaaaccaagagtcagatgctcaactgactgagccacccaggtgacgttttagtttttaaatggatgataacattcaataacacattaactttccctcatgatgacataagtattactatagtatcctgtaatcattttaggagcaacctgccttagaattcccttgcagggacgtctgggtggctcagtggttgggcatcagcctttggctcagagcatgatcctggggtcctgggatcgagtcccacattgggctccctgaagggagcctgcttcttcctatgcctgtgtctctacctctctgtgtgtgtgtctctcatgaataaataaaaatcttaaaaaaaaaattctcttggagatatcattccattatcttcccgcctccattgctgctgaagataagtctgctgacaatctattttagtacctttgtaagttatctgtcttatctccccggctgcatttaagattttttctttgtctttggtgtactgcatttgctcttacatctatgcctacctgtggaatttaaaaaaactctatttgggacacctggctggctcaactggaagagcatgcaactcttgatcttggagtcgtgagttcaagccccaccttgtctgtggagattactaaaaaaataagtgtaaaaaaaaattctgtttggggtttatttattttgttttaaaagattttatttatttattaatgagagagagggagggagcagagagagaagcaggctccatgccaggagcccgatgcagaactcgatcctgggtctccaggatcatgccctgggctgaaggtggtgctaaaccgttgagccacccaggctgccctgtttggggtttaataggaatctttaaactgatgacacatgttatataataaaaaaaaatttgtctttgtcctaggttcctggaagggagcttctaaacacttcctaattttcccagcagagcatctttgctaatcatggtggggtccttagaccacatctgagtttatgttaatgagtgactcaggatgggggctggtcacaccagaaagactaaccatgtgattagagggttgggtttttgagccacatggtatcagcccaactccctctcaggggggaggggactggagactcagttcaatcagtgatgtgcatataatgaaatcccaacaaaaactgtggacaccctaaacttgagtgagccacctagctggtaaatgcatcaatgtgctgggaaagtggcacatcttgattctacagggatggggcatggatagtctatgttttgggaccctcccagacctcacctatgtgtctatttgctggttctgatttacatactttataaaaaaaaactgttattaagtatagcccttttttgagttctataaatcattacagcaaattatggaacctgagggaaggtcatgagaacctctgattttgtagccaactggtcagaagtgaggatggcctggggaccctttgaaagggcagctggggtctgagtagggcaatcttatttggacactgagctcttaacctatggctgtgctaactctgagtgattactaccagaatagctttgtagtactgcacacatttttcttcactctagaaagatttcagtgttagaaacctgtagtttctggcttatgaaaaatcactggcttatgaaaaatcagtaatgactatccattgcctattgttccaatcaaagcaaactgtggaccctctctgcctggggtcaaaggaatgccactaaacataggagaaacaatgtcgtgcctttgatgtaaaaataaaacagtgtaaagtagaggcagtgtggcaggtggcattaatgtttcttttttttaatttatttaattaattaattttattttttggcattaatgtttctttagcagacattactggtgctctgcccagatcttctcagatctcttttcgggttctggtcttcctcctaatttctgtgtgatcttgtttctaagatccacacatgtatgcttctttttaaggactgctccagggctactggagttgcttcacccaggtttggaaagccaaagctgttccactgcttacgctctcctggagcagcccttagccaatgactgacagctgtggaaataagaaagcctagctcccttgccttgagctgggtagactctgaggtataattaacactccagaatcccctacagggtgaggctcagcccaggactctgcttgatattatacccttacttagctttgtctcattccctgttctgttcacctactccttttctggattctcccaggaacacttccttagtaaatcacttatccacaaatccttgactcagagtctacttctggggaacctaacctaaaatagctcccaattattcactgctgagaatgctgccatgtgacttgcaatgcgtgagagggagggaaatctatttttcttcccccattgagccaggcttggccatatgatgtgtcctgaccaatggaatgtgacaagaagtaatgtatgctacatgttatttgaaccttaagaatcatcacttactagaattgttcttttctttggggaagggccagaatagggctgctccttcagcctgggtcctagaaccagagctgacacacagccaacatggaacatgagcaagaataaacctttattattagaagacaatgagatttgggaagttttactgcagcataatttagcagatataacacagaggatatgtcctaaacagcctagggtcaaagccaagctctactgctatctatataaccttggccaagttgcttagcctctgtgaacctcagtttgtaaaatagagatattgatgatatccacttcataaagtcattgtggggatcaaatgagttaacacatataaagtgtgtcaaacagtgcttggcacatgataaatgcttgataaatattaactaaagtgaactataattaggaactgtgatagctcatcctcaagttttctgttttctcccacaaccactgagtttattggctgtctccccagcatccattccactcttcccacagtcttgatttcaattggaggatctatctggtcctggggaagcggatttcactgtgacttcacttggcccaagataagccagacagccaatagtgtgttggtgaactggatcccagaaggatggggagggaaggcaatttccatggtgtacacactctctacacgacgaatttcaagctaccaatggtttaacaattggcttgcagaattcctgaatatttaacagtcacctgaggagccagtaccagctggctccagtccattggaggccacgtttctagtcctaatacctaaattcaagctgctgcaatctgtgagaatctcaggattcctgcaactctaatcaaatgcgaacaattcccctgcatgttgtaaaatagaaaagaactttccaaaatacatcattaggtcgaacatacaaaattgcaagttttgatctccataaggagcaatttcatatgattcaacttaatagaccaaatacacaggatactatggaagaagagcaaggaatgaggaacgatgggggggggggcggggaggagaaggtggaggaggaagtaggtccaccaaaagcagatgtgagctataaccatgtggagtttaagatttttttgttatttaattatttattcatgagacacaggcagagggagaagcaggctccctgcggggagcccgatgtgggacttgatccccggaccccaggatcacgacctgagcggaaggcagaggctcagccgctgatccacccagtgccctgaccatgcggagttgaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattctggaaggtcttagagattttggccagcacctcgcgacaggtttttggagacactcagggtcacgctcgctgtccagagagtcccacttccctacggcgttcttctcgctttaagatcactcgcagcgagctggggcgggagggactcgagtgcgccggggtccctcacctctcggagcttcaggtcattcacctgtgcggtgggggctgctcccctcggtagggggcctgagaactaacccgggacacgcacgcggggggcacggcgcccgaccgccagccgtcatcaagcgtgcccgcgcggggggatgttaaacaccccggggctgcggctgcgcccgcgcccacgcccacgcccggcaggtgccgagacgagcgcccagccgcgcgcactcgcagctcccccgccccgcccccgccgcgtcccggcggcccctgcggcgggcgcggccccgcctcccagaatcccctgcgggcctccccggagcgcggccgcggcggcgtgaagtcgggccggagcgtcccggccgtgggagcccggccccgcccccggcccctccgccgaggtccccgtttcctaccacgcaccccacccgagctgcgcgtactcccggcacagctagcgccggcccacccctccgcgcgcgaccccacgctctgcttcccgcccgcaaaggacgcacctcccccacgccgagtcaagtccgcggctcgcggccctcggggcatgcgcagactcgcggccctcggggcatgcgcagaccgcagctgcgggcatctgctcggcccggcgctcggcgctcgccgcccgctcgcccaggacctaggtccccgacgcggcacgtgcagcacacaccttggtgcaccgcctgcgccgccgccgctgcaaaccccatgtattttgtagcgattactccaatcgctcacatccacaacgcgcagtcgctcctcacacagatgacacgcgtgacacagtgttccacactacaccggacacagagcgtgcgcttaagcctctgacgaaaaaggaaaagccacattacacacaaacgacacgcatgcgttacccacaccacactaaatacaacacattatgcaagccctacacacacccatagcacatcttcacacgctcagcaacatgaccccacacacaacacccaaatgtaccagtgagtcccccactaacacccactgcacaaacatgaataatcacacacactctctgggggcagagagatagggggctgcagaaacccagagctaaggggactcgggtgtggctttctgagcactaagttccatcctctgacttgtctgtaggaggaaatgcacttagggagaaaatgcctaaaaaatgaagttgctgggacacctgggtggctcagtggtcgagcgtctgcctttggctcaggtggtgatccgggggtcctggcattgagtcctgcatccggagcctgcttctctctctgcctatgtctctgcctctctctgtgtgtctctcatgaataaataaataaaatctttttaaaaaatgaagttgctgtctgcgccttgaagaaaaaaagagagaagcctaactacacctgactctggggttttacccttggcaaaacacttttactggagttatctcatctcacaaaacctgtgaggtaggtagcgtacgtactattatgacactagaatcattgctggagaagcacaggcacctgcctgaagtcacagagcataggtcaggccaagcaggtctggaagcagtcccatctcctggatcaccccacccaggcttccccctcctgccagctgtctgcacagccccccttcttcccccatcctggctgagacactgtggctacaatcaagaagccacctgtcttgagccaccaccttcaaaagcctttcattccgtcctaatggggcaaggcgcccaggccgccccacccttagggtggattaggcctccgcctccctgttccctgttggagtttaaaatacatcaaaagagctccctgcaccaaaagagctctcacaggccctgtctggtagcttgaaatcacaccaccagagatctcttttaggtaaaggcattgggctcggaaggcctctgctcaaaatgcacctgtgtccctgagacagactcccacgctgcagcttccagctgttgtctttcctgtcactctgtgcattgcaacagacattgcctaatgccagcttgctggtggagttggattgttatagcaagttctgtgggaatggggcacaggatggggaagtttgatcgtggctgagggaagatatgaaaaacgtgtagagtgacccggagagggggaagcaggatcatgcgaacaggattgagaacgatggggatacaccctgggtagaggtggaggagaccctgagtccaagagagaatgccatgaactttccagagaggcagggaggtacagaggatcaaatgtatatggtgggcttatgtggtggtggtggtggtggggttggtgggagagagctgtttgtgggggacattctggctccttgctggcagcatcccgatcaggacacttgagcaatcacagattatttctctctggaagttgccgaagaaaatgtaaggtcgtgggaaagtgttagcgatgtattgataagtgggaaaaaaggtttcaaaacagaacatagaatgggatccctattttgtaatgctggctggaaagatttcaaaatgttagccgtggttatccttgctgtacggaggatgactttgcatttccttttggagcctttctgtattttccagattttcttttttttttttttaagattttatttatttattcatgaaagacacacagagagagacacacaggcagagacacaggcagagggagaagcaggctccatgcaaggagcccgatgtgggacttgatcccgggtctccaggatcacaccttgggctgcaggcggcgctaaaccgctgtgccaccggggctgcccccatattttctataatgaacttggttggagcatgattgtcatacctatcagaaagagttattttattttatttttatttttttaattttatttttttatgatagtcacacagagagagagagagaggcagagacataggcagagggagaagcaggctccatgcaccgggagcccgacgtgggatttgatcccgagtctccaggatcgcgccctgggccaaaggcaggcgctaaaccgctgcgccacccagggatcccagaaagagttattttagataaagactcattgaacacttccagagtgcccatcaaattctacagtgttggcactacacataatgcagagaaatgtaagccataactgctgctctaagattacccttaaatccagtcatgccacaggggttccactctgtgcacaacaatgtggctctggaattgaaacacctgggttcaaattcctcttttgcagcttcctagctgtgtgacctgggtgagtgccttgacctttctgtgcattggttgccttatctataaaatggagtaataataatacctgtaagaattagttgagctgatacagctgaacacttagaagtcatcaccatgtaactgttggctttactgctattagtgggtaagagctttgcctctggggccagcctgtctgggttcagatccttgttctctttctgtttgccttgggcagatgatttcatctgtttctacttcagttttctaatcttgaaagtggggatgaaactaatggtgcttcatagagttgttaggaaaattagagtagctatggataaagtacttaaaatagtgccaggcacatagaaagtgcccattgtcagctgttagagtactaattgttgttggtggtggtattcttattaccactgggtgaggcagggattggggcaccacccaccagagcgccccaggtagagcccactggggggtccagaatgagatgggctgagctgagcactgcaggatggccccacgcactctgtctggcttctcttgcattctcctctagcccacattcttctggtcctttaagttttatttcttattttttaaagatattatttatttatttttgtgaggaggggctgggggaagggcagatgctcgagtctgagcaggcggaggggcagagggagaagcagggtcctcgctgagcagggagcccgatccaggacttgatcccaggaccctgggatcatgacctgagccaaaggccaaaggcagatgcttaactgactaagccacccaggcaccttggttatttatttatttatttatttatttatttatttataaaagatttatgtatttatttattcatgagagacacagagaaagaggcagagacataggcagagggagaagcaggctcccacacaggagcccgatgtgggacttgatcttgaaactctgagatcacaccctgagctgaaggcagaaaggcagacactcaacccaaccactgagccaccctaggcatcccaccttggttgtttaaattttaaaactgtagctcccgaggtttcagtccttgcacctacaccactacttccttgatctttatttagctataaacactgtagatttctgaaactaatggaaggagccttccaggacttatttgcatgggaagtgcctggccatattatttttataattgtgtgttcttttctttctatcattccataaatttcagccccacctgggtcctcccttaattttaggaaggggggctcctaattgagacttctgataaaatctagcccctttctctaactcagtctggtcactgagatctatccaggtgggatttttgaccatgtgaacctgttttcctttgttcctgtgcatagtacttatctcttcttcttttattttttttttaatgaagtcttttttttttaaattttttttaatttatttatttatgatagtcacagagagagaaagagagaggcagagacacaggcagagggagaagtaggctccatgcaccgggagccctatgtgggattcgatcctgggtctccaggatcgcgccctgggccaaaggcaggcgccaaaccgctgcgccacccagggatcccagtacttatctcttcttgcagccaaagcctctacctgtggtaatgtcatgaatgaatgaatcaatgaatgaatcaatgaatgagtgaatgactacactctggatctgctttgttctcaaggtaaaccagcagaaaaatggcttagttcttggagcaaagcccttggcagacagaaactggaaggccttttgaatctatgtggaacaacaagcttctgaaatcccagagtggttggcagcttaggaacttgactataggactagttgggaaaatgtgttaagtctggagacttccagaagctgaaactgatgaatagtcacagatcagggagagaggattcctatcatacctgtgttctttattgagagctgtgctctccttatatgtaggctttattaatgctgctctgctggtccactttattaaagatttatgttcttatttaaaaatgagcaaaattaacaggagagcaagcttgcttgtttcagagttaggcatgaccttccattgtatctctggctttctcaactgtttttgagggtactttatcaggctgtgctcagaaccttgcaatttatcccacgctagatgcttcatactctttgtgattgtttcatgttccccagttttgtcttctctgggactattaactctgggaagtttcacatcccatccctgacagacactcaaagctaaagagttggggtattgggtatgatatttattttttttcaactcaatatgtagtttggtcaaacatcagtctagagttgctaagtaggtatcttttagatgtgattaacatctggggcacctggggggctcagtgggtaaagcgtctgactcttgacttcagctcaggtcatgatctcagggctgtgagatggagccccatggctctgggctcagtggggactctgcttaagagtctctttccctctgcctgtgcccctccccctgcttagtctctctctctctctctctctctctctctctctcaaacaaataaaatcttcagatgtgattcacatataaatcaagagactttgagtaaaaatgattacctgccttaatgttgttgggcctcatccagtcagctgaaggcttaagagaaaagattgaggctcccacccccactccaagaaagaaaggaattcggcctctggaggaccttccaactcaagactacaactcttgctgaaattgccagcctgccctacattatggacttgtcggccccaccccctctaaaagcacaaaaccccaataccttacaataaacctctctatctctgtctgcctgtgtctgtacatatatacacagaaattagagtgttcctatgaaaacttaaaagttgaaatggtgtaaagtgaagaagcacttgccattaacttatatggaaatgctttttagtgttcccaggccccaaataaacctctcttaggcttttcagatatgttaggacacatcttgctaatggatgcaccaaataaaccgagacaaagcctggatgttcacggttcaaagctatggcggcttgatgctgagatgctgagtgtagttcccagagaaggagcttggtggcgccactctcactgctccgtttggccacctctgtaacagctggttacagatcaaacaccagaaggctattttcacttttagcctcttttctgtaaaagtgacagtcctcttcagatttcctttagttagcaaaaacaggcacgaatgtaggtctttcataaaaacaaagcgtggtagcacaagcttttgaaaagcaaggggtacctgtatatatatatacacacaaatatgtatatacatatatacaaatttcatatacatatataatatatatgtatatgaaatttggttctgtttctcagagaaccctagtacagtagtaatgtattttctttccttgcttggaacaaaatcattcttaatgccttttcatgacattaagtggttggacaggtgcagggggtctgagagacctcagcaggtctggtctctcacctcattcttgagcagacttgtacttaaacttttggtcacaaagaatcattcgaaatgaaaaccaaggggcaactgggtggctcagtttgttaagtgtctgccttctgctcaggtcatgatctccaggtctctaggtcctgggattgagccctgaatcatcaggcttcctgctcagcaaggggtctgcttgggattctctctctccctctgccccccccccccccgctgttctctctctctttctctctcaaataaataaataaaaatctttaataaaaaaataagtgaagatcaattcttcctctgctatctaccatgttagctacatctaaaattatgtgcatttgtagggtgcctgggtggctcagtaggttaagcacctgcctttggctcaggtcatgatcccaaggtcctgggattgagccccgcatagggctccctgctcagcggggagactgcctcttcctttccctctgtgttctttctctcaaataaatcttaaaaaaaataaaaataaacaaaactacatgcacttgtaataacaaaagactggagacagccaaaatgttcatccatatgatggagtaccatgtagtggtcatggaattggagataaactgagtggtaaaaagcaaggtgccccacactgtgcttccatttgggcgggtgataggaatatatgcacatttgcttacaggtctccagtcccttgtccataatccccaaatccaaaaaaacatctgaaaaccaatctttcttttggtttgtggcaaacttatgtggtagcaaaacaagagataaaaaggtgtgaagacacttgcagttggtacttatccttattagtgtgaataccttatactgacttacaggtgacctgcagcctgtctgcctgggattgacagggttccttgagtctggatggaacttccagggctcagatccgggcgatgagtcatcctacacagaacctacagggggtcgggggaggaggtgttactaaatacatgtatatgcacctcggtacctgtctgacacctgaaaagttctggattctgaaaccaatctgtccctaaggattttggatgaaggcctgtggacctgaatgttcatggtctaactctggcaagagacacagctctcagctgcagcgcctgggaaggaaatgggtggctgcgaggcagagataggatggaacattttccctgcatattattttgcaacttttgactatgaaccatgtgaatgcattgtctcctaaaaaaataaatacaggaaattatggaaaggcgaaactgcacttctgagtaaactacaaatagaattttaaagatttcaaaaaactgaaatcactgtgctacggttatggatgccgtcaagacaatatttgtctttctgattctgctgattccagcatattccgtcctcagagccgcttgggctccggagccccgatttggggagagacttgctctcggttttgtaaactaagaatgctgagtaggtatctcggggagcagcaggtggcccagggctctggcatcgggagcctgctccacggccccccgggcgattttttttttcctggttagtagttgttattattattttgaaaaatcaagaacaatcatgcaaagcaagtagaaacaggctgggtcagcgaagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcggggttcctgagcatggctagactacatccgggctccttagctgtgagggtggaggatgcgaatggctcagtcagcgggggagattttgcagaatccctgggaacctgtgtgcctggctgcccgctgcccaaattctaattcagtaggttcaggtagggccagaaattggaatatggttttcgttgtattggttactatttaaaatgatattaacccttacaaagatacattacgaggaataagcctaccttgcacacacacgtggggtgggcgggcggcggcaagcaggcggtacacaccgcagctccagcccctggatgcagtgacacaaccagggaaaacccatgtgcttgtgggttttcttttcttttttttttttaaagatttttatttattcatgagagacatagagagagagaggtagagagacataggccgagggagaagcaggctccctgcgggtactcaatcccaggaccccaggatcacattctgagccaaaggcagaggctcaaccaccactgagcaacccaggtgccctgaatatttttcaaaagagagttccctttcctcccactctataggttgagtaggaggagctggttgagctggaggaagcgaaggctaatgggggggtgggatcaggcatctactcggtgataaaggaggattgggtccccccagaaagccaccccaccacggcatccccccaatgccccaccaggtcaggtccaagccgggtcccacaaaccccatcaagaacctttcagtgtctctgtacctctatttcaggcaataaaaggccttttcttccttccttccttccttccttccttccttccttcacttccttccctaccttcattccttccataccttccttgcctgccttccataccttgttttttgacaagatttattcatttattcatgagagacacacagagagaggcagagacccaggcagagggagaagcaggctccatgcagggagcctgaagtgggactcgatcctgggtttccaggatgacaccctgggcgtgaggcaggcgctcaacctcttagccacccaggcgtccctaaaagaccttttcttagtaatcctcctaggccagtgggcctttttcagatggatttgctgagtaaggggttttcctgcatttcaatgttctcacagactttgatgttggctagtgaaaacaaaacaaaacaaaacaaacctgtgtaccagagaggggaaactgggtcctgctgtgtggttttaagacaagtcacactgtctctttgtgtcccggtttcttcctttgggaactaagatacatctagatagtagatacatctactaaaacatcaggcctgcctcatgtttttcaataatctcagggagactgtaaagttacatataggaaaacacccattttatagatgaagatactgaggtccaagttcgtgcagcgcagaggtgtcactgttcttcttgtaaggtccagaaacttggcaggaaaagaccctcttttttttttttaagattttatttaaaaaaaaaagattttatttatttattcattagagacacagagagggacgcagagacacaggcagagggagaagcgggttccatgcagggagcccgatgtgggactcgatcttggcactccaggatcacgccctgggctgaaggcaggcgcccaaccgctgagctacctgggtgtcctggaaaataccctcttgtgggaagatggggggcagagtgaggggctctgatgtgcctctgtcccctgctgtgacagagatggctagcaggtcatcacaaatctgtgctatctagggacagcattgacccttgcatctaggtggggacacatgacaggttctcaccaataaaatgtgggtgggaaatggtgcatgttactttttttttttttaagattttatttatttatttgccagagagagagagcgcgcaagcacaaacagggggagcagaagaaggagagggagaagcaggttctccactgagcaagaagccggattcagggcttgatcccaggaccccaagatcatgatctgagccaaaggcaggcacttaactgactgagccacccaggcaggcctgatgcatgtcacttctcagccagatgtgaagaaatgcacatgccttcttcttggtttttctcctttctccagctggaagcagagatcctgttgttccagggaatggtggagccagtcaagagcctgaatccctgaatcaccacacggacatcggctacttgccaaccagaacaccttagttgtgctcatgtgtgtgtgagaaataaacatctttgggtgtctcgaaaatcaatttgagagttgatttgttataatggcttgtgtcatcctaatacacacccccacttttcttcctgagtctaggcctaagctgcttacctgttcccagaaggggacatggataattatttctcagcaaatgccgggttgtttgaaatgacggaatgtggggaatggagattttgtctcctccttaggtctgagattggggccaccagcattcagggcctgggggttgcagctgttggcattctgcaatggctctggcggggttaggaccatgtgtgacactcggaggaactcctagggaagcaaagacaaggacaaacagctgatgggagggtgaggccacagccagagccttgggtctgccctgactctctgcctgtgtcacctcactagaagccagtacctcctggcacctccatttttcccatctgtagtatgagtcatggatgtggagtgagagtgaagtggggatggtaaggagtcaggtaataaatctgaaatcctaaaatcacttttaagactccacactgctgtgcaatcaaaagatccaaacccaagactcctagaactttagtttatgcaggggataaactatgcaccttccttgggaggcgcttaaagataatttgttagggaagaaaacaatgaaagatcacataattccttctctttggggggatcatccagaaggctattctaagctaaagggcctgggagatgagtgtcttggggctttgaaggccagctcagaggactgagctcaattccctttgctatcaaatgtgtactctcaggcgtctagcatctgaaattctagcattagtgcttcattactttgcatatccatttgttcctccacaaaaacgcaagcaacgataatccctaacatttgttcagtgttttggacttattccaataatcccgaaaagacagacaggctccaacgctgggtgcggtgtttctcaatcacttctcctgacaggatgatagtgagcaattctactcctaggtgtacatccaagagaaactcttgcacacgtacctcagagaaatggttaagaatagtcatagcaggtagctatgccactgggtggctcagtgggttaagtgtctgcctttggctcaggtcatgatctccgggtcctaggatggagcctggcctcgggctttctgctcagtgcagagtctacctctatctctctccctctgaccctctccactgctcattctctctctctctctcagataaataaaatcttaaaagaaagaaagaatagccataacaggggtgcttggatggctttgtcaattaaagcctccaactccaagtcaggagcccaggctgggggagcctccaccatgttgaggtagcatcatctgggaacatgaaacctcactttcgccccagccagggagggcagagagcctggagagtttcacttggcctcggccctaaagagaccaatgtcatgaatacgcacattctcattggccagacctagtcacaagaccctgcctaaagtgcaaggaggggttgagagcacatagagcggtggcccagcattactctcttggccacaggtgctaaaactattgaaaacaaaggaaagttcaacataaaactcaagatagtgtttagcacaggacgtggggtgtggggcaactcacaggaaggtgtcagtgatttgtaatgttctagctctggggttgagcaatgagtgttaattgtgtgtgtgttaattatatgtatatacacacacatatatgattatatacatatataaatgaatgaatgagtgaatagatgaataaataaataaaagaaaggactcagaagcagtgacacttaagcctaatctcaggttgcaggccaaaaatggctctttcataaatattcaatgagctctggctgaggctgctaggcctcaaaagtacaaagatgaataaaatatgggctcaaccccctcaggttctcagctcagggaatgcagtaggtacacaaaccaggcaagccggcaaggcacagtggaatggattactcaccaggagctctgggagccagagggagccctgagaaggtctccctccaaaggggtcatgtaggttgggtaatgcaggatgagtaggagttcaacaggtagagaaatgagtagaggtggggtaggttggtcaggaagactcattctagaaacgggagtgctatgtgcaaggcacagtgagaacttcattccttaggtggcctgtgttcacgcatctccctaaatgatctgatcaagtcattcaccatgtgctatgccacctagaaccttctgcaggaccagccaggcactcattctccctactggctgtttggagcattggttgctgatgcttacaactaagtccttcttcaggaatcagcctcagataagggaattctcttggccaaggctgtgtacacacctctactccaagggcagccatatccaaatgactggtcaaaggatgaatatacaggcccaggccccttgctttaattcagggaactctgtgggacatcccagctccagagctcgtgtgggattagctggggcctctctagagcctccagtctccatcatagcccaactcatctctctgtcggatcctatttcttttatactcccacaggggttgagtggggatgcactccccaagaaacctccttcaagagtatctccacttcagagtgttttctaggaaacctgcctaagatactcactaaggtgtaaatgattactcaatttcaagggatgcctttcctggggtgtgtgtatagcaataataactaatgttcacagagtgatttccatgtgctaggcactatactaagcattctgtctatgtgagcttatttaaaaacgaacagaaggaactcatgccaaaggaatgaatttctaatggtagaatttcagacttagggaaggtgaaattatcagcttagggagactggaagtgtttgtgtgacacatattcagccacagatttctctttctcgctgttcagtagtcctgatcttttgtactggctgactggctgggccaaccctccagcaagtcagagttggggctctcaaaatcattcttaaaaaaaaaaaaaaaaagaagaagaagaagaagaagaagaagaagaagaagaagaagcaggacttctgctcagtagtacaataaatatttctgttctgtcttttttctggggtctcccttcttgggagcctgtgtggaggtaaattcctctgtaagccgagtaccccggtttgggactccccaaacattttctgagaaatggcgaccttgttcctactacttcctctcccttcctgggcagctccagtagccacccttacatcctccttcagacttgagcttcccagctttcctttctgtcatcacctccctcctggtgggggctgacctgaaacctcttgtccccagacagagcctccctccatccccgagccacgtccttcccagggagcatgcccgggcagcagactgtagccccgactagtccttcagacctcaggaacatgtcccaacatgttgagcactggggtagaaggggctggttgctgttttgtccttcgggctgcctgctttggggtaaagagggggatggcaggacacaggagaccccccaaagaccccaaggagacttggtttgaatttctctgaacagaaatatgtgttttgctgcagatcccttgggattggcctgggatctagggtgtgtgtctgtgtgtgtgttttttgcacacttttttttgcatcagctctcctgtgtgacttctaacaatctgttcttttgcccccttcatagcagaagtcccttgttaagggcatgcctgggtatacactcaagtgtatggttggaaattttttttaagtactgaacagtatcagacacttagtactgtgcctaataaatatttgttgaattctgttgttgttgtggtggtggtggtggtggtgagctaaaagtttcattaaaaaaaaaaaaaaccccaaaaaaaaaaaaaaaaaaaaaaacccacaaaactcacttcccaacaacaacaaaaagaattatttcattgtgaagttcagtaccacaaaattttaaataattcaacacaagcctctttaaaaaaaaattttttttccccaaagtaaacagacagacaatgtcaagtctatttgagatgcttgagagacaaagggattcaaggcagtaggaggatatgcctgtcctctgctgaacatttgacagtgcagcctttgggtatgtgtatgttggggatggagggaggtgcagtatgaagaaaggagctagggaggaggggattggtcctggggtcttggcctttgtgtggcccccccctgagatccagctgcagtcctggcttgaatccaccatcaggcaagcaagggagtctggtgctgtgcccttgcacccctacctgggctcctatgccagcagtagaggagaagacctgtcctccctgaggtcagctgtgttagaggaagaaaacggggcatgtctgggcagagatttccagacactgaacagtcctagatgtcagtaattgtagctgctccaagcctgggatctatttcttagtggtatttctgttcaaagtagcattctattctttgaaatgtatttttaaagatttaaaaatttattttattctatttcttttatttttttaacatttttaaatgtatttattcgtgagaggcacagagaggtggcagagacataagcagagggagaagcaggctccctgtggggagcctgatgtgggccttgatcccaggaccccaggatctcgacccaagccaaaacagatgcgcagcccctgagccacccaggctccctatatttcttttattttttaaaagtaagctctatgcccaacaaggggcttgaagtcagaccctgaaatcaagagtcacattgtctcctgactgagccagccaggcaccctcctctgttccccgcaattttttaaaagcaaaactacaactatattaagtgaaagaaggaggcaaaaaagaagtacaagaggggctagtggtggcaagtgggtgggaggaaatgggcacctcgcttgcttttgtaccagtggcaagcaccagtggacatttccagaattgtctttcatcaatgccacctcagtacactgcctgaaaatgaggagtgctgggggtttccctctttctagagccacttaaatagagagggcaatgagcagagagctctgagaggcactgggcctatgctccaattatagctgtttatttgctgtgtgacctgagtcaggtcactgaacttctctgagcctcagtgttcccagcagcgtaagcggattgtgcgggggaatatccaggagataatttgctaaccaagtccttcccccttcctagctatcaaatctgttgcaatcagaggtgcctgggtagttcagttggtttagcatctgtctttgcttcatgattttggggtcttggtatccagcctggagttgggctctttgctcagcaggtagtctgcttctacctctctccctacttctcccccttcctctgctcctgctctctctctgtctcattcataaataaataaataaataaataaataaataaataaataaataaataaaatcttaaaaaaaaaaatctgttgcgggatccctgggtggtgcagcagtttggcgcctgcctttggcccagggcgcgatcccggagacccaggatcgaatcccacgtcgggctcccggtgcatggagcctgcttctccctctgcctgtgtctctgcctctctctctctgtgtgtgtgactatcataaataaataaaaaaataaaaaaaaatctgttgcaatcatagagatctctattgttgaggtgagaaggaggtggatgtgggcacgaggaggaggggtagggaggttggttcaatgtccaatttcccccatttcctgctttcccctggagacctggttgaccttttctgagtattccccattccctccttccccgggggcattgggcgagcaacaactttgcatccgtttagtcctgaggtccttaatttcttcatctgtgaaagaaggggaatcgaatccggttctggtctccaagatgctttgttggcgtgtctgggtgcttgggaagaggcggtctagtgaggggtctgtgggaagactggcggtatagtgggcttttctggaaatcgccgagcgaggcacatcctttatgcttttatttatggagtgttatctatgaatgtcacccctcgtgatcttctcggggccagaagaagggctcatcctaagaatgccatcccttcgtggggagtgccaactcccaacccagcgaaaacaaccccggtctgtggctcagttagtggggaaacatgtcaagcacagggacccaggcgcggggcgcggggcgccgggcgcggggcgcggggcggggagggaagcgcccccctgcagcccgcggtgtaggcgtctgacttcggaggtctccagccgccggcgagttgcgagctgcggcggcggacggcggcagaaggggcggtgccaggcctgggggcggggcggccggtccctatataaggcggcaccgggcggtgccagctcgcgagctgctgcgggagacggtggcttggagagcggaggcgggcgcggattcgcggagccggagaccctcggaggaggtgagggcgttgtggcgggcgagggggcctgggccggcggctcggagcccggccgaggtgtccgcctcgtgtgtgtgtgttcgtgtcccagcgggtgagtgtgtgcgtgcgcgtgccgtcttcacaggtgaatgacgtgcgtgggtcggcgcgtggggctgggctcggctcccacgggtgtctccggaaggtgcgcttgtgccggaggtcgggctgtgtcggaagcccggggcggcgggagcgcagcagagcgggggatcccctgccgcgccccccgccctggagccaggggaggcgtggactcgcgcgccccaggcccccggcggcgcgcggagggagcccccgggcgcggagcccccggaggggcggggaacgccgagcccggcaggttcaccgccctccgctcccggcggctgcgatccaatccgcgccgtctccgcccagacccctgcggccggggtccccgacgcctccgcgtccgccaccggctgggcgctgaggtcagcgcgggcggcgtacccccccggtccttgggaacgtgttgggacacatcctttcagggcaatcgaggaggtgactcacggtgacaaggagaccccgggaaatgggacgggtgcggtcagagccccgcccgggctgggggacagtggcgccccagaagtcggcttcctccccgatcggcacagtgactgtttggctggcacaaagtgttctcagggaagccgggacatcgggaggtccaggactgggtgtccggtccccgcctcgcagcgcgccctcggggacccggagcggtggccctgcgcgggctgggctcgctccagccggcccgtgggagaagaacaggggtcggacacacctgtcctccttcgcgccccgcctgccctggggtcggggcgccgcattccgcagcgggaggggagacctgcgccgcggggccgcggggcgtgcagcccacgcgcggggcgagggacccggagaggtcccatctggaggctggtcccaccctgacggccacatccgggggctcccggcgcccctcgccaaactgccctgtccgagggcgactgctcagcgcgcagcgagaggacgagccgtcctttgggcgccgccgcccagcgcgggccaccgtgcaccccccccccccgtcgggggccctcgggggacacgggcgcccgcctcttgcggaaaagaatcttggaattgggtttggcgcttcggggtgcccgggcggctccctccctgcccccccttccctgcctccacgtcgcggttcgaggactgtcgagcggttctgttttccttgctttcgtctatttttattttccagggatctgactcatcccgtgctttgggcgtggagataaggtggagggaccaaacctctgcgcgcctctgcgtgcggagtgtgtgtgtgtgtgtgtgtgtgtgtgtgtgtgtcacggaggcgcgcgcgtttttccaacagtggcggggctttcggaagcctggctggctcagcgtgacgtgttcgcggcccccggtccgccccccggtccgccccccgcctcccctccccacccgagggtgacgctgcagcccgagcgcacgcagagttgtggcgggcggggagcgctccgcaggaaactgactcatcgctgctcgcggcggcggctcgcggctctgcccacacgccgaccctgcgcgtgatttcctggagaccggcgcccccgtccggccccgacgcgagtagcaagcgcgccttcccgcggaacgcggcttcgcccgccttcccttcccgcctcgctgcgccgcggctgagcctgagccgcagctgcgaacgcccctgaaaaagcatgccccgttggctcatcgcggggtgctgagtgcttactggttacttcggaattaaaactggctgaagtctaagacacgaaggccaaccaaggatgctattctcggttgtttgtgaaataagggtttatatttgacttttctctgaactgggagttacgataatgggaatgagatcagattttgatgaggagcctatgagggccatagggtggtaggagagaggatccttgcctggattctggtcccatcttgagcgcctagaagcctgggaatactcagcctcctggtgaaaagccaaggcaggctcctcctccttgtgccagtgaggccatcctgtgtatcctctcttgaaaggcaccccaagagtgcccatatggggaactgccaaacacctgcttaaatcccctttattttattattttttaagattatttatttatttattcatgagagacacacagaggaggcagagacacaggcagagggagaagcaggctccctgcgggaaaccggctgtgggactctacccttgaactccggcatcaggccctgcaccgaaggcagatgctcaactgctgagccaaccaggggcttaaatcccctttagtttgagttattctgggaagagagggacctatcaacctgtattttttaaaaagctccctaagtgattctgctgggcctctggttaggaacacaaaactagagagggagtaaggatgaacaccagagcacggaacccaggataaacaggcctgggttcaaatcctggctgtgccacttgtgagccatgtgacctcgggcaagttactttacttctctgaggtcttagttacttcttctgttaaaaaaaaaaaaagaccaatatacccactctttaggaaaattaatatttattaacttagaacagcccctggcacataaaaatatataaataaatcctgatgcttgccctaaagagagtgggtgaaggttatttgagggctccgcccactgtgctgtgtaacccctctatggggcagtggcccttggcctttttagttttctgatttgggggcaagcctcgtatctctctaaacgcttgccctttaaacttggtctgaggtcacctaatgtgtcctctctcctataagctgtgggaggtggggtggggagggggagctgtggcaagggtccagggcttcctgccccaggaggtcactcagcagagctttcaccctcagagcctgcaaagcaggacttgtcctcgggggaaaagccagtccctgccaaggttgcaaagccgctcagccctggagtcaggccagagcagggcaggtaggtgccagcacttcgtcatgagcaaactcaccctcggttttccctcttctgaagtgaaaggagaggaaccaggtagaccggtcaactctaattttctttgcccgcaaaacgggttcctcagatgcagctaacacaggcagaggcttccaggctgtctagacttcagatcacctgatgtgcctggcaggatgtggctcagcctgggagaaatcatcaccctggcctgccctgcccagcccctcctcacctccaggcctcccgcctgatgacatccttgggaaaggcccccagcacacagcacctgtcagctgctgtctgaaggaggtggtggtgggggaagggggggaagactcagccagaactgaacacagagaaataataacacttctatataccagcttctatataccagctgcttctctgcctgttacctacgttaactcagttaatcctcacatctgtcctctgagacattcactattactgtctccattttacagatgaggcaaatagagttgagagaagttaagctatttgtgcagggtcacccagcggagcctggattccaacctaggcagtcctgctccagagccctcactcttaactacaggatagagcctccacctctgttctattgccttgctagaagggactccctgaccaattgcttgagcatgcttgcacagccccatttttttatagatgagaaaattgaggcccagagacattaagtgactttatttttttaatctttaacatttttaagtgacttatttttaacagattttatttatttattagagagagagagagttgtgcacaagccgaggaagaggcagagagagggggagaagcagactccctgtggaggagggagcccaatgcagggctccatccctcaggatcatgacctgagccaaagtcagacacttaaacaactgagccacccaggcacccctttaagtgactttaaagtttatgtaatacgcagcagagctaggaatagatcctaggtggggtttttttttttttttctttttatcccaaaaccctgggggtacttttgaatttcagaacagaattatcccacatgggtatcttggtagagggattcaggaggccagagttgctgtcagcctgccctttcatttgggacctgaccttttggtccgggctggggttgggaaactactggactctggtaattcacacccatgaaggacacctcgagggggaaactcattgattttagttgataatactggtggtaaacaggactccgatcctgctaatgcaataaacttgtctttgttgacagaacctgtccttcagctgcccactcccccagtgaccttggggtgccaggatggctgagttctggccccatccgggggctgtggactgggggctgggagtggcctgtggggaggagatggtggagaatcagctggaaggactcagagacctcgtgttctagtaggaagctcccctctgagcttgcacaggaagcccggcctgctagggcagggtgccattccccaagtgaccgggggccttgtgtctcagctgcaggtgccatgtcggagccgtccagggacgccctgcccatccctcatggcagcaaggcttgccgccgcctcttcggccccgtggacagcgagcagctgcgccgggactgtgacgcgctgatggccagctgtgtgcaagaggcccgggagcgatggaactttgacttcgtcaccgagacgccgctggaaggcgactttgcctgggagcgcgtgcggggcctgggcctgtccaaggtctccctgcctgcggggccccgggggggccgggatgacctgggagggggcaagcggcccggcacctcgcctgccctgctgcaggggacagctcaggaggaccacctggacctgtcgctgacctgcaccctcctgcctcactcccctgagcggcctgaggcatccccgggtgtgcctggcacctctcagggccgaaaacggcggcagaccagcatgacaggtgaggatgggtgcggggaaggacactgcaggggactctcagaatccgtggtgcaggggctggcctgtcgggttcagctggctcatcaggcccagagggaaacaggccagagagaggaagtcactcggcaggtctacagccaagaccagctagctaacatttattgggaacatttattataggccaagccccttgctaaggtgaatttctaagacggtttctttttgcttccttcctttttttttttttttttttaaagatttatttatttgagagagtcaaagaatgcgaacgggggtgggggggttgaggggtggagtggcagagggagagggagaagcagactcccatccatcttccttatttttttctttggcatatggtttgtttgcttgcttgattttactatcaacagctacttccttatcttaagattgtctatgtccctcatgaagtgattatctccacgagaaagggatctgcatctttcttgttcattgctgaatccccagcacctaggacagtgtctggcatatagtaggtgcttgataaaaaaaaaaaaaatcaatgagcaaggctgaccttcaagcacatactgtgcctggctccagatcaaagcctttagagagggcatttcatccaattcttggagcattgtaccagtggcagcttcattttatacatgaggaaacaggcttagagaggtgcagtcctgaatcccatggcaggggcacctgggtggctcagtcagttgagtgtctgactcttggtctcagctcaggtcctgatctcagggctgtgagttcaagccctgtgttgggttccctgctgggtttggagctcaccttaaaaaaaaaaaaaaaaaaaaagaatcccatggcaaatttgcagctgagtcagaactaacaatacggataataatagttcctatttatatggcccagtcattgtacggaacacttctcgcagagtatctagtggcattcttggagcagtgctgttcaatggaattctgcagtgatgcagatgtccagtgccgctagctccaaatagccactgagcatctgacgtgtggctggtgtgactgagaaactgaatttttcattttatttgattctacttcatttaacgacagacatagctggctactgtagtgggcagcttggcttggagccggcccacggatgtaggtctggttattgttggtcacagctgtgaagcgtggtgggatgctctctgtaatgctccccagggaggcagagtggaagttgccccccacccccacccccggacttggcaatgtgtcccttcggccctaggagacatccctgccccctctgcgtgtgctctagacggatatagctctgctgggccctcttcctcctggtcagctgacttctgttttttcttcccagatttctatcactccaaacgccggctgatcttctccaagaggaagccctaatctgctcaccggaagcctcaagctcctagaaatgagagcccccccacatcccaggccccttctacaccttttgcctttactccttcagtttgtacgtcttaattattatttgtgttttaatttaaacttctcctcatgtacataccctgcttgccaccaccctccccccccacccctccccagcctttggcatttaggattatttaaaaaaccattagatagcagaatgataggcttattagagtgctaggtatttttattatgcaaactgttatttaaatacatcttccccctgtgctcctcatttccactctcccagaggtaaggtggggctggcatgaccctcacctgctgggtggtgttctctggaggggcctggctccctctgctcaccgcctggtaggtgttctgaaatttcgcccccttcctgccttcccaaacctggattctttatcatttgagaagtaaacagcactttgaaggggggcccagcagggtgggggcagcatcaaaactttggggtcctctcaccttctctaaggttgggcagggtgaccctaaagtgggcacagcctagaacactctgtcctgtgaaggcatgggggaaggtagggtcccgtagcaaaccaccccacctcccctcaccccctctgccaccacaagggagacagtctccatgtttggcctcccatgaggtcttctaggagctctggatgccccctgttttccagctgggctttcaagtctctctctgtcccccgcccctcccccattctctttcccactaggaccctctcagtcctgggtggcagctctgggatgcctgttcccccagcttagtggactgagagggtttcctaggggtatactagaagtgggggtccccagttctacctcaggcagctcaagcagcgaccacctcctcctctcacctcctggggcagaggtcctgagagggtgagataggcctacttgagtggggaatctgtcaggggcgtattgggggggagcagatttttctaggagagagagggcaacaccagcccctggaactcatccaaggactttccccactgccctacccttcccccatttcattgcactttgaatagcagctgaacaaggagtcagatgttttaagatagcagaggtagacgctgtggatagggcatgctacatgggctagttgtgagttattgtctcttctggccctgaacattgagcccctagaggtactgaagcacttagtgggtctgaccccaaacactgtaagctcctgtaacatcctggcctgtactgttttctcctggctcctcatgtgtcctggttctcctgtttccacctagactataagcctctgaagggcaagaacaagtcctgtactgccctgggtctctcacagcccctcccgcagtgctgggtacacagcaggtgctcaataaatatttcttagtaacttgtattgtgatcaatatgcctcaccatttgtaagcacaagtaggtggaagattatgtgggtcgtttttacaattttagcaattaggcatttaaagttaaaaaatgccgagagcttaacaaagacaatgaggcaaaagacgacaaaacccaaaacaataaacatcacacctctgcaaagattgcccaccaggatcaatattttggttcattgtgtggcctctttttagtaaagaatatgttgttagtcaccagggacatgcaaatcattactcattggggaaatgcacgttaaaaccacaataagataaactgcacccttataatagagtgactataaggaaaaaagctgaccttgccaagtgtgggcaagcatagggaacaaccggaactcttacaccttgcaggcagaagtataaaatatctcaactactttagaaaactgtttgatgataccttccaaagatggctcgcctcatgcctgccccgtgacacaggaattccattcctaagtttgttctcaagagaaatcagtacatatttccaccagaaaccatgttcatagcagtcttgacagacccaaactggaaacaacccaaaagcccataacaaggatatatatgtaaattgtggtagctttctatagtagagtactgtagaacaaagtgacccacagctctatggtcaactcctctgcgacaaagcaggaaagcatattcaaaggaaaaaaagaagagaccgtctcttcaacaaatggtgttgggaaaactggacaaccacatgcagaagaatgaaactgggccattttcttacaccaatagaaaaataaactcaaaatgaatgaaagacctaaatgtgagataggaaaccatcaaaatcctagaggagaacacaggcagcaacctctgaccttgaccatggcaacttcttgctagacatgtctccagaggcaagagaaacaaaagcaaaaatgaactattgggactttattaaaataaaaagcttctgcagagtgaaggaaacaatcaacaaaaccaaaaggcagcctatgggatgggagaagatatttgcaaatgacatatctgacaaaggtatagtatccaaaacccataaggaacttatcaaactcaactcccaaaaaccagataatccagttaagaaagaggcagaagacatttttttcaaagaagacatccagatggccaacagacacacaaaaaagatgctcaacaccactcatcatcagggaaatacgaatttaaaccatgatgagatgtcacctcacacctgtcagaatggctaaaaattaacaacacaagaaacatcacgctgttggtgatgtggagaaagggggaccctcctacactgttggtgggaatgcaaactggtacagctactgtggaaaacagtgtggaggctccttaaaagttaaaaatagagctaccctatgatccagcagttgcactactaagtatttatccaaaggatacaaaaatacagatttgaagggatacatacaatccaatgtttatagtagccttatcaacaatagccaaactatggagagagcccaaatgtccatcaacagatgaatggataaagaatatgtggtgtatatatgtttatgtacatatatatatatgtaatggaatattactcagctaatgaaaaagaatgaaatcttgccatttgcaacaatgtgaatagaactagagggtattatgctaagcaaaataagtcaaagaaggacaaataccatatgatttcactcatatatggaatttaagaaatgaaaatgaacataggggaaaggaaggaaaaataaaataagataaaaacagagaggcaggcaaactataaaagactctataattaagagaacaaactgaggagcacctgggtgggtcagtcttaggttaagtgtcttgatttcggctcaggtcatgatctcagagttgtgagaccaagcccagcatcactctgcactcaggagtgcactccagtagtggagaatctctccctctcccccacccctcccctcagtcatgggtgctagtgcacgctttctctctctctctctaatataaataaataggtcttaaaaaagagagagaataaactttgggttgctggagtgaggagggtagggggatgggtaaattggatgatgggtattaaagaaggcatttgtcatgatgagccctgggagttgtgtgtttttttttttttttttttaagattttattcatttattcatgagacacagagagagagaggcagagacataggcagagggagaagcaggctccctgtgggggagcccgatgtgggactcaatcctggaaccccgagatcatgccccaagccgaaggcagatgttcaacagctgagacacccaggtgtcccagcactgggtattatatgttaagtgatgaatcactaaattctactcctgaagccaattttacactatatgttaactaattagaatttaaataaaaatttgaaaaaataaaagaacagagtactttacatgtatcttctgattatctgtttataattaaccactccaagactttagtggcttaaaacaataatcatttatttgcttctgactgcagtttgaccaagaactacttttcttttttttttttaattttattttattattttatttttttatgatagtcacagagagagagagagagaggcagagacataggcagagggagaagcaggctccatgaaccgggagcccgatgtgggatttgatcccaggtctccagggccgcgcctggggccaaaggcaggcgctaaaccactgcgccacccagggatccccaagaactacttttcaaatgttggataattgtctgctgtacaggggcatggctttgctctagaaccctagggctcccagttggagctcagcccgcactggggcttttcagagacttcacatataatatgtgagtaatatcctatggatatttctagtaccatgggatacactgactcatatgtcctgagtgcttgttctatagcatggacctgtcacagatttgtcttttgtcctagactccactcaaacatggcagctccccacatcatctagtaaatttgctggagagttaatataggcctccaaagtccaaataagctcacccatcctgtgcctctctatagggggagcatgtccacattacaatggcttgtcttttcttcaagagggaatggcccagcatgtctctgttcatttgaccacttaaactgtaacatgacaggtctctgaatttttgtaaggaatgtgaacatgggatctctgggtggcgcagcggtttggtgcctgcctttggcccagggcgcgatcctggagacctgggatcgaatcccacgtcgggctcccggtgcatggatcctgcttctccctctgcctgtgtctctgcctctctctctctatctgtgtgtgactatcataaataaataaaaatttataaaaaaaaaaaaagagggaatgccacatttaaaaaaaaaaaaaaaggaatgtgaacatgacccctttttttaaaatcccctttcctgaaatgaattgggaagaatgcactggccatattattagtgtcttacagtcagaacccacgtagactattctatagcaaaggcaccatatctgatgtaatggctgcaattagagctactgtgtagatagccatcaattgccatgtttcatttgaggtggatggaatggggatctgatggggactactttgcatactctaggtcttgagtgtaacactaatgtctgcatatccacctggcttgtggtagtgcttctgatttactgcttgactagtaggatgatagcagagacttccacttcatccttctttccataatggctcttattccacagataaggaaaccgatcagtgagggttctggcaacagctaaatatatccatcccaatttgcactcaggggctgggagataaccacagagtaggtccataggcccactggactctgagatgaacctggccaggactccattatcacccagccttgcatgtcctcctcctctaaaaggagcctataatggtattttgggtcggctggtactggggtaagctcagactctgtatcaaatagacctcaacagatctgttccacactgcacagctcttctgctaaatagccagagggcactttgaagggaagagttgaggaagtatttatttagtatacttacagtgacattatggggttttttcttcaatcagtgagtctgagtctgagaactggctcaaatttggcagctgggtgagaaattgtgatttttctatggtggcagctggcatcagcttttgctcaccccccttgaccggcagtggttcagtcaagccatgtcctattcaatgctcctctctcttagctttagaaatgccactgtcaaagggctctgctgacccggtcaggctttgtgtctaccttgcctctgatgattaagtggctgtctgaggcctctgctcctcttggatcatagtgtgtcccttgcgttgacagtggccatgtcatttcatgatagtatctcccagccagctctgagctcctctcactggtacatcctttattgctttgagaagggagggccttctgggccctcctggggatgacaggtccagggtggggggcctcactaggatgttcagtcctgagttaagagagagacttccatacaaactctctttatctagtctgtattcctcatctctcccagcactggtccttgagatctcccatgggtgtttccctagtcatacccatacttattagccagactgtagcttttttggtaacctgtactttcctggttgggcaatgttgagacttgaccccaatgattcatctagagaaggggccagcaaaccaaaactctgtggcctagctacctgttttgattaaagttttatgggaaagcagacatgcccatttgtttacctattgtctatggctggttttgctctattatattaaggagtgcaaagtccgaattgagtagttgtgacacagaccatgtggcccacagacctaaactatttactctcatgtccttgaagaagatgtttgctgcctctggtctagaagccatgaggggaggtggaatggatcttggggaaggtaaacattcacctcaggtgaatccttcgtgtgggcttcaggtagtgatagaaaacctcctctagagggtgcttctgcaggcctggggagcttaggggacatggggtacaggttcctgagggcatccatccacatatctcagcacccctctcccaacttttcctgctggctggggccatgcactgagcccccccgtagcaccaccacctttatgatgaaatcctggggctgattatcaacccagatgagggccatttagaatgctcttatggggttctcctgtctcccacaacatgctctaagtcaagcctgtcattcgttttcttcgagacctctagggcagttaaccaaagcaagccaaggtcacactcctcaccgcccccccccccccccgtctttccagcgttagatctacggtataagtccgtgttgccctggaatcccacctgttcctcaccccaatccacctccgcacagctgagtgttggtccttgtgtagtcacagcctgtcacgggctgtcaataccttgttcattgccagcagtccggtcccccttgtcatcacattggcaagggatccattttcagaagcccatactgctttctgtcatttttggtaccaggtctgggaatcaagtcccgtatcaggctccctgcgaggagccagcttcttcctctgcctgtgtctctgtttctcatgaataaataaataaaatctttttaaaaaatattggcaactaaagggaaagaattgaacttttttctacttgaaaaatttattttacttatttttactattttaccaatgtggtaaatatttgggaaagagctatctctagatcaaccaatacactttaaaaatattttgtattctgggatgcacgggtagctcaatggttgagcgtctgcctttggctcagggcatgatcctggggtcgtgggatcgagtcccacatggggctctccgcagggagtctccttctccctctgcctgtgtctctgtctctctctgtatctctcatgaataaataaattaaatcttaaaaaaaaaaatcactgtggctttaccctctcccaccagcccacagaaatgtgagctccatgaggggaagtctttgcctgttttgtttgcggctgtgtcccaggacctaaaaaagtacccaacacagggcagcccgggtggctaagggtttagcaccgccttcagcctaaggcgtgatcccggagacccaggatcgagtcccacgtaggttccctgagtggagcctgcttctccctctgcctgagtctctgcctctctctctgtgtgtctctcatgaataaataaaatcttaaaaaaaaagtacccaacacctagtaggtggtcaataatatttgttgaatgaatgaattattccctatggcttgtatttccttcctgaccccagtattcatctttcaaaccccaccccacccatccctgcttctggtcccgggttgctgcccctcatggcttgacaatcagtttggcatgtgaacagggctatctgcgaattggcaggatggacaagttggagactctctcagtccccttcttttaacagccgcaaaaataacaacagctaacactgatgatcatctgcctaacgcagttccaaatgctttatgcgggtttatagcatttaatcctaataacagacctaggagttgggcattgcctttgcctgtgttttacaggagataaactgaggcaataagcccttaagtcactcgcctgagagcactcaggtggggagccaggatattcacgcggatacctcaggtcatgtggcctgctccttgaaccctgggcttctaccatcgtgacaattctggggaggcctgccagcagtctcccctgtgcccctcctctgtctctgaagtaattttggggttttctcaatcatatgtaaagtgtgctgtataaatgcgaatttgcaccaagctccctggccggggttccctgcagggaatagccggctgcctacatgttctttccagagatagttgggaggcaacagctggaggctgggagcccagctctcgacactgcacctcaggacggagagtattttgcttcaggatttactaaaccttgaactgaattcaagcatctttgggggattgaaaaacagtgaatgtgaaactttcccattcataaaacagtctcaccatcttggatctccgttcatccactcagtttttggaaaatgtagtttctgagctcagtgtttttaagtccagtgacgccgtattttaaaataagctctgctgtttccaaaaaggcctggctctaacttttatctcagcacttggctccagcctctggccagctggcttgcaggcaggttccctcctggggctgctgcacggggcggccaggcctgacaggctgggctctgaccacttgggctctggcagggggtcctgggaccagccgggccttctccgtgccccttttatctccatgactgggaggtgggtcatggggatgtggggcaaatggactgaggatgctttgagatcctgggggctgggtctgaaagttccaacttcactctgcttcccagggaaatggagagattccctcactgcagagaaaaaggccttggatttgtggcagttgccccatccagcagcgaattgggttgaccctgctttcaaaatatatccagaggtgtctgggtggctcagttggttaggttggttaagcgtctgactcttgatctcagctcaggtcttgatttcagggttgtgagttcaagtcctgtgttgggctacatgctgggtgtggcacctgcttaaaaagaaaaaatggggggcacctgggtggctcagtcggttaaccaactgcctttggctcaggtcatgatcccagggttctgtgatcaagccccaagtctggccccttgctcattggtggtagtggtggggggtgtctgcttcttcctctccctctgcccctcttcccagctcatgttctctctcttcctctctctggtctctctctcaaattaaaaaaaaaaaaaaatctaacccccctaccccccaacgatatatatccagagttctctcaccatcacctccaccactgttttcctggtccaaactatctcttcttgtctgaattatcctaacagcccccttcctggtctccttgtttctgtgtttgccttgtacagtctgctatccacaatgaaggatcatgtcaccctccaaatggcttccacctcacttacactaagaacccagatccttacgtggcctataagttctcctttctgttattcccgaccttatcttctctactcttccctccacacaggtctagccacacaggtttcctcactgttccttgtgtacacaaaatgtgttcctacctcagggcctttgcattcactgttccccctcttcacattcttcttctaaatcttcttcctcataaggtctcttccaataccacctcagacaggcctcccccaaacacctcatataaagtatgcttctcaccattttatccattcgctccgctttacttttcttcatagcacttattgttaccaaacattatatggcatatgtttttttctcttagttttgtattctttttttaaaatttttatttatttatgatagtcacacagagagagagagaggcagagacacaggcagagggagaagcaggctccatgcaccgggagcccgacgtgggattcgatcccgggtctccaggatcgcgccctgggccaaaggcaggcgctaaaccgctgcgccacccagggatcccttagttttgtattcttagtgcctagcacagtgtttggtgcatattaggtgctcaaaaaatattttgggataaaaacaacgaatgccttatttagttcaataaagctatagaaactctgagtatcaatttcctcagttgtgaaaatgggataaaaagggatggtttgttgggagaatatatgtttatttagaaattaaataattcagtttcaaaactttatttatttttaaaaatattttatttatttatttatttattcatgagagacacacagagacagagacagagacagagacacaggcagagggagaagcaggcttcatgcagggagcccgacgtgggactcgatcccgggtctccaggatcacgccctgggccaaaggcagcgctaaacctctgagccacccgggctaccctcaaaactttttttcaaagattttatttttttattcaagagagacacagagaaagaggcagagacatgggcagaagcaggctccccgcagggagcccaatgtagtactccatctcagggtcccgggaccatgacctgagccaaaggcagatgctcaaccactgagccaccgaggaatccccaatttcaaaacttttggttttgaaatagtttcagacacacagaaaagttgcaaaaatagtaaggtaattcccatatacccttcaccaatagtctctgtatgtgaccattttagcacatttcccgtatcattctctctctgaataataaatttatttttgagcagataatgtataaaaatggtacaaaaaaagcagtggaatataaatttccctccttctctccagccaactgctaccagtttcccatatgtcctgtcagaaatatttggtgcatttacagccatatatgaaagcacatgtatttatagagcataaattttttcttcatgcaaaacatactggactcactgttttgtacctagctttttttttttttttttttaagattttatttatttgtttaagagagagaatgagtgggaggagaggcagagggaaagaatctcaagcagattccccaccaagcgtggagcccgttgtaccctattctgtggcccatgagatcatgacctaaaccgaaaccaagaacctgatgcttgactgagcaagccagccaggcgcccctgaaccttgctttttaaattcaacaatatattttgaagatcttcacacccgtccacctgtatctttctcctcattttcttcacaaccacagggtgggtcctatatgggcatatttgagcttctttaaccaggtccccgttgatggaaatttcaattgtttccagtcttttgcttctatcaacaatgctgtaatgaaatactgtcgtatcgacatttggggcatcacctacaggacaaatgactagcagtgaaattgctgagtaaaaagctctttcctttttaatgttgacagatatcaccacattgcttttcaggaaaactgtaccaattcacgttcttactcacaacatgtgaaaatgttttcctacatcctttacaacacaccacaccatcaataattttttgttctaacagttggaaaacttaaaaatatcacattgtagtttttttattgcttttattataaatgaggataaaactttttcacatgttgaaaagccattgatgcttttttcccatgagccacctatttatatagtgccaatttttctaatgcattgttgctttttcattgatctatgaggaactcatgatctatggaggaaatgaacttgttttctgtgatatgagaatatttttcactgtttgccttttggcttgtcactggtgacctttatttttgtcactcagttgtttattttttatttatttttaaagatttatttatttgagagagagagcacgagtgggaggggcataacagaaggagagactctcaagcagattctacactgagcacagagttagatgtgaggcttgattccaccaccatgagatcatgacctgagctgaaaccaagattttttttttttttatttttttttatttttttttatttattttttttttttaccaagattttttttttaaagattttatttatttatccatgagagacacacacacaaagagagagagaggcatagacacaggcagagcgagaagcaggctccatgcagggagcctgatgtgggactcgatcctgggtttccaggatcacgccctgggctgaaggtggtgccaaaccactgatccaccagggctgccctgaaaccaagagttgatgcttaaccgactgtgccacctgggaggatcttcagtcatttattttttatttggaaacttctatatagttgaatgtgtcaaattttttttttatggcttctaatgatttgtaataagcctgaaatggcttacttgctccaagattattttaaaaactctcctggggcacttaggtggctcagttggttaagcggctgctttcggctcaggtcatgatcccagggtcttgggatcgagcccggcattgggcattctgattagcagagaagaaagagcctgcttctgcctacctgtccacttacttgtgctctctctctgtcaaataaaaaaaaaaaatctttgttaaagagattttgttagggaagcgggcatgcatctgcgttttagtcctcctttggctcgggccaggtcccggagaaccggaatcgagtctcatatcgggctcccggcacggcgtctgcttctccctctgcctctctctctgtgtgtgtctctcacgaataaatcaaaaagattttattgatttattcatgagagacacacagagagagacagaggcacaggcagaaggagaagcaggctccctgcagggagcccgatgtgagactcgattccggttcccaggatcatgccttgagccaaaggcagacaaacactcaactgctgagccactcaggtgtcccataaataaaatcttttaaaaattttttaattaaaataaaaaactatcccatgatttcttaaaaaaaaaaaaaaagatttatttacttacttggagagagagaagagagaggaaggaccagatggagaaagagagatctccagctgactccccactgagtgtggagcaggattcaggacttgatctcaccaccctgagatcgtgatctgccctaaaactatgagtcagatattgagctgactgagccacccaggtactcctatcccatgatttctttctgcctttcattttctttttttaagattaattgattggttggttggttttttagagagagagagaaagagcatgcacataagcaggggaggaagagaagagaggaggaggaggagaaaagcagattctctgctgagcgaggagctgggatgcggggcttagttgaatgagcagaaatcaagagtcccaagtatcctgctgagccacccaggcaccccatcccatgatttcttacagcatttgttctaacatacacaagagtgtagagagactagaatgagcggacagtaacttcattaacttcaacagtaagcagaacagggccaggactttatttcacatgctccacctgttcccccacccttccattattgtgaaacaaatcctaaacttataactttatgatcttttaatgttgaaacttctgatccatctggaattattttattattttaaaaaagacttcatttatttaatttaaaaatacatttcctaaaaattttatttatttatttattatttatttatttatttatttatttatttatttattttagagagagagcatgcacatgagtggggagtgcagagggagagggagagaaagaatctcaagcaggttccatgctcagcacagagcccgataagaggctggatctcacaacccctgagatcatgacctgagccaaaatcaagagctggacactaaactgactgagccacccaggcacccgggattttatttatttttaagcaatctctacacccaatgtgggactcgaaatcacaaccccaagatcaagagttgcattctcttctgactgagccagcgaggcgccctcatctggaattattttagagttagatctccagcttcacttttgcagatagctagctcatttttcaaatcgtttattgaataagccatcttttatccactgatttaaaatgccacttttatttatttatttaatattttatttattcatgagagacagagagagagagcgagagaggcagagacacaggcagagggagaagcaggctccgtgcagggagcccaacatgggactcgatcccatgtatccaggatcaggccctgggctgaaggcagcgctaaactgctgagccacccggactgcactgtaaaatgccacttttaatatacattaaattcccatatgtacttgagtctgttcctgtcaattctgttccattcattcatccctgtatattcatgcactggtatcacactctttttggttgtagccctacagtatattttggtattaagttagactatttatctaaaagaaaatttggatgaaggcctcccctgatattccttaccacctgagggtgagaacctgagggaaggcacggtgtgcagttactccaggatggttcatacacccagctttagccacaactgtgcccatcaacactctggttgggacaaggcatagcaacatgctggcaaccgaagactcagttccaggttctggccttgccactgagagctgggtgaccttgagcaacctgtcttccccttcagagcttctgcttagaaagacctccctctcattcccagcactctctaattctacgattttagggtgagagacctgaggaggaccaggcaagattatgaaaggacaaccagtgcttgcttctacaggaagtcccatagataacacaggagattggctcgctggggaacggaaagagcgattaagcaagagacaagactgttaacagtgccagaactcgtgggctcctgggggcagcggttgcctcagcgccaagtccaggaggccaggactgtgtgcacgactgggagcctttgagaggtgggagccacctggagtcacaatgctctttttctttggaggggttggggttgggagaaggagcagtggtccccatttggctccaaggacgcaaagatctgagcccttttttctcaagaatttggagctctctgcatggtccagtgagggtgctggggcagggggctgggatagattgcctaccataagtggccgtgtgattttgggcaagtcacctgttttctcaggtgcctggtttctctcttcgagtctgtgagaggaagagagaggtaagtagactagagcaaggcactaggtagtctctcagacccaccaacttacaatttgggttctgtgaccatcactattactggtagttattgaatgacgtgaatggagtgaggagaagacccagttctttgcccgtttggagaaagaatgaaggaattgggggaagccctagggtagccgttccctaccctgtttttcttataaggctctccacaccctgacccaaagcctatagtgtctgttcccctaacccaatggcacagtggggagctgattcctgtagtttcctgggagcaagatcgatttgttctcaactttggcttccaactttgtctggtttctcaggtgaggaatgtggggaagagaggggagggctgagggtgccaatgtatgttcctggtcaccaggggcttctaatggtttagggtatgaagtagggatgttccagagaggggaatgtggcagaggatggaggagtgcccctgcaggctgactgtgaggggtgttgttctgagtgactccgaatgggcaggaaccttcgtacatgccaacaacctgtgaagaatgtcctatcagacccgtgagggagtggtcagtggtgggagctggctgaggagggagtgtgtgtgtgtgagcacccatgtacgcacaggtaaggagtgacagagaatgtcccctactatctttgggtggtcatgcttggctgtgaaaggggtgcagactgtttttagggtgtgctgtaaggccatgagggggaggggagggccagagggagagaaagaagcaggctccccactgagcagggagcctgatatggggctcgatcctagaaccctgggatcatgacccaagctggaggcagatgcttaaccgacttagccagtcaggtgcccccagaatttattttaggattctagtttcctttacttgtgggagtccagcagactcagtgatgtggcacccatatcattgtaaactcttcgcttagtgtttcagttctggaagcttctgccctgagaatcttatcttgctgcctcctgtatgttgtctccaacggaagtacatgtgcaccttgagtttccaagtgttacacctacaggcaaagccggcccactctgccctgctcccgaagcccttgtcccacacactctctgtcaggtccacacagagatggtggcatctatggtccacacaggggccttcggccaccaaggaggtacctctccaggaagtggtctgggggatcctggggggatcctattctactaagcgtcatggcttgggcaggcctcagcatctcagagcttttcttggcctgctcacaggtcaactaggaataaattgtatctgtacagtactcggcttttatgaggctcaaatggaatcctccccccccccccccccatttgtagcctttgctggttcacgtgtgtaaatactcccctggtggctgatcccatgccactggaagaaatgtgcacaattggcttctgcaagcccctcagacccagctttgcagttttcacctatgagctttaaactgcatctgaaacagacttgacaggcctgagagagagccatggggacagcaagacagagagaaacaaatgcagagataaaccacacaagaagaaagagagagaaaggctggcggagagagagagaggagacacttgacttctctttaaagtctggggaactctgcaggctgaggaatggccttattcaagtcctatgcagcctgtgtcagagaacttgcccgaagggaggctggaccagtggtgccaggaccctagaaggagcccaccgtccctccgttcagcctgtctgtgaccttccaccacagcagagaaagcccagaagaatcttcttgttcctgctggctcacactgctcatgtttctttgtgcgtgccgttcactgcttctaaatcccacctgccttctttagagcttggctccagtcccacgccctgcaggaagctgcctgcccgtgggcccagcaaggccctcgcacccaatggaattttatgtaccccttgcttattcccccagggcaggcccagactggatatcttccagactccttggggtctcacctagacaaatcttcatccatcaaaatcctaatcaattgactgacccaagactttcagtgatagttgggaagactccaattaatgaattggacaacccgtacatgagcacctactgtgtgctaaggagctgggaacactgtggaccaaagtgcacagtgacatccatagggggagcccagagcatcacggggccacagtccagggggcattgaacactgcttgaagtgtggagatggctgcagggaaggcttctcggaggaggcagtctctaaggtgagggaggaagaggcatcattaggtggaggataagagagttggggaagctgggcaaagggagcaaaatgagaaagaatctgatattctaggaatggaggtggttcaccagacttgacagaccatgagggtgtgggagagagtgggatgaagcagggtgcaagtctgtaagagctactgattccctggtgcatgtgtccaaggagcagggaaaatggtgttagaaattaaaaaaaaaaaaaaaaagattgttggaggtcaggtgagatagagggaggaagcaacctccaaggtgagatatgaggaaatgagctggagaactatcaggagagacagatgagacagctagatcctggacaaccgtgtgtccgcaccctcgactcaaaacagaacctatcctgcgtggggctcttttctataatggccaaaagatctaacagagatgaggacacatggatagcttgggggaaaagcattccaagcagaaggaacagaaagggcaaaggcctcatgctggaagccaggaggtgggggaggctcccgaggttggagaagccagctggggtccagttagcttcatcagctgtggtgtgttttctccaagagccgtgggagggttttcagcacagtgactgctcagcagcctgatgccacctctccattcttcggtccccaggccaaagcagcatggagagtggacagagagtgccccgaaaaggccgcaagctgggctccagccgccggcggcagatgcgagaaccagctgatggccaggatgcccccatggcttcagagccagagcccttgtcctcagaggtggccgtggagctgcagcgtttctttcaggactgtggtgccaaggagaggggctttgtcacccgcgaggacctggcggtgagtccacatccctagctcaccctctgaatcccttttctgtagcctcctgagacttcctatcccaggaaagcagggcaggcctgctctttcccctttctctcatctaaaatttgctttcaaagaggaactctcatgcactgttggtgggaatgtgaattggtgcagccacagtggcagatggtatagaagtttctcaaaaattttgaaatagaaatagcctacaatccaataatttctctattgggtatttacccaaataaaatactaattcaaaaagatatctgcatccctatgttcgttacttatagtagccaagatatggaagcagcctagtgtcccttgataaatgaatgaataaggaagaagtcacacacacacacacacacacacacacacacacacacacacacacaccaccaccacactggaatattactcagccacaaaaagaatgagatcttcttatttgtaacaacatggatggacctagagggtatcatgctacacgaaataagtcagacagagaaagacaatactctatgatttcacttagatggagaatcaaaaaacaaaacaaatgaacaaacaaaaagcagaaacagacccataaatgcagagaacaaactggtggttgccagaggggaggcaagtggaaggacaggtgaaatgggtgaagggaagagggggatacagacttctggctatggaatgaatgagtcacggggatgaaaggtacagcatgacgaatatagtcaagggtattgtaatagtgctgtatggtggtggctacacttgtgccaaacacagtgtaatatatagccttgtccaatcatatgttgtacatctggaactaatgtaacattatgtgccaactatacttcaattaaaaattaattaattaggggtgcctgggtggctcagttggttaagcctccaactcttgctttcagctcaggtcatgatctcttggtcatgagatcgagttccatgtcaggctctgtgctgaccatgcagcctgcataagtctctctctccctctctctctctgctcccccactctcttcccctccctaaaaaactccaattaattaattaattagttaaacaaaatacaaagatcagtgggcaaaaagcatggtttgtatgcaaagaaatgttctctgtgctagttgacaagcacatgtattttctgaagcaaataaataaatatgataaaatttgtgctcagaaaaggtgaggaatttgtttatattaatatgtaaatggatgatcaggcattatgcattcccatctttcagaaagatttgcacttaacaaaggaaaggacctcacaccaaagaaggaacttgcaagtgacataattttaggcccattgagcagagaagtttatcccggggagcagagtcctacaaaccatgtcaatgactataaatgtcagtgacacatgagattggccatggttgtgtgtcccacccaggaaggagtcttaggctctggcctagaccaatgttgactgatatttggtttttcctcattctctgcagagcggcctatgtggcttgctggaatctcactgggcctactgtctcctctggatacttttccatgctccagaccttttcctgcccctgtcaaaactgactttgcctgtgttctatcctcagggccataacaaagtacatgcaaacggctgatactgaaattgaattttcaggggcgcttgactggctcagtcagtagagcatgtgactcttgatctcaggggtcatgagttcaagtccaacgttgggcatagagattactgaaagaaagaaagaaagaaagaaagaaagaaagaaagaaagaaagaaagaaagaaagaaagaaagaaaaactttctcagggtagcctttaccaactccctcaaataagtcagtttctctctctctctctctctctctctctctgtcatgaataaataaataaaatctttttttaaaatttttatttatttatgatagtcacacagagagagagagagagccagagacataggcagagggagaagcaggctccatgcactgggagcccgatgtgggattcgatcccgggtctccaggatcgcgccctgggccaaaggcaggcgctaaaccgctgtaccacccagggatccctaaataaataaaatcttttaaaaaatcaagcaaataaaaaacagcactcatcaaagttcttatctagttaattattattactaattaatgaaggaaccactaagatgttatgattggctcaaaagcacatgagaagccagtatacagtatttaaaggcaatttgacaggagagtgttaggataagattgctgagttcaatttttaaaatggctgatgtccaacaggctgtaaatctttggggttagttgttctacaagacaaaaattattttcatctctcccgggcaaaaatctgcaagttaacaagtaactgcagcaagtctgggactttttaattaaagataaacaatgagatggactgagtacattcctctagtctagacaatgcttgaagggacgtgttctctaccttttggcctggtttccaagtttccagttattcagataattttctgtgatgataaataatctcccaagtctattcccaatataaaaaaaactctcattaggttgccacctattcccatccatgcagccagggtattaatgacacatgggcatgggtttgctctgcaaatatacactttgaaaatattaagccattttcgcttctgtccagatgttttcacacagaacctgagatttaaaacctcttatttgctcttctacctagagtgaatctctgtcccagtttgccaggggctggaaggatgcctgggatgtgggacttccagtgtcaaaactgggaatgtctggcgcagcctgggtcaagctggccacccaatttctatgctcaggccaggaaactaaacccaggactttttttaccagctgtcacccgcagcccctataagtgcaaggagtttcctttcttgaaattcccaatttttctaaggtccctctccagcccagaagtggctttccttatcaactggttccaggccaggttgctgggaggattttgcaaatatgattccatggctgttccttacagtagacttgtcacatatgattgagaattagtctccaacatgacaatcttttttttttttttttaagatttaatttgttgggcagccccggtggctcagcagtttagtgctacctcagcccagggcatgatcctggagaccccggatcgaatcccatgtcgggctccctgcgtggggcctgtttcttcctctgcctgtgtctctgcctctttctctctctctctctctctctccctgcgtctttcatgagtaaataaataaaatcttaaaaaaaaaaagatttcttaaaaaaaagatttaatttgtttatttgacagacacagagagacacaacacagccatgagtaatagcaggcagagggagaagcagactccccacagagcagagagcccaatgtggggctcaatcccaggaccctgacctgagccgaaggcagatgcttaactgactgagtcacccatgtgcccccaacatgacacgctcattacacaattgattcatccaactacatcccagcaaaaaaggaggacaaattcttattgaatccatgtaaataactatattgccatggaaagtaaggaggttcagtaaaagtatcagtttctgaatcaggaggggggtcaatgagattcaaataatatttaaaatgtttaattttgggggcacctgggtggctctgtggttgagtgtctgcctttggcccaggtcgtgatcccagagtcctgggatcgagtcctgcaccaggatccccacagggagcctgcttctccctctgcctgtgtctctgcctttctctctgtgtctctcatgacacagagagaaataaataaataaataaataaataaataaataaataaataaaatcttaaaaaggaaagtttaatttcagtttacagaagctgcaatctactaaactgaaagttagacatggctcaagaagacaaaaatcttcctcataaatccataaagatagaataaaaaataataccaactatattcccaacaaataaccacacctccattcccttgaaccattcattcagttctacatcattaattcctgatctgctggatcttgagtgagctggctgcttctggactcaagagtcttagaaattatcaggctgccagcttggctcgctaatgtcagctcagaatctttgtatccatgtgaagcatcagtagttcagagaacctggtacaatccttttccatgaggcttcgggtctgtactttgtggctcatggcttttaactgaggtttcaggccagggtaggaaaacagaaacatttttggtaatgagactgaaaagctgtggttacttattacagtaactattaatatcagagtggaagatgctaaaattctctgttgggatacagcacgtaactattttgtagggtttgatcagtgtttcctctgaagataagcacttatcaaagatcggcaaaggcactgagaaatctccagggccttcctataaagcatgcaatttctgaagtctttatatgaattgcattctacctacataaacttagcctaggaaagcctgaacatctcttctgatttgatggttcttcccatgatgttcttttttttcaacccaaaccatatatatacatatacattttatttttatttttaaattttatttaaattcatttcattaacatataaagcattattggtttcagaggtagagaccagtgattcatcagtctcatataatacccagtgctcatcccatcacatgccctccttaatgcccgttacccagctaccccattccaccacccccttctcctccagagaccctcattttgtttcctatgattaagagtcccccaccaaaaaaacaatgagtcccttatggtttgtctccctctctgattttgtcttttattttttcctctcttcccttatgatcctctgttttgtttctttgattctacatatgagtgagatcatataattgtctttctctgattgacttattttgctcagcgtaatatcctctggttccatctgtatcattgcaaatggcaagatttggggtgttttgatggctgagtagtatcccactgtatacatatatatataccacatcttctttatccattcatctgtctgtcaatggacatctgggctctttccatagtttggctattgtgggcattgctgctataaacattggggtgcaggtgccccttcaggtcactacatttgtatcttcggggtaaatacccagtagtgcaattgctgagtggtagggtagctctattttcaactttgtgggggacctcatagagaggctacaccagcttgtgttcccaccaaggagggaatgtaagagggctcccctttctccgcatcattgacaacatctgtcatttcctgacttgttcattttagccattgttcctggtgtgaggtggtatctcactgcggttttgatttgtatttccctgatgccaagtgatattgagcattttctcatgtctgttggctatttgtacgtcttctttagagaaatatctatttgtgtcttctgttcatttcttgattggattatttgttctttgggtgttgagttttgataagttctgtatagattctggatactatcctttatctgatatgtcctttgcaaacatcttctcccgttctatcagttgtcttttggttttgtcgactgtttcctttgttgtgcaaaagctttttatcttgatgaagtcccagtagttcatttttgcctttgtttcccttgcctttggagatgtgtctagtaagaagctgctgtggccgatgccccaaaaggttgctacctgtgttgtcctctaggattttgatggattcttgtctcacatcaatgtctttcatccattttgagtctatttttgtgtttgatgtaaggaaatggtccagtttcactctcctgcatgtggttgtccaattttcccaacaccatttgttgaaaagactgtcttttttccattggatattctttcctgctttgttgaagactggttgaccacagagttgagggtccatttctaggttctctattctgttccattgatctatgtgtctgttttgtgccaataccatgctgtcttgatgattacagctttgtaatagagcttgaagcctggaattgtgatgccaccagtttgagttttctttttcaacattccttttctttctttctttttttttttttcaacattcctttggctattcggggtctttactggttccattcaagttttaggattatttgttccaactctaagaaaaaagttgatggtatttttttaaagattttatttatttattcatgagaatacacagagaggagagagaggcagagacacaacacaggcagagagagaagcaggctccatgcagggagccggacgtgggacttgatcctgggggttaccctgggctgcagacggggctaaaccgctgtgccacctgggctgcccaaattgatggtattttgatagagattgcattgaatgtataaattgctctaggtagcatagacattttaacaatatttatttttccaatctataagcatggaacatttttccctttctttgtgtcttcctcagtttctttcatgagtgttctctagttttctgagtatagatcccttacctctttggtgaagtttattcctagatatcttatagtttggggtgcaaatataaatggaatcgactccttaatttctctttctttggtctcattgttaatgtataggaatgcaactgatttctgtacattgattttatatcctgccactttgctgaattcccgtatgagttctagaaattttggggtggagtcttttgggtattccatataaagtatcacgtcatctacacagaatgagagtttgacttcttcttcttttttttgttttaatttttatttattcatgataggcacacagtgagagagacagaggcagagacacaggcagagggagaagcaggctccatgcaccgggagcctgacgtgggattcgatccctgatctccaggatcgcgccctgggccaaaggcaggcgccaaactgctgcgccacccagggatcccagtttgacttcttctttacccatccagatgccttttgtttctttttgttgtctgattgctgaggctaggacttccaatactatgttgaactacaggggtgaaagtggacatttctgctgtgttcctgatcttaggggaaaagctctgttttcatatatatatatatgaaatatatatatatatatataaatcatatatatatgatatatatatatcatacacatggatactttttcaaaagtttaacctccatcctcctaacccaagccatatgtaatatcagatttttttttttacaggttaaaccctcagtttttattttcatctacatgaaacagatattgttaagatttctctttattgatataatcagctcactatcttttaggagcaagtgttaaacataactgttttatttgtattaattaaccttaatgaactttattttttttaagattttatttatttatttatgatagacacagagagagagagacacacacacacagaaacacaggcagagggagaagcaggctccatgcagggagccccatgcggcactcgatcccagaactccaggatcacgccccggccaaaggcaggcgctaaaccactgagccacccagggatcccaccttaatgaactttaaaaatacttcataagttattcgtattgtccaaaaggacattagaaatatttcagtatcaaggatttgaagcaagaatttctttatgatttttgaaaattattttttcaggtatttttaaattgagtcataactgacattatattagtttcaggtatataatgtgatgatttgatatctatatatgttacaaaatgatcaccacaataagtctagttaacagccatcaccatacagttacaacattttttttcttgtgatgagaactttcaagatctactctcctagctactttcaaagatgcagttcagtattattaactattgtcaccatgatgtgacaatattatatccccatgatttattcattttataactggaagttgtactttctttgacccttcctcctgcaacccctgcctcaggcaaccaccaatctgttctctgtattcatgagctcagtttttaggtctgttggttagttggttggttttagattccacatataagtgaactcattcagtatttatctttttctgtctgacataattcatttagcatagtgcccctcaagttccatccctgttgttgcaaattgcaagatttcattcttttatatggctgaataatgttccattgtatatatatcccatgtatttatttgttcttccatccatgagcatttaggttgtttctgccttagctactgtaactaatgctgcaatgaatgtgggagtacagacatcttttcatattactgctttgtgctatcttcaggtaaatagctagaagtaggattgctggatcctagggtagttttattttgaattttttttagcaaccaccatactgttttccacagggactgcatcaatttacattctcaccaacagtgcacgagggttcccttttctctacattcttgccaacgcttgttatttcttgcctatcctgctcttatgatagtggtgaagtatttaataaagacagagaacgatatcctaaaattttttcccctaaatttaggatcttatattgggagggcaaagtcagaagaactatcggagaagattttggccactggattaagataggatcataggagcctgagaaatagtacttcgttacctatttaatcaaagtgacaataaaataaaatattttgagataaacatagaagaaggtaatatgactacaaggatacttagctctttcataaaagagatgccttagatgttttataaatgaaaatatgatcaagtcaaaacagagaagtttattctgttgacatatggaataatttatcttgacaatttacacagaagataaatagtagctactttttaactcctgctaagagctctacaaccagttcatcattttaatggagatagagctgaattctagtttttgcattaatataacatgtggcatataacatataacaatttttaaaaattatttattttaaacccatcaaaacagagacaaatttgtcacttggcaaaaacacatttcatagcttatttattataaatcaaggcaactaaaattccctttcagcaaattcttcacgtttgtattttcatctcttttcatgttctgaaacaatcagacacttaagacaaaaccactcccttattccttagaaaatcaaaacgtatcctgttttccttgcagacacagctgtatctctgccaccgttggtcctagtagaggctcaaacatccgtagtgattataacttttaaccaaaataactaacttctatttcacagaaagagctgggatgcaaataatggagcactatctgtgttatttaagcattttagtagatttagcaaagttcacagacacgacacattttacagtcacacatatctcttgcacaagtttttaaaaatttgtcatgaaaggggggcttgggtggctcagttggttaagcgtctgccttcgctctggtcatgatcccagggtcctaggatcaagccctgcatcaagccctgcatcgggatccctgctcagcagggagtctgcttttccttctccctctgcccctccccctgttcctgttctctctctctctcaaacaaataattaaaaaatcttcagaaaattgtaaaaaaatatacataacatgaaatctgctactttaagcatttttatgtttagagtgcagtggcattgggtgcatttcacaattggtgcaaccatcaccaccacccatttccagaccttccccaactgaaactgtgtcccagagttcccattcccattctcctttctcttcatcccttggaatcccccactctcctttctatgaatttgaccactctaggtccctcatataagtgagaaaatatagtatttgtcttttgtgacccacctctttcactcagcatgatgtccctaatgctcattcatgccatagcaggtgtcagaatttccttcccttttaaggctgaccaatattccactgtatgcatagaccacattttgtctttctgttcatccctcagtggatatttgagttgcttccatcctgtggctattgtgaatagcactgctatgaacttgggtgtaaaaatatctacttgagtcttgagtttctgcttggccttgcacaactatttaaagtggcaagaatgggggcacatgagtggctcagaaggttaagcattggactctggtcatgatctcagggttgtgaaattgagccccaggtcaggctctgtgttcagtgaggagtctgcttgggattctttctctccctctgcccccacccccacctgctctttctctctctctcaaataaagaaataaatcttaaaaaaaaagtaaagtggcaaaaatgaattcactcattaacataacccaaagttatagctgccctcttgcatgtaaaaataaaaagtaaaaggacataaacttaaaattatgcttagcaatcaatatttcagtttttctcagaaactatccccgtagccaaaaattatttattaattattattaattcacatttttgaagttacctaaggattttgggactgtgtaatgagtcaacttagttgaacacaaatttactttttttttttttttttttacatttttcttatcttaaacattatgtaagggatccctgggtggcacagcggtttagcgcctgcctttggcccagggcgcaatcctggagacccgggatcgagtcccacgtcgggctcccggtgcatggagcctgcttctccctctgcctatgtctctgcctctctctctctctctctctgtgtgactatcataaataaataaatttttaaaaattataaaaaaatttaaacattatgtaaggataatgttgacttatttggtcagtaagacaaaatcagaagtataagaaattaatattaactagtttcttcacataaaacaaatctagatcttataaaaagtagaatgtttaattgtattatacttaatataaagcaaacactgatagccattatttgcattttataaacaaaattactaaaccagtctaatttacccaaagatttacattaattacgttaacctggctccttaaaagctttctgagctagcaatttcttgtaagagggatttttttttttaagtctagcacatttaggggttcctgggtggctcagtcggttaagcgtctgcctttggcccaggtcatgatctcagggttctgggattgagccccttgttgttgggctctgcactcagcagggagtctgcttctccctctgcccttccccctgctcgtgctctctctctctctctttgttaataaaatctttttaaaaatatttatttattttatttatttatgatagacatagagagagagagagagagagagaggcagagacacgggaggagggagaagcaggctccaggctccatgcgggagcccgacgtgggactcgatcccgggactccaggatcatgtcctgggccaaaggcaggcgctaaaccgctgcgccacccagggatccccaaaatctttaaataaataaagtttagcacatttaaagcactagaaattcagtctctttattcatgatttcggagaacattagatttatattagtgcttatttgtttctacaaaccaatcaacacagaaaccctgtaagacacatagtactctaagtcattaataccctccagatgtagaaaactatttcacactcacagaagagctaaaggtctttctgaattacagccatgtagacacccagatacagagacccaggggcttcatacgtacaactccagggcacagatcaaaagtaaacacagacacacaaaactaaacagtccagaactcaaagagctggtctccttcctagcaggtacaaaatgcttcaatttggagcatacgtagaaaaaccaccaccaacaacaaagatcagcaaatcagattttctgttgcctctcaaccaacagatactctgtctccatcatgcatcccacagggatcgccaatggccagtccatagagctgaattccccatcattgctatcaccaaaaatgaaaacacagaatcagcaagaaaaaaaagacaaaccacaatagcaagagaaacagcaaacctaaagttctgtcacacatgggattctgtccaagagccaagggaggaaatgtttgagtttctcaaagcctatgaggggcacatctccagcaccacacattcttggttctgacaagtgagtttacgggggcatctccatggaacctccaaaactcttacagtacgagttccaaaaaggtaaaatcatgacccttgggcaaaaagaaaataaatccctcttaaaggttttatttagctcattagttaatgagagatgccatgagtagttgacagagcatttaaaaagctggataacaaagaagtgttagaacgagattgctgagttagatttttcaaagctggttaatgtacaacaggtcataaatctttgaggtcatctgagatctccagtctgtcccaggagatgaaatgaagtacattcttacagtccagaagatgcttgggtggcctctgcccttgtggaatgctgaaagagtgtgctgtccacctttgggacttattttcaaattccagataacttttttggatctcgataaacacgtcctggggaggattagccaccgtccttagggatgagactcagaaggggtaagtttttattgatgtcagatggaggaagggaaaagatgtgtagggagttgaaggctctgccgagagggctgtcttgagtggggtcctggagcctccaaggtaggccctggatcagcttgggtctgggactccaaagatggggagggaagggatgggggtcgctaaagacaaacatttctcttttttttgaggatagcccagagtcttccccagggcgaagagcgccaacttacctcttccttgcaggtggccaagttcagcttcgtgggcagcgaagaggagctggagatgatctttgactgggtggatgtggagcagaagggacgcctctctctggaagaattcagctctgggctcagtatgtctgtcctgggagaactctagtgacttgctgcatagccaggcatcccatgcagtgtgcccagtacagggaggctaggctgacataaaaggcaacataaaaggcaacagggaacctccacagcaccccgagagcagttcatggcatggatgatgatatgaattactctggagatgaggatactaagtccatgcgggcaagcagttggtttaagacagggctaggccttaaggctctagcccaggagacctgctcacttcctttcctatcagcaagagcagttctttggctggggatggaggtgctcctcttagcatcctcctcctccagggaggcctccaggcttgcttactttctgatgcctcacttgtcttctccccagcaaaaggttcccttgagcaagaggttaagcaatccccagtcttgagaccacaggctttgtttctgcctgaggaaggtcacattctggctttgggaattcctggccccagggagcaacagagggtgatatttagcagttgggagcttcccaggctttctttgtccccctttgggcagggctactccaatgcttgcttctcaggacaggcccaaaaggacctaaaaaggccaaggtcagcagagcacaatactcccactgatctcgatgcgggtaaactttcccgccagagcaatggaaggtgtaatgtccttgccgagaccctgcagagcacagctcaggcttaaatgcctgcaaagccgttcagagttctcaggtctgatgagtctctgcaagtttgggggacaaggaggaagaaggccaggaatctgcatttacaggtcataaaatggtcagaatgtctaccttgaacagattcccatggatgacagggcgaatgtatgaacgtggccctgtataaatgtgatcacacagagagaattacttccccaagggccggaacaggacaagatgggagatcagtggacccaactccactctgctgccttttgtcccctctgtcccacagagaacatcttcagctccagcctgggcacccacaggctccacaggaagaggccactgtcttccaagagagaacctgcagctgccagtttcctggcactggaggaggctgaccatgaggagaaggaggcgttctttgcctttatccagcagctgggggcaggtgacgtcctcccagagtaaggccagcactgagtgtggaggggtgggggtaggaggcaggggcaggcactgcccatcagtgcggggcaggactggcctgggcacaggtgggaggccaccaagtagagcggggtgcaaatctgggtttggccacttgggttagctgtgtgaccatgggccggtagcctaacctttgacatctgttctccagctgcagtgtgagtgtaaggacagttgtgggatgaaatgaagcccacccgtggagaatgtctgttcttggggagtccctcccacgccccctcctccgctccctctccatcctgccctatgtgattgctccccaggattagcggcctggggtatcaacctcccaggtgtagtcacaatcttaaaaacatgactacctaaaaaaaacaaaaaacaaaaaacaaaacaaaacaaaaaaaaacatgactacctgagggggcccttttttttttaagattatttatttatttattcataagtgacacacagagagaggcggagacataggcagaggaataagcagggagcctgctgtgggacttgataccaggaccccaggatcatggcctgaaccaaaggcagatgctcaaccactgagccacccagatgtccctgagggggcctttcttaactagaaaagagggtcccgaggatccctgggtggcttagcggttttagcgcctgcctttggcccagggcgcgatcctggagtcccgggatcgagtcccatcccagcatggagcctgcttttccctctgcctgtgtctctgcctctctctccgctctctatgtctatcataaataaataaatcaaaaaaaaaaaaagaaaagaaaagaaagaaaaaaagaaaggaaaagaaagaaaagaaaagaaaaagaaaagaaagaaaagaaagagggatccctgggtggcacagcggtttggcgcctgcctttggcccagggcgcgatcctggagacccgggatcgaatcccacgtcgggctcccggcatggagcctgcttctccctctgcctgtgtctctgcccctctctctctctctctgtgtgactatcataaataaataaaaatttttaaaaaattaaaaaaaaagaaagaaaagaaaaaagaaaagaaaagaaaagaaaagaaaagaaaagaaaagaaaagaaaagaaaagagggtcccctcaatggagtgattcatgtacagtgatgccctgggttgggcaggtttggagatggggagggcatttcctccagactgtctcaggctctgggcttacggggttcactcatgctcagagaagggggacttctgcctgtaaatacccctctcacacctcccaggtcctcctgggtctcttagaaccatcaggggaatcaccctgcctgtttacctgcctcatggggctctgcaaggacaagctctcagagggtgggactcagggtacaggcaggcagggcaggtgtggtggatggggagccatttacctacttggcagcttggcctgggcccagccctctggcatctatcttcgtaacttaattaaatccttaggggggatccctgggtggctcagcggtttggcacctgccttgggcccagggcatgatcctggagtcccgggatcaagtcccacatcgggttccctgcatggagcctgcttctccctctgcctgtgtctctgcctctctctctctgtctctcattaataaataaataaaatatttttaaaaaatccttgggaaagcagcattaattgagtgccagccatgtgcctggccccaagctggcactttcactgggcacggctcattctccggtgaccctactgggcaggtatcaggctcccctttgtacaaataagcccagagagggcaagggagttgccaaaggtcacacagctacagggtgagagaagagggaagacagatggcagcctggggccatcaggctcccagctcctcccctgccccattgccaaatcaatgagccacaaagtaccgtgggggttcaagaaggagagggcacatctgggaagggttcctggaggaggtagtaactcgaattgtaccttgcagggtatgaaccgatttttgtggcccaggtgcccaagtttcttcgaatgttgccatcaaaatagagaagtggggggtgcctggggggctcagtgggttaagcgcctgctttcagcttgggtcatggtcccaaaatcctgagatcaagccccgcattgggctccctgctccatggggtgccggcttctccctctgcctctctctctttctctgtctctcatgagtaaataaataaaatcttttaaaaagtgaaaataaaaaatacaatacaatacaataaaatggagaaatgggccctctgcttactggctccacgtcatatctcctctctggctgtccccccttccccaggcaggcagaaatctgggagctgtgggggaagcttgaggcaggaggagccccagcgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtggggctcgttggggcctcacccacctggtgtctggcacagagtatgtgctctttacattttagctaaacgggaattgaattccctcagctctgggcttaggggtgggatatggtgacagcaggaagtggggcagagtgatggggcgagtgggaccatgtgacagggccggggaaccagtatcttgatgatggttacaggagtcggcgtgtcgggatcaaggtgaccaatgtcaagggtgtacgggtcaggggccattgtcgggatgactgtcctcagggtgacaggggtcagtgatcactggcggagcgaggcgagcagcgagatggactccacacccaggcccagagcggccctgcccgcagcagggtccccgggtgctcacgggctgcccggctccccctcgcaccccttccaggcggcactccgaccaccatcgggaggtccagcagctctatgaggagatggagcagcagatccgccgggagcagcggcagctgcaggctgaggtgacctcccctggcagcgccccatcctgggctcctccgggctgatgctggccagtgcgggggggggggggggggggcagctcctctcacccccgcatcctcagggagatgtgctgggagtgctgggcctcgcccggccctcccggccctgcccaccaggtctcactctcctcgcctcaatcttgttgccacaatctcggccggagccagagaagtggtcgtgagaggcgtccccgtaccccggccgggtgcgggtgcgggtgcgggtggagtgtggggagggctgggcgtcagcaggccgcgggggctgagacctgtctgctcccagagcgactcccgcggcctggccttcagctcccagatgcaggaggccctggaggccaaggagcgtgaatgtcaacggctcacggacggccagagggaggtgagtgccagcgcctccccgggagcccagattctgaggagtcacacattctgacaccccgcttctcagacttcaagggggtggctaggccagagagtggctccctttgccgagatgaggtcaggtagtgcagaggggccactggaaaggtccaggttcaaatccctgctgttcccattaggagccaggcaaatctgaggcaatgactttgttgctttttttttttttttaaagattttatttatttattcatgagagacacagggtgggggggtgggggcaggcagagacacaggcagagggagaagcaggctccatgcagggagcccaacgcgggactggatcccaggactccaggaccacaccctgggccgaaggcaggtgccaaaccgctgagccacccagggatcgatcccctgaagcaataactttggcctgagtttctccatctataaaatgggactaaccacatctactgcatctcctaggccagttgtgtcaaatgaggtgataaataggaaagcactctgaaacagaaagtcactgggctaacatgaggtcacagtgttagagaggctgagtgatagggtggcattcaactcttatgtccgctgacagctgagtcacctggggtaggtttgtaacctctctgagccttggtttccaaatcagaaaaatggagatcagaactcttgccctagagggctgctgggatgactaaagataccatatctgagggcctagcatggttcctggcacacaggaggtgcttttcacatcacaattgttactgactctgaatctgacctagctccctgctaccctgacaccccagatctcgtagcccatagtcacttccagttggcatcgcagctaggtgtttgggtctgagatcctgctccccccaccatctcttcctttctcaactcccagaccactgaccttagtaaaatcaccttctgatggaaccaggacaaccacctttccttcagcgctgggcgaggttcccagagcattttccactgtcgcctcgcctggctctgttatctggtctcaccttcccaacatgggctgatttccagatgcctctgcagcagctgctccttagaaattgaggcaggccccttcagccaagggaagagtttggactttccaaaatggggccagtttgtcctgtcccccgtagatgtgaagcctctcctctgaagtcattcattccttcacctgacaattcttacggcatgcctactagtgcctggcactgctctagggtcctgaggaacatgatagacacaaccccctgcccacagagtgatagccttagtcaggaagatggatgaaaaaaaaaaaaaaaggaagatggatgataagcaaaataagcaaataaaatctataacatcctggaggctggagagtgaaagtgctaaggagaatgaagggaagcaaggaaggagagtagaagggttttgacaagagggtccaggaaggcctccctgagttgatggcattggagtaaaggcctgaaggagatgaggcatgagccgtgtgatacctggggaagggcagtccaggcggtgagaatagtgagttcaaaggccctgaggtaggtgcgtgccatgaatatccagggagcagcaaggagaccggtgtgctggagcagacagggggaggggagaggagtgggagaggagggcagagacctcacagggcgggagggactgtgcaggcactggatgccactgtgaaggcttcactttctcttctgagtgctcaagcagccccccatctctgagtatgtgacttgctgtggctcaggagctccctgtggaccacttggggttcagagacaagcaaccattgcggagctctgagcagaggagagtgtgatccaatctacgtttcgggtccttgtggtgctggccgtttgtgtttcttacacagtccctctgtcctccctgcccagcatttcaagtgtctctcctggacgggaggtcacggagctaatcaggccaacaaggggtaaccacgccccgcccccaccaaccctcaaccctttgtttaagctgggtctccaggagcctggagtctgtgctccacagtggctttgggaggctgcttgtcgccctggagggccccggggcttctctcctcctcaccctccacctcccgcagctggaggcccagctccaccgcctcagcagcacacaccaggaggcctgctctgagaaccagcagctgcgggagaccgagcatgacctggctgggcggctggaggaggtgcaggggcagctgcaggtgaccagggggcatctgaacgccgccaggggccgcgtgtcctggcagatggaggaggaaccaaggcaagtagctgccatccgtgggctaaggtgggtaccagggcttcctaaaggtagggagggaagctctgggttctctgaagccctggttcagcacccagaacacatgcagagtttcccttcttaaacctcacgacaatcctgcaaggccacattctcctgcccatttctcagacagggaaactaaggcaccaagaagggaaagtcatgtgcccaagttcacacaacttggatacacacacacacactgctagtatagtaatggatcccagaaagccactcactctacctgttagagctcagaggagtgggatgggccagaatggtcagggaagacttcctggagaaggtgaggcttcatataggccctgagagatgggcaggattggacaagggggaggcatggggcgcatgcagggtggggaccacctgaggagagactgggggttggggtcagctgtgaggtgttaccgatggggagaggttcccctgacctcagcttcctaaacccttcctagtgtcccccgagcaggtgaggagaaggcttcagatgcccaggcagtcccctctgaggaggctcccctgcccggactgtttggggaggaggatgactgggaccagctcctgagcagcttcaacacctcctcgcgcagagctctgcagctctcctggagcccacctcccaccccaaggacccccttgggcccccagacaccccgagttgtcaggcagatctccatctcagagccacgtgctttgccgtttggtcaggagccaccttcagatctggaaggggctccaaggggccctgctggggcgccctctggagccaaggaagtgaaaggagtgggcgcagatgggcaggatgacagtccagagcagcccgtccagtctcgcagcccggaacctcaggaggagtcagggtctggccctgaggccctctccctccggagtttccaaggggccaccactggggagtcagggagcctggtggcagctgcactcaaagtgctcattcctttggaggatgcacctcctcctctggtgacctgtccctctccccaggccccagctgggcccagtgacagctgcaggcctcatacccaggtgacaagattccggggcccgggcctatcccagacaagccgcctaggcagacagaggccctccattgggaccggcaggatcctggctctgagccaggactggggtccccaggagctgaagtccttataccagggctggctgggccctcccaggatccgggacctgtgggtcaggctccctcagaggggctggagcgggcctggtgcagccctggtgtgcagggaagccagcccggggggccaacagaagctcagggccaggtctttgggccagatgggctgtctggcctctcccttgagcgtctggaagagcccagggtggagggaaggaaccaggtaggccgaggaggacaagacctcagttcagagcagtcagctggggctcacagcctgaaaactgggcattcagaagccccccctcctagaacggggtcacctcccctggagtctcccctggagggggctcagcctggggatggagcagagcctcaggagcaccggcgcagctcccccaccacagtggagctagaagttcagcccatgccctcacctccaactgctcatacagaagaacaaggctcccttcgatccagggagccaatggcagagaacagactcgaagaagacccaggaagtgagcccggggaggctgcgctgaaccggtccccggagtcccccgcggccagcgagcctctagccgaccccgattacctcttccatgtcatcttcctgggagactccaacgtgggcaaaacatccttcctacacctgctgcaccagaattcctttgccaccgggctgacagctactgtgggtaagggctgacctggggagggaggctgcagagggaggggatgcccggggagacccagggccaatgagctggaggcaagccagacagatccatctccctgggaagctgcaggttctgtcctggccacaggccctgcattagactttattttatatgggcacaatcttactattttactaattatctctaattataggtaatttgctttgctgcattgatctgattagcttataatgtgccgcaccaacaaagcaccctgcaatttaggggccagagctggttgccagtgaaaacaagcaagtctccacccacatggccctgggggcaggccactgcagggtgggtgccgcttgcctttgctcacaattagccccaggccaatgggccaagctctggcagagagttgcccggggcaagttgagtactttacacagaatgtgtttctagagtaaggtcagttaggagctcagatacctgagttcaaatcccatctctgccacccactagcagtaaggactgggagaaattatttaacccctctgaactctcaaaccctcatctgcatcatgcagactgcataatgcaggcaagtgtacaggctccctaaaataggtgtaaggatgagttcagtttgtacatgtcttagaatatctggcatgtggtaagtgctcaatattatttttattactattatcataagcaaatatttgatcatgtctaatgcagtggcccctgcaaatgaaatatccccaaacacaaagactcctctacctacaaatgttgggatctgtgatcgcttggcattgtacagagccacggaaatgcaagctcaagaatgaagaggacacccgcttaggcacagagatggggggacccatgtgtttgtgccaggcaaagtgcatgctaactggggaccagcgccagaccaatgggtagatgacagacttcatgcaaaagaggcttcaagatgggttctcaaatttttctttaagaatcctcacctgggggaaccagttaaaaattcagtgtcttggggactagagaacttgcagcaggcctggcctgctgttggggagggtcacagggtctgcgagcccactgttctgaatcatctgaggtcctggttactgaccacctacaatgcgccaagcatcttccgtgcctccttcctttacaaaagccctccctatataactgatctgcccccattattatgtgataagaagattccacaaaattcaatcaagaaaaacacaggttgcataattgtaaaaagacagggcaagcctgcactcactgctagtcggctgggagtacccgagatccaggggagtgacctgtgcccgtcccagtgccagctgcagtttggtgcctcctggtggctgtcatccatctggcttcaccatcaatggggacaattctggcttcctcggtcatgaacatttccacacccagcgtcacctcctctgtttcctccccttctctcagaagatgagaactctagcctgctggcatttgagaacagggctgggtggagcaccagagccagagccaatggagttatatcagaatgtgcatttttgccaggcttttccatatccccattttacagatgagggaaacagatcatagaagacctggtcaggtttcctgccctcgctggggcccaaagttcatacccatggtctcctgctttcagagcacatgccccaccctagaaattctgctgtgttctgggttcagcgtgactctgcccctggggccgctcatgtaaaatagcagattccttgggaaggagataactgttatattcttagcgatttatgtggttaagttataacacgttttggggacatatgggagccacgtgggtggattgaggaggggatgggcaggttggtgggagtaatggtggagttaggaaatgcaaggaatacttgttaaagacgttcatagattacatggtgggcattcaagccaggctggatatcatcaccaggggttgggttagataatgtcataggttcatgcagctcttgggcttcctaggacaaggattcctaagtaaaagagcagtcaagagaagcggatgttacagacttctgctttgccattttgaagagtcaggttggccggagtagcttttctgttgtagagcgatgtcgaaagaacactctagagtcacactccagcatgggtcattattctcaagacctagatcttccttttgtaaattgttttgataaagcacaaatgaatttttgatgcctgacctatcacaagcaatgctcacaagagaaattttcttccctatcattttattgcatcagtaaggtatacattcgctctctcaactgtagaaatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctccttcttccctctgaggctgcctgtttctattccactgtgtggttgttgggggaagatccatgctatacttaggaatgaaacagagagtattataaaaataaaacagtgaaactgattttcctgagggacctgaagaataaacgttgctgtacggttgggaagacagatatgttcatagaagccaagacaatgcaaggtgcctcaaattggcaccgaccatccgggtgtgggagtgcagtgggcgaggcagtcaggaagggtttcttggaggattcaggctcttgagtatggatgggatttggagagctgaggggaagctcagcagccagaggagctggtgttggggacaggtgtatcctggggcaggtttgggctggaagccctggatggtaacttggcagcaggcccaacacccctgtgtgtgtcctaggagtggattttcgggtcaaaactctgctggtggacaacaagtgcttcgtgctgcagctttgggacacagctggtcaggagaggtaaggggccctgtctccgttagtggcgttggggccctgcgctgagcccaaggtgaagaggggtggagggcagcctgaccttgacaactccaactcaggcaagaggtgatcaagtataaaaaagccatccagctcctaagcatttaggaggttgggaaagcagagatgagtcaagcttctgtgggctcacagagggggcagcagacccagagtccccccccgcccttggcctcgcaggacagctgtgaaggccattccaacatggccctcgggggacagcttggccgatctccaggccttctgaaaatgctggcctgccactttccagtgaggcaggagtgatcaacgtgcaaaaggcacacccttaacccagcagttctgcttccagaaattcattgtgctggtgaactcacacatgactgtaataccagcatgtccatcgcaacatcgtctgtgctgggagcaccaggaacagcctaaacataaggactggtgggccagagaataagtcagggtctggctacacagtccatagaatattatgaagccaccaaaaaaaaaaagactgaggactctgtctgtgtgccagcggggaaacacctgcaagatgttatattaactggaaaaagcaaagcagatgagtgttttgccccctatttgtgtttaacagggaagagaggtgtacgtatgtgaaggtgcgtatgtacacggcgtgcatgtacgcatacatatatttgtatatattcataaaatacctctggaaactggtaaccctggctgcctctggggagggagactgagtggtgggggccgggggacgtggggacagacttttccctgggtacccttccgtaccttttgaaacttgaaccatgagaactgctaccttttcaacaatcactacgctgcaagaaggaaaacgtctgcacactgtcttcgggaagcagttaggagcaggaaagcttcattctcccaccttgcagctgaagtagctaaggcccagaggggccagggtgagggggcggcccaccaggcctggcctcatgcagactgtctgggcaggtaccacagcatgactcggcagctgctccgcaaagccgacggcgtggtcctcatgtacgacatcacctcccaggagagcttcgcccacgtgcgctactggctgaactgtctccaggtaagcagccaccttagccacctgcagatggctgttgggcttggccccagctttgggagtcaagagggaacttgtaccctgcccacgccctcttttctcccaggattacgaatgataccacggatatgtgggtgatgtgacccactgaggacatggggctggatgagctgggagcatagtcatatgaagaaaccacaaccacgtagtacagcctccaaaacaaactacttcctttatctcttgaacattcctttcctatatatagcagctctgcaatgtcttcttaacacctggggataatgcaaggctagtactactctaggtgataattcctctgtccacacatgtctagttctctcccccatgtacttaattgttccatatatactgaaattctgcagtatgtactagcactgcagaggggtatgatgaaagacatgtgtcttctctctggaagtttctagtccagctgaagagaagtaggataaggtctagtccggcaaaagaagtaggataaggtactatacgggggtggccaggctctgggtctgacaggacctcggtttgaatcccagctaccctgccccgactctatcatcttggacaaataacttctctgaacttccatcttcccacttttctcatacagttgttaggattaataggtacagttgccgttagaacaacaccgggtatattgtaagtgctcaggaagcagaagctagtggtagtagtactcatgaaacaatcaggaagtgagccaagccagcccatgtaatcaagtgctgggctgtttggcacaggcaagaagagagggttgtgggcaggaacaatcctggaaggcttcctgggggaggtaccttgggggctggccttgggaaatgggtgaatgtttgcaggcagcaagaaggggcatgttcactctagactgaagggaagatgtcgtgggtggggtaaaggtgtggagtgagtgttacagggaaaggccggggcaggggccgggggcagggttgggtgtgcacactgtcagcttcctggagggcagggccaaatcctcccagggcctggcacaccacagcagaaacccaacatgtgtggctaagggaatgtattctatgtgcaggaatcagggcccaacggggtggccatccttcttctgggaaacaagacggaccgtgaggaggagcggcaggtgcccatagaggccggccagcaactggcccaggtgagcacctggccatcagtcccccacccagcctggcctggacagaaccctccctggagggacatgaagaggtcaccctggcctgggccactgagaaggacccattgcccatccctgcccctacccctgccctgccagaggccgggtcagagtggacagcagcctggtctcctctgcctcccacccaccctgttcttagactgaaacatgcaaccagcgggtctgactttggctctcagatggacttagcagatccctacacaacattctgacctatataaaaatatcttcagagtaaaaaaaaaaaaaagttttaagagcttcacttaaaattcccaatcaaatcttaattttccctctggtctctaattaacataacattccttctaatttattctatcttaagactccaattcttccctggcaagattgcatcaaaagtcccaccaccagacagtggatactatttatttatgaacagaagttgaccacattccagaaactccagagaataataaagaagggaaaaagctcccagcccctgcccgccccccaccacaaccccccttggcatttccatattgtatttctttccccttctcccctcctttctcagaatcatgagctcatcaccatggctcctggttggcgcaggaatcgccccccttaaatgtagtggctcatctctttgacatagtaattcctcctctagcaatttatcctaaggaaagaatcagaaataataatccctacgagaatagcataatggatacccacatataatgtataatcaagcgtgtttatatgaggatgttctttacagtattatttataagaacaaacatttggcaggagttggtggttaagttgtggaggttcatgtgagaggccaccatttgccattaagaatcctgtcccagaaaaatatttgagggcgtggaggaagtgcctacaatgtaatgtgaagtcagaagagcagctgcaagtcccagcttaggttgagttgaaccctgggaggttgctgacattcgactgggtcctgccggagcagccagttcataggattgactccaccagcacgatggcatttagcccactcacccccagggggtcatataaaacggaatagaaatatatatcaaacactacctaacacgagtggtttatattttgcttttgcactttttgaaggctgtattttccaatagttccctgccctcagctgaatatttttgaaatcaaaaaacataactagaggactcagcggttgagcacctgcctttggctcagaccgtgatcctggggtcctgggatcgagtcccacattgggctccctacagggagcctgcttctccctctgcctgtgtctctgcctctctctctgtgtgtctctcatgaataaataaataaaatctttttttaaaaaaccacataactaatagtttaaaatgtccccaaggacatttctccaatttgggacacaggctttccatcgtcactcagggtgtgggctgtggaatgtctctggggtggcatctttgacacggtggccagccagggtggaggtgcagggggcaaggagccgagggccgggggccaggctgcctcacccatcgagggtggcctagggacaccctgggtgggattctttgatggccaggccatgggcatttctgccaggatgctcagtgggctctcccgggggtctgtctgcaggagctgggggtctcctttggagagtgcagtgctgccctaggtcacaacatcctggagcccgtggtgaatctggctcggtgagttccaccccgatgctcaccccctgagtcccctgggcagcctccagatcccgcctgtgggaagggaagacccactctgaggaagcatcatgaaactgtaaagctcaccctctggggaaggggagagagcactctgtggagagtctgagtccagctctactagttccattgctctgctcaccttctcaaagtctcctgcaccctttcgagctttagcttactttctcgcttacccagtgcagtgggcctgagagggtcaccttcctgctctcaaccttccagtaacttccactagattgacttatttatttttgacagtttttatttttatttgtttacttaagtaatctctacacccaatgtggggctcacactcatgacccctgagatcgcaagttgcatgtgcttcctactgagccagccaggtgctccaacttccgctagatttagaataaaatccaaatgcctccaaacggcctttgtcgtctctggggcctcccccgtccctgtgtgcacacgtgcaagcacacacatgcacatttactcactcagcctctgccactcagaggggccctccctgaccactctctgtcccaccactattctggatccctgtcccctattcgtgtccttcaaagcccttctcgacatattgtaaggacacaggcatttgtctgtttctctgttccctggttgctgtgagcctcctgccctaggcggtagctccaggaaggtggggccatgtctgttgggtccagctcccctccctctacacccagggcctggcacctactaggtgcccccaaaatgaaggaaatgagtaaggcagaaggggtccccggcccgatcatctggaagccccttatctgacaaagtagcccaggtgccacgtggaatgcagtgcaaggcagagcagatgagagagagggggcttcggggggcacaatcccccagccccacagaggatcaggtgatgccctgggttagacacctgctcaacagcttccctcagcttccctccttcaaaagcccgagttcctgaatgtggcttccaggcccccagggctctgaacccctattgcctctaaggctcatttatggccaatttggtctttgggcttcgcatcattcagcgcagtggtccgcacacagtaaatatatcgtgagtgaatgaatgaacgaatgaatgaacttctttgatttccctaagctctctcttgacactgagcctttgccctcagccggaaacaaaccccccttttctgctagggtcccttgtcctctgctcagcctcagctctgacgcagcctcggctctgacactgcctccttcctccctaaacccttcggggacccggcgtgcggtccctccatgtccttccttattcctggttctgacggcctcttctcctgtccgtttcctcacttctcaaggcgaggacatgctggcttcgtggtctcgttcagtgtcccttgcacagtggagaggcacacagtaggctggaaagaaagctaggaaggccacagaaggccagagtctccgtggccccattttcctggtgccacgtggaatgcagtgcagggcagagcagatgggagagggggcttcggggggcacaatcccccagccccacagaggcacccacaggcccctccgtgctgccccccgaaggtgagacagagggctgatgtctcctgttgtcatacaggtcactcaagatgcaggaggaccgcctgaaggactcgctggtggaggtggcccctaagaggtcacagaagagagctggctgttgcttctgaccatctggcccagccagggtaggacgcccaccccttgggcttcctgttcctcagctcctgtcccacctgcccagatgcagcagtgacacagatggccagcttgaaagttcaggaagatctccctcaggtcaagacttggatcccagggcaggggctgcatggacactgctgctcttgcactctgaagaaggatttgacgggggtgggggttggttgttcatggtgaaaaccctctcaagaaaggaaaagtctagaaaaatgaattaaggaaaacataccatatcattggccacacatctctgtgtggtaaaattatagggtgaatatgtgggggagtcatttccttttttataagtatttgtatttctctatctttggcaaagcttgggtattccttatatagtcaaaaataaaaataaatgcagagaggagggaaagaaactttccgaggagcttgctttgggggctgatgactaattgatacaacctgttaattacaaaatactctttattaagcagtcccactgttgcatgcctgccaaaaccggtgaaccttgtctcactctccatctgtgtgcgagcatcaagtttcttccgagcagaatccgattcccagggaagagcaatgttctgatgctccctggcaggccctactccccgtgtgtccctgagccccaaccccattccgtttccccaagacctgtctcgcaggggtcatattcggggatcccaccccttgctccaatgccacagcgtcccctggtgcagccttctgccctgaggtgggctggcggggtctggggagcagtggagaagctggattcagatcactcagaggctcctctttggagcttttgttgaagttccaaagtggctgcagattataaaccaggccggggtcctcagtgccattgaggagtctgcttggaaagtcttggggagttgacccctcagtgttggacaatctctcatgtcagtttgctgcaactgctgtccttgtcatcgtacatcgcaatgatgctcgccacatcccgcaatccagtgtgtgcgggacgctgagcttgtaatgattactttgtaatcgttcagtactggtgaaccagagagggtgggaggtagaagacagagccttcctacaggcttaatcagtctccaatcttggctctgtccctctgctcagttccggaagggatgcctgggatgcctctgcagcagtgagctgtttgtcgttcgaggcatataagtgcatgtcgggtgacacttgacaagaggcaaggtggaaaagattccggcatcagaagccaccaaagtttgcctcagctgccctaacggacctcatccagcctctggatattatgcaggatgattttgtgatacagccagttctcactgattcttacctccaatgtcttctccctgctgccatcctctttctcaactcacaagcctcttcctgctctgaacagttattaggctatagtagattccaggaaagacagacaaggagaggtggccacgggtgagggtgggggggcaggtcctactgttgctaatggctctctctgggacctggggacccggcaggcatggacaactctgtcctgtaggccagccggttaatgaggcaggtaagcagggtgtgattcctgggggagccagcacagcagatagaggccctgtcctttgggggacctggtatagaagtggccttggggcctgcccctcccatctcagctctcccccagctgcaggcggccagctcagggtccctagaggtgggatgctagaaaggaccgcacacctgcccaggactatctcttggctttctctggcaagatctagctgcggaggagcctttcctggtgtcagagggctccaagtcagcaagcagagcccaggaacctcagagcagcacaaggcacatgtggagagcagcaggagggactcaaggtagatttcagagtgaacttgccggcaagtggtgagttctcagggcatgtctgctaagggggctcgggtcacaccttagcttgagactgattaagaagaggcaggactgggctgatgggactcaggatgcagagagagaaggggagggcagggggagacaatggagcctggacagagatgttcgggaagagagctgttcagaactgggggtgggcagaagcaagacagccatggtgtacaaagtacctacttcgtgccaggcactattccggcacttaacttgtactgccccatttaatccccacatctgccctgtgagatggggcttgtggttatccccactttacagatgaggaaaatgaggcacagagtagctggaccacagtcaacacagctagcaagtggtgcagtggaattttgaacccaggctccggcagccacaagcttcaccacaaaatcatggtagttagaggagggtattgacacttagatggaacagggcccaggtccctggaccctttcttttcctcccctcccctccactcatgtcatctgcaggcaggcctgggccaggtagaagggggaaaaaaagatttacagatgctgagagaatgactaggattaggaccccacaggctgttgtgtttgctgttggctcagggtaaatactcaggaaatatttatttattgagttaatgggcaagtctctccccaagaaagctagggatgctggcctggtctgtagggtggcaggtggagacactggctaactctgggatgtctagaccccatttcccagcctgactcctagcaatcggggactctccatgtcttcagcatgtaggatggtgtgggggtgaggaggaagctggggtgcagcgctgcccctgaccctgccaggtaaccagcacacagccatagacggcagtcattcccaagctggtgtgccctgcagagtcctctgggatctttcaaaaaacaccaaagcccagcccaactaaatcccgtccctgggatgggacccatggattagtatttttgcaactccccaggtgatcccactgtgcagaaaaatttgggaacccctggcaggggcttcatgccttctcaaagcccctgcatatccacttccttacttgaacctcaaattaatatctgcctgtttcataggcaggcaaggtttttgttaaaaaatatataaatatataaatataaatatatataggtgcctgggtagctcagtcagttgagcatccagctctggatttcggctcagatcttgatctcgggaccatgagatcaagcctgcactgggctctgcactcagcagggagtctgcttctctccctccccttctgcccctccctcaaccctccaaataaataagtaaaatctaaaaagtgcatttggtgtgtacacaccgtccccaagcactccctgcagaaatcgtagaaataaagagattataaagaggaaaatgaaaatgacctgaacctcacccttttgtagcagttactgatgacatctatttttattgtattttcttccttcttcaaagttgaggaagctgaggtagggaacctgggtaactttcccaaagtcacggggctacaaagtagcagagtcaggattcgaacccggggtgctgacccggcctgtcccgccaagctgttgtgcggtctcaagtgattaccgcccgccaaggggcacccactggacgcggggggctgagaaaggtggggggctctacggggaaaaaggaagctggtttggacacgtgtccttgtgtgtctggggcaggaggatgcagcccgggctggagcccaatgccacgtccgccgcggggctcgcggccacacccgagccactgttgcgactcgtcctcgccggggcctgtggcctcgtcctgctggtggggctgctggccaacgggctcatgctgctggtggtgggccgcggcccgggcgcctcccggccgctcctcgtcctgaccaacagcctcatggtgaacatcacgctgtctgacctgctcttcctggcctgcgtggtgcccgtgctgctgctgagcttcctgcggcctgactggtggctgggccctgtcgtctgcaccaccagccaggccaccaacaatgccaccatgttctgtaccttctacagcatggtggccacggctttgctgcgccatgtggccgtggcccggcctgatgtggccctcccctctggcaggggcgcccgcctgctgctctgtggggccatgtgggtcctgggcctcactgtgtcattgcccaactggctgttccaaagggtggttgtggaggagggggccgcaggggcccgggcctgtctcttgctcctgagcccggcccagacctcctgctacttcaccctgctgggagccctggccttcctgccttgtatgttggggctcggctgctctttcagccacgtgggctggctcctgtggacacagcctcgtggccccattggggagagcatcctggagcaccaggagaacacagggttcatccttgtggtgctggtggtcttcgtgctgatgtgggggccctgctccgtgctgggctatgtggcagctgtgggtggcctgcctgccacgccagtggctttcgtggcatccagcctctgcaccatcctggcctactccaattgtgccgtcagccctgtcctctgcttctacctgtcccgccccttccaggcggggctcagggatctcttccgcaggccaagggcagccaggcgccctgggcgtgtgggtggggccagtgtgctgctggagagcatccgggacagggccccaggaggcctatggggtctggctggggtctgagaagataggctgatgggagacagggctgagagtcaagagaagtgggaagccctttagtgacattagagcatgtcccctccatttctccagtggggagactgagatccagagcaggcaggtggcccagcaaaggtgacactaggttgatgttcccattccactttgggactcagatactataggctttaccatttaccattttcttgttatatggccttgaaaaagtctcttaccctctctctgactctgttctctcatttagaaaatgggtaatgattataccatgttcatggggttgttgtaaagagaaactcaacacatgtaacacatataacatgcttagaggaatgcctggtgcttcctaagtgcatatgagtgttggtcattattattactatcatcatcgttttattaattcaggggcatttcaggtgagtggacgtgaggtcagtcaagggacttccaaaggcagagaagtgggtagaggaacaatccggagaatgacagcctggggtctttagtcctgaaggcctggggagtgagtggggggtgtagagggaaggagacaactgcagccagggtagaggcccagaggccaggagagtctttcaggaacctctcccttctttgcctgccctcccctagctcagtcacacacacctctctgcccaagaagggaacacaaagccacccttggagctgtgacgttctgaatgccctccttttttctctgtggtttctcttctcaatgtggtgggccccttccttctttccagagaaactgaaggtctccacctctcctactccatcttctctgagaagctcccaaactccaagccctccccctggcctcctgggagcaggcctcagacttctgtgttagctggggagcccaggagattgtcttaagtcccaagataacctgttctgcttggtaacagtgttacagctacacacacacacacacacacacacacacacacacacacagtctccatggtcaaaaagttttggaaacactgtattgaacaaaattaaattggtctctgctgcaggacttatcagagccttgaatacaccaaagaccactgggatttctctgagaggagctcggagtaggcagtttcccaaaatccacactagagaaccagtgttctgtggaacacaccttcagaaataacccaggagagaaactagtgttaagcacagtgaagatgcacccagccccctgaggcagaagctctggagacttgattcccctgccaggtgggcatctcccctcgacacattccccaaggcgcccagggagaggcaaaatgggtcactggttatgggaatttccttcttcccaagctatgaccccacccggttctcactcaaagcgtatcggaatgcgagtcagaggggtatctaattatagggacagccatgaatcagctctaatttactataaaataataagaagtaaataagtctcaaactttggtataattagtctcagatttcttgtgatgtgcagattgggactggctggctggagggctaatctgacagtaaggtggcctagagggagaagtcccctttccctgtgatcctggactctgccggccacagggatttatatatggagagggacagggaggagaaacatggtgttgtcgtgctcctcaagtgcaccctgtgcgtgtcacataactcgtgtgggcttatctataggtcccacagttcgtccacacaacagtcctgcaagggaagggcagtggttccatcccacacaggagcagtaacttaccctgggcagatggcctgtgagtcgtccaggctgttccagaagcgcccctttggtgcccaaagaccctggctcctcccatgggcttagcagcagtagcccagggttgaaagatttccttgctcactgctccagagcaggggtcaccctctgagggtgcaaccgtgcgtgaatcagtgtctccaaacggagcagggcctggcgcaagtgctcagtaaatacttgttgagggatgagtcaatgagtgatcaaatgcaataaagtgacccacttgttttcgagagtaatctgatcatgttactcacctctttcatctccagctggctctgtttcactcagtaatgctgaagcccttaccatggcctacaaggccccatgcattctggattcttcacacctcccgactctcatctccttttttttttttttaaggattttatttatttattcatgagagacacacacagagagaaaggagaggcagagacacaggcagaggcagaagcaggctccatgcagggagcccgatgtgggactcgatcctgggactccaggatcatgccctgggccgaaggcaggtgctaaactgctgagccacccaggtgtccccctactctcatctcctgaactatccccccacttaacacagttccaaccacataagcctccctactgtcctttacacgaagtatgctcctacctcagggtctttgcacttgtctttcccttctacttggagccctcctgccttggataccagtgtgcctccttctgccatttccttagagctcatatcaactttcacttcctcagagaggccctccctgatcttgtgcctggtggagctcagttggttaagtgtctgcctttaactcaggtcatgatcccagggtcctgggattgagccctgcacaaggctccctgctcagtggagagcctgcttctcccactccctttgctcctcctcctgcttgtgcatgctgtcaaataaattaaaaaaaaatttttttttaatcaccctgtccatctccagtcccttattctctgttgtctttgtaacttttttttttgtctttgtaactcttatcaccgcctgaaattaggttatctacctatttgtttatatgcttactgggtgtttccctgtcctatttgtgtttgttgtaagcttcatgtggagacaggcctgcgttttgttcattgctgcatcctgagcgcccagcacagatcctggcacattgtagttgctcaggaaatccttattgtacaaaacaatgggagagggagagagagagagagagaggagaacctggaccctgtcaaacagcaatatatttctatttttcacagcagaaaagaaaacaaggaactttactaaaagaaccaaatttacttcagtttaaggcaaattccacacagagactgtctcagagacgggtacaggaccagacagtgtagaaacaccaccatcatgcatgacaggaagggaagcggtgtgggacagcagacagggcgggggcctggtctccacccaggcatgggatgtgtagtgggctgaagagccccatgctgcaggaggggctggcatgcatgacttgctccctgtgggggtaagggctgggcagctctgcaggcccaggggtgccatcacccttctcaccttccccacagcaggggcaggggctccggctcagacaccagaacccaaggctgaaggaccagggtggatctgaggtgacaggatggaacagggtgaccctaagggccaagacggcctggggtgaggggtcacactgctggggagtgggatgcgggaagctgggcatggcatgaatggaccctagggacaccagagcggaaggtaaacctgggactatctggtcaatcctcttgccctacttctgagtcccagaaggcagaagggccttgcctgggctcccccaggcaggggctagatgcagggctcgaacccaggactcttagctccgatccctaggggcagtgtgagagtgctggggcaggactgctccttccaaggcatccagggcggcagcagaggacggggctcggagggccctgggcagccatggcagaaggaggggatccctggagccaggagtcaactatagaggtgcctgtgggcccacacccaggagacacttgtggatctatgtatctaaaaccagcgtcattccagaaaggactctgtgcccgtaaagcctccattcctcacccatcatgtggcctgtggcctaccatcacagcctcctcttcacaagtctgcagggctcccatggcatgcaagtatccctgggaggggtcacacgttcaggcgtccctgcaagcccatcagccccgcagggttcactggaaacagggacggggtagatactggggtgggaggtcaggggccaggtgtaggagtagacaccacaggaggaggggagagactagagccctggaggagagaggcccagctcaggcttcagggctgtctaggaacagatgagattgcccagttgggctggggggaggaccccaatcctccagactgttaacaccttcctggctgggctagaaccaggtgtccaggggaaacgagaaaggcaggggcccggaacctcacctccaccacctgtaccctccaattccctgggtacgggccatgaggccaggaaagcagagaggagtcttcagaggccccgtcccccgccggcctcccaggcacacacgttacaaaggctaggcatggcatagtgtgagggggtctgggggccccgcctatgctgccacgggcctccccaggccccagcgcctgccacaggtcagggggcctcgggaagagcgctcagatgtgtgtgtgcaggggggaggccgggggcgtgtgggctggggactgtgggggcgagggctctggggccacgggcggggggcgcgggcggatgccctgtgacttcatgtaggacaccagctggtcaggaatctcggccagcacatcgcgggccaggcgcgccatgctcagcacgtggttgccagtgcggtccacgtagtccctgaagggcacgaactgccagaggaaggcaggtcaggcagggtctccggcgggagctgaggaggggggccccccagtctccaggcctgggaccccgccccactccaccccagcctcttctctcccctttcaacacctcctcctgctggtgagttctgaagggctagtctgtgcgcccagcagatgcctcctgagcgcctatcccaggccagggtacaccccaaaaggagcccttcgtccttgaagcctgggcacccagcacagggacttagccagcactccggaaatgctgaatgaaccccctggctccccatctcccccaacctctctgtctctcttcctcttcggtctctgggccccacacctaaagtcaggcccctctggcttcctcccagggggtggcccccaccccccatcccccacccccagagtgcctcagctcactcctgcctcccggcctttccatgcgtgcgacccccctctcagactgcccctgctctggtgcccagcctcctaactggtctccaacattggaatgcccctccccacccccatttttttaatccagggcgtctggagaaggtggagcctctatattcccaatctcctacacactgcaggacagtcacaaacagaagtgcttactaaggtgcattctgaggcttgactgggcagggacaccctggagacaaagatgcgtgtgcccgctatgtgtgccatccgacacgacaggttaagacacgggtccagttagccaagcaatgcccgctcctggagagggctagagcaacgctaaagacacctccaccttcgagcgttctaactgggaaggcagccccgcggaagacactgggaagtgcaagtaaggtgtcagtgctctgcagggactagggaggcctgggggcccagggaggcctgggcggagcattgtggtcagggcagcagccttagcagtgtgtctcagagtggtagaaaagggtccagccggggaggaggggtgacccaaagactgcttcctgttcccttctacggtggccaggctactctgcggctctctccaggggccctttccagagaagtctctaaaagggggtacagggggcatgggggaggactcagtcagttaagtgtctgcctttggctcaggtcatgatctcagggtcctgggttcgagtcccacattgagggagcctgcttctccctccccctgtcactccccctgcttgtgcgctctctccctccctgtcaaataaagtaattaaaaataaaattaaactaaactaaaataaacaaaacaaaacaaaacaaaacaaaacaaaacaaaacaaaataaaataaaataaaataaaataaaataaaataaaaaaataaataaataaaatgggatatgaggtccgcctggctagaggggttctggcatcttcctggggcaggcaggctttgggcttcacctgcacgatgtccctctccgccagcttcccccgagaggagatccgcacatcgtcgccatccagctccaccatggctgtgggaggagaggcagtggctgtggggtgaatccagggtgggcacctgggccctgcagggcccatcccggacagaggctgtcagaccagactcccaggttggagaggaggaggctgaggccaggagacgggggcagcccgcaggtaagtgacttccagcccagcgctctagcttcaccatcctcggggttggaggaggcaggagtgaccggccctcctccccacagccctgggacgtgggcgtaggtgcacaccgtgacacacccttccctgtgcaaacagacacacccagacccagatggccacacccagccagcagctctccctctgcgggaaggccaaggccgttcccaagggcctggagcctgccgggaagcatctgggggacgagcactcaccgtcgaactccgcctggcccacgccaatgatgatgatggacatgggcagtttggcagcctggggtatccgaatagggtccagaggggtggggcaacggaagacagaaggacagaagaaatgagagatagaaggacagagacacacacagagaaagatcggaaaggggcgaggggcagggacacagaacatggggaaaaggtggggggtttcagagaggaagggagggtcaagaggggaataggggtcacaggtctgcttctctgagaaacccccccccccactcttcttctgtccctgggcctccatcaagtggacatgtttgatgtgggcatcgagctgtgcctgctggggccggagcccctcatacagggagaccacccaggagggggagccatggtccttacccccccctcccccgttgctaggctcccacttggactggccaggctgggctgggatctggggcagtggtactagaggtgggttaagagggagccggaggcgttgagaggaaatggaccatctggggtgcgtacagagctcctcagggtggggggacccctcacaggccagcacccccgccacccctcaaactgccctgcccaggaagcctcgccccaagggtttctccaaagaagtgggaaggcccgccgcccgcccccagctcacattgacgatagcctccttggtctgtgccatgtcggagatgaccccgtccgtgatgatgagcagcaccgagtactgggagccgtcctgcaccgcggccgccgtcctggggggcgggggccgcagtctgtctggcctgctctgcgcccctccctgcccccacgacactttggtgggggcaactctttggcaggaggggagtctctttagggtcagggctccctgaaaggcgagtcagtggaagaaccaccccctcccaccttcctgagaggacaggcagggacgccctcacggctgagccgccggggtgggagtccagtggccgcaccactcacctggccacgtgggtgaccacgggggcgaagttggtggggccgtagagctgcaccgtgcgcaggctgtggtggtacgcctccaggatgccgtcgatgccgcagcatgaggggttctcctggttgccattctgggggcaccggggatagggaggctgagcccaggaaggagggcggagtaggagggcagcggggtttctggggggtgggggtacagccagggtggggaaggccagcccatcccgtctgcgatctcctagcctcttctctggtgggagcaggggagagagcccccttggcatcccatgtcccaactgcaccatgtctccactgcacctcccctgtgtctggtcaggaaaaggaggccagagcccactgtgggtggcatcagacatggaggggaggtgctggtgagcaaggtgcaccgtgggcttctggaggccctgctccaagcccccctacagatagcaggccatatgtctaggcggggaggatgggagataccccctgcccaggcttgccaccacacccgagcccagtcagccctcagctcgtccacccaggacctcctaccagcgggaactcgtgggacaccctcccgtcaggaggcagcttggccccgaagccaagtgcagggaacatcttgtcactgtcgtagtgttgaatgatctccccgacggcggtcagcgccagcgcataggcgttcagctggtaggggctcatgtagtgcagggacgtggactgcgatgggttccctgggacacgggacacagggacacgtgctagtctcaacactccatgcaccgtgggctccaaatgcacaagggggtgtccaatgggacccctaattttctttattcttgactcccttctttttctcctgccacattttcaacgcttcagtaaatcctggttgctaaaccttcaaaatatatgcagcacctcacctacttctcccccctctgagacccccccatccccttgccggcaggaacccagaggcccagaccaattcccagcttccactctcatgcctgcagtccagccagaggagctgtcaaaccccaggcagctaggccatgcctcttccctgcttcaaaggctctcatttcacccagaaggagacctacaatccttatggggggcggtgcacaggtcccacagggtccagcctccagttatctccctccttgcctcccaccatcccctctcctcactcactcaggcgtggccccctgccatccccacctcagggctctgccatagcgtgtccttctgctttggggaagcacagatgtacacatggctcactccctctatgcaagtgcccccttcacattgtggtcccttagtggcctcctgaaaattacagcctccacccaacactccctatccctcttgccggcttcagtttttcccatagccctcatcaccaccaataactgcccatattttgcttatgaatcaggggttcagcggcacagactgccaaggaacagatcctgctacagctgtgactgttcgatggctccttaacctctcagcctcacctcctcatgtacagcgtggggataacagtcccacctcctgggattgttgtaaggatggagcaggtgtgattcttagaattcacctcgttgttagtattacagttcctcccagctcagacatcctgccactctcggatgctggggcccatcaaagacctgggctgcttctgagaagcatggaaatgagcactgggcactgctaacaggggtccagactccaaggaaagttgtgatgtttctaaccatgtgaagctgggcactgattgctcttggtgactcactcagagccccaccctagaggaggtcagaggtgggaagggagccggggctgggaactggggttcctgccctcgctgaggaccacagagctcccctccagcctgtgggttgggctgtgcagaggatgtgagatttgatcctgtaaggaaacaccttttctccagcactctcccatggacccagagcccagatttgttagtgactacagtccaagctggggatacttccgccatcttggttatacctttggctctcctggcctaagtacctccttcttggtgaggccagagaatatggaagagcgggctccctgtgagggccaactatcacagctctgaaaagtcctcccctttcttgccctcagtctccctctggctcctctgcccatctccccactcaccattggaggctgtgaaatcgatggccactgtgaagttgatctgggtcctggaagaggaagagaagcagaggagttacctggacagggaaaaatctggcttccaccccagccccacagcttgccatatatgtagccttggtgaagtcactcattttcttctagttctggaaaatggggataggaaatgccagccacacactgcacatccctgccctccagaattgttgtgagcataagaagtagtcagtgtgaaagctctctgaagggattacgctctgtgtgggcacatggtgatgattacttgtttcctccccaaaccctgcccctagaggcccacctgagtccagtgaagtagggtctcactgtttctggctcaaattcacagtcatattcagggttaacacttatttgacaaaaaaagagccaaagagatattgtgcatctctgaggcaagaacaagacaccacccataatgctgtcttgcccaaaacttgaaactgaacctgagtgagcttccagagctatctcccagtttacaggaaatacaggagacagaggaacatgttaaatgacgttaaatggtggagagtgcctaggtggctcagtcaggtaagcatctgccttcagcccgggtcataatcccaaggtcctgggatggagccccacttgggctccctgctcaggggggagcctgcttctccctctgcctctgctgctccccctacttgcactctctggctctctctatctctctgtcaaataaatacaaaaaaatttgtaaatgtaacaataaatgatagcagggggatgcagccagtaaaagccagtctgggggaaccctgtgaggagtccaggccccccaagaccttgtgaatcagaatccctcggtggggagcaggaatctgttttggcaaatcctcaggtgcttgggggaatcaacagatgaaaagagaattaagggatgaatcaaccaatcacaatatgtggaccttgcctggatttctgattcaaataaaccaattaaacaactttataagacaactgggagaatttgaacactgactagatatttggtgttaaggggctatttgatttttaggtataattatggcattgtgtttctattttacaaagagaaagcccttacattttagagctacatcctgaagtactgggggcggggagaaaatatgatgtctgtgatttgattcaaaacaactggacaaaagggagcatgcatggaacacgactggccaggagttggtaactggtgaatctgggtgaaagattcttggggtttgttataccttctctctacttttgcatgtattttagaatttttccataattaaaagtttggttttgaggatgcagattcagggttgaagctttctgagggtttgtttgttctaggttctgtactagatgctgatagaacaaagccaacaagataggagtccctgataaagtctagtcttgtggtttttattctgcagtgaccacagagtcaccaagggagcttgtttgaaaggaggatcccagggccccacttgcaaggatgccacatcagtccatctgagagggggttccagaatctacttcttcaacagacattccctgacctcatccagggatggatcctgggaagggggttctgggatcacctttagggacaccgttctggtggttccaagatgggctgatataagatcagccacagccctctctccacctgaccacagaggagctgatgctcatggaaccatcgtcccccaggaagggtgaaggacatggttagcaggagacccaaggcagggtctgctggccagagatggtccagagatggtccatgctctttccctttgtctactgtctggggacagagcatccagaggattccaacctctgagggacacggaaccacaagatgtcaagagcctaggttcccaactgactgtgtgtggagcatctccccacccatccctgccaccccatgaatgaaaaataagcctttgtttatattaaggcttaaggtcacaggattatttgtgaaagcagttggcctgtactattcatctgctgtttgttgtcagttctcactggggaatagagagattgtgtgtctgtgttagaggaagggagacacttggaaggaaagagctctactcctagggccaccatccagagggtggttctggactatgggacgagagcagaaggacacctccagccaggcgcatccaaataagggtgagggaagaggcaagccttactccttaattggtcttcccctgctctgggttctgaaatgactcagggagggaaggggctggaaagcaggtacttttgtgggatagctactccctgcaggctcgcccctcctgcctaagggcagagcaggacagacgcaggctgctgagcaaccagttccatctctgacacgggccgaggtggctattccctttctctcgggccaggtggacaggggagggaggctggggaagggaagatcctgaaactaatgcctccatcagctgcctgcctggacacgcaggctgggctctcactccctggagtcagctctctcactcaggtctctggagaggacgaagaggtgtgagggagggcgagggctggcgccagcatgctaacttgccgggtactggcggcgccagctttgcgcagaaggctggcctctgagggctccttctcgatgagacatcacagcgcacccagccctttcactctactgtctctgcctgcattacaccccacctggtagctatgaggcaggtagggccgggattattcattactatggaagaaatgcagcatgtgtgaacagaaggaaccctgccactggctgggcatgtggccaccagcaagttacagaaaatgcagataatcatcctccccctgcccactgtgttctgtaaattaggggcactatgcaaaggaggataaataggatgtggattttttgaaaatgagcaggtgctatagaatgtaagtgcgggttgctccatgggctagggaacagggcagtttcgatgggggaagggaccaagggcagggtctggagtgggttcagaggagggacagggaggggcagcaggggcctctgggtgactacagcgaggcgtgtgctcagtaggtagaaggagagcttgcaaccttgaaaccagcttcaaggcagcagggcgtggtgtcatgggagagtaagtgtggcttcccagggcctgacttttccctctgccctagagaacctggtagccaagtgcctgcttggctgggatgagcctttggcagctaccctgcctctcgtctttccagacaggtgtagtcactcacctgcctgcacctgtgggctctcggctacccacaccctaacctggcacctgttctggcagggagcatactctctttctgtgagctgttggctggagcctgcaggccttcctgcctgccttggcctggatgccaacccctctggttctttttgctccttaaactcgtgtttgaccacctgttggccttgggatcatctgatggctcaccgccccccccagagcctcctgccccttagaggtccctgatgacactggggaggttaatcatggcccccccaccccctgacagaccagacatcagaagctcagagaaggaagggccattagaattcacttaactccagtctctgtttatagaggtggaaactaatactcagggagggaaagtgatctggccaaagtaacctagcaaattcatggcgaggcagggcctagaacctgggtgtcctaattcctagtccagagctctttccacctccctaagcccttggctctctttgtcagggagtccctaccatgcctgggtcccacccccacaggtcccaggctggcctccgtggctcaagagcagcctctgcggccactcaggatccaggggcacgcggggctctgggcaagttgtctgaggccagagatgggagtttgctcacagctcacaggctatgtccagggcctcagaggggccagggtggggccccttcccactctctgaagccaaagaaactgagctggatctcttctcaccctcctttgatgtagtcaagaaatgtgcactctgattccacagcaaaggaaagcagcgtgaccttgaaaacaaaacagagtttggtcagcagggagctcagggctggtttgcggaaagtgaaggagcagggagtatgcaccaagtttgcagactctgtcacatacggtacccacaaggaccctacaaagtacaactattatctcatcttatagacaaggaaacaggttcaaagaggcaatgcagcatgcccaaggacaccaccggagcctggtcgagtgagcccaaacccgggtctgtctgactccagagcctgcctccttgaccatgatgctcagctgcatcccagcagggcacgttctctgtcactggagcaccggggctcaagccaagagcacaagtttcccctaagtgggtccgtgcgtggagtgtagaagacagggggtcttcctgaaacaggcctaacaacctgccactgctgacaaggcccttgccgtgctaacgatagatcccaaatctttaccttctcagccccaagaccctcataaagcagcctgttctctcttgggaggtaactgacctggggctccctccagagcacacgctgccgttcaacctctgccccctgtcggctttggcattggctttgcctagacaggcagctacctggcagcttattacgataatgatttaggatcgtggagacaagtaagtgaaagcctggctgccaaaatcaattaaatgaggcaagatttggaagcaggggaacttttacttgtgtcagagaacttgaccctagaatttggggaaccctctactggtgcagactctgctatctttatcaactctctggataggccagggagggcctctgcttgatattagcccaaataaggggagggtgtgtgggcgctgcgctgggccttggagaccccacctgctgtgattacagtgttaggcgcctggatggacaaagcctcccttccataggagtggactatggcagcggcctccaccctgactgatgaccaccagcctccctggggagcttttaaaacctcctgcagcctgactgaggaccccaaaccaattatatcagtttagggagtagggctctggccctggatcttttcttagctcctcacatgagtctactctgcagctgggggttgaaccccactccccactcccatcccccaaaggccctgggatgaagtagttccctaacctgcctgaccatatggatacccagggccttgctgctcaaagtgtggtccctgggccagcagcagcagtatcaccctgatgctgattagaaaggtggacatgcagattcttggcattttaccaagatccccagaagattctgcacatagtaagtaaggtatgagagaagctgtaaatatgggttcctaggccccagcctaggcctcctaaaatggaagcccagggaatagactaggcatttgtttttttaaaaaagattttattgatttatttgaaagagagagagagattgcaagaaggggagaggggaagagggagaagcagactccctgctgagcggagagctcaatgcaggactctatcccaggaccctgggatcatgacctgagccaaaagcagatgtttaacgaactgcaccacccaggtgtcctgggcatgtgcgtttaataagcatcccgaactgggacgcctgggtggtgcagtcggttaagcatctgactcgatttcagctcaggtcatgatctcaggggcatgagatcgagacctacgttgggctctgggctcagaagggtgtctgctggagattttctctccctctccctctgcccctccagatcatatgtactgtctctttctctctctctcaaataaataaataaatctttaaaaaaaaaaaaaaaaagcatcctgggccctgactgatatttttatggtgaagactgacccaagacaaataatgtcccctctgggtgtcagtttccttatctctaagaaaactgaagatcagtggtttttgggcagccctggtggcacagggggtgatcctggagaccctggatcgagtcccacatcgggctctctgtatgatgcctgcttctccctctgcctgtgtctctgcctttctctctctgactctatgaataaataaataaaaatcttaaaaaaaaaaaaagatcagtggttttcaaactttgtgtgtgtgtgtgtgtgtgtgtgtgttagctgtacatccaagatttctcagctggggaaggtgctgcgtcccctaggggcatgagaatgtgtgggaaaatttcaggggtctcccagtgactgtggcactaccaatagccatgggccgaggccaggagtgctaagcaccccacaatgcacagggaagtcctgggagatgaagaatgatcctgtccaacatgctgacagcattcccactgagaaacactgcagcttttccaagcctgactgggaaacagaatcattcccctttgaatgagcagagtactttgcagtttacaagttctcgtctccagctctctgtcagagccacccagtgcaaaaagcagggtagggatgatttattagccccattttacaaatggagaaaataagggtcctcagaggaacctcagagctccctaatgaggacctcttctgggtctggagttgcagtttacttaaatctaatgactaaatgtggctacattagctgatggggctatggacctctacagtggggagggcaggaaggaagcagctctgaatatatttgcagggcaaagacattggcttgtacaagaaatgcactgtgggctgtacctcaggacctttacacatgctcatccctacagctattattccctttcctcaatatcctgaatacttgtttgctcaccttcttcaaatctctgctcaaacatcaccttcttagagaaaatctttccttgactacttgatataaaatagtagttttgtctctggcattgcctaaccctttaccttcttatgcttttttcccacagcactcacatgtgacaaatacacatatgtgtgtgtgtatatacatatatatgtcttctacctccctcactaaaatataagtaccaagaaccagatatttaggtctgtctgcttcccagctgtatccttcatgccgagaacatggtagcactcaggaaatcttctttcttggacaaatgcatgaatgttctggagactggcccctggaagccacacactagtgtaatcctaggatcgtcatgacaaacaggggcagtgccagctaccagctctcaactgaactgtagtgctgcctgccatctctagctctgtgaccttgggtgagtcacttccctgctggcagccttggtttcctctcttctgatgagatgtctgcctctcaaggaaacaacctgtgaaaagcaccgcaatggggaatttcccagaattaagggccccatgctcactactccttttcctctctctttctgcaggaagtccccacgggagtttctctctgggatttcttattctttaccacagtgcctatgtgtggcctgcaccatctatacaccgtctaccatccaccggctaccccccaacctgttgctccatcggccccacccctccccacccccaactcttcaggtctggttctcacactctgcaggaacccacatggacacgcaggagtcctgacaccagacatagctcaggcctcaggatgcctgcacccggctgcgggggtggggtggggctggggggttggctactcactgtgccagaattcacgtatttctttttcttcattttcttttttgggtttaccacctgcattaaaaaaacagttggcgggtaaggagtgtttccaagcagtcagggccaggctcatagagcttgtagccaccctcaggtatggcctcagccccaacaagcagactgtggggcatgaagactggggagggggggtacgggaggtccaggggaggagggtcctgggaaggttttgtgagatactggcatttagatttacgcaagcgggcttcctgattagacccggtgttgcacgaccaaacacaccaggaataatatttatttaaccttttttccccattgctcccccagacacagcctccacccaatgtggccaaaggatgccctctatgcctgctcttgtgtgttggctcagactgctcccctcaccccaaatgcctttccctcctccctccaccaattcccaccctccctgctcctccttggagatccagccctagggcctttgaggctcccctctccacccccacccccacccacctaacaggacagtgagaactttcttaactgttcctctcgtgaaagctttcatcccaaaccagacctgtcatcagagaatataggacaggcctaggcacatatttagtagatgctaaaaaaaaaaatcacttattggtgggcttaactcagtggtctcaaatgcccatgccctcaatatttggccttgtttggagacactttggatgtcatgactcagggagaagatagatgccagggacgctgctgaacatcatgccatgcacagggcagccccagccactcacccccaccctgccccaagaatcatcaagtccaacattgagtagcatggaggctgagaagctggaggcccagtgaggggagcaccttgccttgtgaggcctccagggggcttccacatgggctgcatctatactggccttcagccccactggctgttctgcttggggggtggagttcaggccccacttttccctaatctcccaccaaaggaggcaaggagggttgattttcatactagttctgtcctccacaggtttctggtgaactcactggccctccccccatctcccgttcttctgcaggcagaggcagcaggctttgtctttagcagaggactcttctgcctgaatgagtgctgatacccatttctggggatcaggagacaagacacagggacagaaacaatttgcccaaggttgcctagtgctctgcatggtgacaaaattagaaaccaggtcccagctcgcaggcagatagagctgcccacctgggtgtcgccctgataacaaatacaaatgcaaatatttatggggttggggaaagattcgtcttcaggagatagaggacaagaggaaccaaaaaagggaagccaggaatgtgaaaggagttggaggaagggaggaccattccaggctgagcatcagcgaggcttgccgggaacaggtagtgttgaaggcaggtattgggggcaggagggtttgggcatggggtgatggagggagggctttccagtcagaggagatagtttgggggaggggccatagaactggactccagaaccacagggtggaagagtaaactgggctagctggaagagagcctagagcaccaagttaaatgtctgaacatcacccagcagccagcagggaactctgatgacctctaagctgataggggggcacgatcacagcagactctaggatgccaggacctggtggaaatgagtatgaggggagaaggagagacaccaggggcatgtttacctgcccagttttgccacgtaatggctgtgtgaccgcaggcaagttacctgaccttcttgtgcctcagtttcctcgtctctaaaataggagtgaaaagtacctactttatagaaaggtatggggatgaaataggtcaatacaaggaaagtgtttaggacacggtccggaatgaagtaaatactatataagcgctagctgctattaatttttattactaccacaactaccacccccgctagtccaggtgagaggtaatgagggcctgggggttgttggaacaggtacctagctatgacaaaactccactgtcaagaagtgaccacagaccttggggccagggcatggctgcgggggcaggaaggaaaggggcaggggtgaccaggaagacacagaaggaaggaagagctggatttggggcccaggtgggaaagctggcaagctctacaggtggaaactgtgaacatggggaaagaagcccagaacgacttcagagcccccatgggcacagaggccatccagatgatacggcattcacagacacatttgtggaacaccatgctctaggcaagctccagtgctgtggtgcctcattttcccagtctggtcccaggagggtgtggaatttgagaaccgaacacatctccaacttttattcccaagtagccctcccagctgaggagaataaacatggattcctgggggtctgggtgtcacccaaagacctggccacaagcacatttctttgaagtcttctacgttacctttaaattagcctgtagtccacatttccactctctaattataactgttttaatattaaagcaatgttttgttctcagatcctcatgtgaagtgggtactgaagaaacgccctgtttattctgaggtttcatgcactccagcacacacctccaccccagggaccagcctctccagcccgcgtgggcggtgccctcaagctctgtgtggggcaccgtcgccccctgagggccaggctgggaacttcccaactcactggctggaattctcagccttgtcctctctgctcacccctgggcaggtctgggttctgccctcctgggcaagcaagcaagccacccggtggctcccaggggccaggagctgtgcaggttttgggaataaatacagtagtgattgagacaccaccccacccttgaggaccccatggtctttgacggggtgggaagtatggcaaacagtttaacacccctgggaagggggttggtgagggaggcatgggagcatggaggagaggtatttatttacctcagactttgggggcggagtgagtgtgcaggtggagaagattcctagaggaggaatatacccaaagggagtccccaaggatccataggcccaaccaagtgaagaagaacaaagggagccccaggggagcactatggagtgaggcccagaggcccagccagcagggaggttcagagagcataatggggctaccaccggtagtgggcagaggggaggggccagggcaaaagccctggggcctcctaggggtgggtggtatgagtctacttagaaacccctactggttgctcgcagattctaggttgctgggacatggtgcccatgtggaggagcttggactctaccttgtaggtaaagggccctttaggatctcagctgcggcaggggagtcattctgaatctcctccccacccacccctcagtgtgaaccctgaccaggcagtagctggacatgtgagccagacactcaggctgaggccagcgcccacgatgagtctttcctgcagaagcctgttctctcctcaggcagtttggacctttagagaggccttccggggacacggcccacagtgcaaggcctgcacccctgggactgccggagtgtaattccttttctaactgatgatatttccaatggagaaaacgaatcaatccagccttttctgcttttagcttgagagatcatggcctcttctgagcctgtcaagcacacttaaaagctaaactctgagagacataatcccttccattccctgctctaaaaaacctctttagaggaagccagaaaaggatggatcctgcttctctctgcctgggtgggggaacaaagagagccctcccctttgccgatgcagaaaacaaagtaattaactgcgaggatcagagccctttcaaagaaattcacccacgctctatcttcacagtggcctcgttcaactgaattcagtatgtgctcggatcacaagcacctactgggtgcctggcgctgcacaggccgacgtgaagggaggccacgggaagggctgtcgcctagcctgcccttacggagcttctgtctaaatggaacacaagagctgcccactcagaacagagacgcctggctggctcagtggttggccgtctgccttcggctcaggccgtgatcccgaggtcctgggatcgagtcctgcactgggctccctgcatggagcctgcttctccctctgcctgtgtctctgcctctctctccctgtgtgtctctcatgaataaataaaatctttaaaaattaaaaataaataaatctaaaaaaaaaagaacagagacacagagtgaaggagtgcaagtgtggagtggttcagactcggtgatgggagccaaagcctgctcttcaacgttactagctgagtggctgctcctgtgaggagggagcccatttccagggctgccgtgaaatctaaatctcctggcacacaggcgcgcaacagatgacgctagaagacagccttgatggaacgctcacaaggggcaggcactgttctagtgacttctttaatgctcagcgtgcctggcacagaatggttcagggacttagcccacgtcacaaggctgggacgtggttagagtcagagtatgaacccaagaagttattagggctagaagtttctgcacttcagtgggtccagcatgacatgctgtccatgaagctgatgtgagggagaaagcacgaggccagagtggttgggaacgccaataggggagctgggactcaagctgggagggcaccccaggacggtgagcacacacgagcaaaggctcagcagcaggaactgtcctttgagggcaaacactattatctccagaaggactgggggccctgtccaggttctccacatccagatggagctgtcctgacctctgttcctctgactctccttccagaaacagtaagatactcagcaggccctgaaacggttctgattgaaggcagagggccatttccaactcaggaccttgggtgtcagacctcgcagccttctgataatgtcccccacagtctgccccatcagcacccctcctccgccatcctgtcagaactgctttttgtggggtcactataactcaatattgtttgcctcttggttctgcaacctacagaaccacatgtctttgggcaaattcctgaactcctctgagactcaggcttcttagctctagactgggacagtaactcccacctcacaggagaacatgcaaaaacccccgcccagctcatggcacactgcagtcctcaatggctgggaggtacgtataaggagagcaaaccccagacttggggtatccacctcacctcatagatgttgaactggctctgcccgcgggccagctcccggtagctggtggtgaactcgccaatgaagtcgtggctgcaagagaaggctactgtgagacggcgtggcccaggctgcacactgcttctagccaactgcccgcctctcacatcccttcttctggctccccatcctgcccaggacctctgctgcaggggtgcatgccagcagagagcctgggtccctggcaagagtcagtgtcaccacggagcaggagacccagtggtcacctagccaagagcagggccccggagaaggggaccacttctacttggattcttgttggaacaagccagctgtgcaaggtattctggggacaactggagaaatttaaatatgagatgaatattaggtggtattcaagaattatttattgttcaatgtgtcaggtgtaataatggcattcgtggttctgtaggaaaatgtccttattttttagacattctcaatgagatatttagaggtaaaaaatgccttgatgtctgtaatttaaactacatcagcaaaacacagctaaaggaaatgtggcaacatgtaacacttgttaaattcagatgataggcttaaaagcattcattaaagtcttctctttttctgtgtatttgccatttttccaataacagtttttgaaaagacaatttgcgtcatgtccatcgaggcagctggaggtgttttctgcagtggccacgccttctggcactctggcccccacaagtgtgttgtatgtgtgtgttaagtgcagcaaaaagcaggtgcaggacaactcctgtctcctctgcggctggctgtctttcactgtccccgccctgacagagggagcctggagtaccccccagaggtgctggagagtgatgcccgggagaagtccctggggcctggccctgccttgtacccgctctgtattttcactacacatttatagctcttggcactcagactatgagctccttgatggcaggaccctatgacacctggtggctgtccccagttttccctggtgaagaagaagtatgggggacctccagggtaagataaacatgtagctgacttgcctgttatgtggttaacaaagcaagttcacagagatgctgtggccctggagtcctgtctcggaatgactcacaggaaggtgagcaaccaggaatggccagggcctaacttagagttatatctgcacagccctttacaggaccccctatccacatcacagactggagaggtacggatggagatgatggggcttaaagccccctcacgacacctctagtagtggagtcacagaagtcagaatgacacattaggtttggttcaacaggcaagtgggagccagtgaggtttctggactagaggggccatgagaggccactcatgagaggcccgttcttgtcctcatctatgaattcccagtgacactgctccttggggggcgcttacattcgcacacagggagggtactggcctcccaaaacccaggtaggatgtgccctcctcctggccaggcttggccctactcagaaactgcctcatggctccagagaccattagggtgcatcaaagtgtacccttcccatgcccactctcagggcctgctccctgcaaacgcttcctttaatatgccaagggccctccactagacaaagaggagtctctgagggctgagcttgtcttctgcaccttggtcaccccacgatgcttggcctcacacagaaaacacggatgctcaggggatcactagtatctttgcattagaataggcacatttcagaaaaatccttattctcccaaatgcggcgaactttaggcactggctggctgctaggcagctatttgaggaaaagagacctcttaggcccctggcaccatgtcacgcaggacagagatcctctggtgcctcagcagagccgggcaggggca

SEQ ID NO: 2 - DNA, 489101 bp, Canine spp.
  misc_feature: canFam2_dna range=chr8:31735206-32226068
  misc_feature (24861)..(24945): n is a, c, g, or t
  misc_feature (359544)..(359660): n is a, c, g, or t
  misc_feature (401731)..(401749): n is a, c, g, or t
  misc_feature (431986)..(432150): n is a, c, g, or t
catctaaaggcataagccaggaaaatcaaatcttgttctaagagatgttttctatcatgatggttggccttactttgttttttaatccccactgaattcttctggaacaaaaacaaccccaaatactgatgcagccaaatgtttaaagcaccaaaatataaaagtgaccaaactggctcagaaccttttatcatctccccattcccgaaagggtaggtcttagctatcccaccaagagcctcagagaacttttcatcaaggcttacctcccttttctgttctttgcattcatttactctattctgatgtggataaatccgttaacctgtgtttttggactgccaggcctttctaggctgacaccaaggtttagattttcagcctggctttcaaatctggaactgatcttcagttctgcctttcagatctttcttggctccaccctatacccatgtgtctagccaggattctggaacctctctacctgaattctacatgtcagttctccagttgtctaaagaaaataagacgcttagttaataatttgctgatgcagcattttatgacagtgttgaaacaaattccaatgtagaaggaatttggactgctaaattaatattccttttgggtgaacagtggcttagagcacggtcaccctacattgtacagttctaggagtaccattcaccttgtttctaaaatgtatgtattatgctaagtgaaataaagtcaatcagagaaagagaattatcatatggtctcactcacatgtggaatataagaaatagtgcagagaactatatggggaaaactgaatgagaataaatcagagagggagacaaaccatgagagactgactcttaactgagaaacaaaccgagagctgctgaaggggaggtcggtggagggatggggtaactgggtgatgggcattaagggggcatgtgatgtgatgagcactggctgttacatgcaactaattgaattactgacaactacacctggaattaatgacatactctgcctctctgtgtgttctctctcctgaataaataaaataaaatatttataaataaataaataaataaataaattttaaaacgtatgtttcaggggctgccattggcatagttacaatataaatggtatacagtatacactactttccaaggaagccacagttaattgaatatcaagtcattatgaagtcttcaaaggtttttttttgcttattttttaagatttattcatgagagacagagagagagagaggcacaaacacaggcagagggagaagcaggctccatgcagggaagcctgatgtgggactcgatcccgggtctccaggatcacaccctgggctgaaggcggcgccaaactgctgagccacccgggctgcccgtcttcaaaatttttaactttaaaactagtattacataattcctaataaatatgcacaatgaaataatatcagaaatattgccctcctcattatcttaaaaacaaacaatagttttaaaacaaagccaaacaaagttaatgagcagaaactttaggaaagggacacaacttcaagccagaaagcagcagccaaaaaaggaactgaagatttttagtaaagcttgggatgagttctactgctgcccctcatggtaaaagcagtactggtgagtagacaaaatcctgataattctttgtgggttttttgtttggttggtttttggttttgtttttttagagaaagagagacagcacttgagtgaggcagtgcaggatgagggggtgaggcagaggaaaagggagagagaatcccaagcaggctctaccctcagcatgagcctgacccaggactcaatcccacaaccctgagatcatagagggagacaaaccatgagagactgactcttaactgagaaacaaaccgagggctgctgaaggggaggtgggtggagggatggggtaactgggtgatgggcattagagtcagacgcttaactgactgagccacccagatgcccaaaaatcctgagaattcttaataatattttggtactggggaaaaaagaaatgactggagagtactgagagtggtgaactgaacagtgagcacatctctctctctctctctctctgtctctctctctcagggctctatgctgaaatgggagatcaaactaattcaaggaatgttcttgaattaaacacataccagcagaggtgcttccattgtcttaataaattgatgaatattcaatgtagtcagtggctgttccatcagtgttcttctacattgcagagtcaaatccaagacttgtttacaatgaaaaaagtagagatgtgcattttctatatcctcattgctacaaattaaaaattagggagaaattcacttgaagaaattcaatgtgttatctttctaccatccagaaagacatagtgccaaaaatctttaaatctcatgcttttgaattagtttcagtaaaaatctaaagcaataaaacaaaagaaaaaggacttaagcaaaaaagatacaaatagttttacagttgtataagcaatttttttcctaaactttttgatgtggtagcttctaaattaggtaacaggtccacataaattgttttttaaataaaagactgtcaccttgaggacaaggagattatcttcgaatatagttgcttttctagagctatgctaaataaagccttgtaacacaaattttctaggtttaatttaaactcaaatctgttttgaataaacttcagccaaaatatgccttaagatagaaaccatgtgacagtttgtgggagtttgtgagtttgtatctgaaatattacaaaactcagcaaatatgccttataatttgagttctggcatcccttcaatatgagaattcaaaggtaaacttatagtgggtgagtaaggtttgccaaaattaaaatagcaatttaaaaatctccatatggcattagcagggcttggcaaaacactgcaaatttttatttttaaaatgttattttaattcttgatacacgctcaaactgagatctaaggttcgctgagttcaaatttaattacaaactaatttctattagatttaatgactaaagaaacaatcaaagattacttaaagcctactcgtgttaggccctgtaccaaatataaaagacttagatgaatcagatgatttaaatcctcaaggggcttagactaagcgagaggagtttagttgttgttttttttcttttttaatgtagtttgtaagtgctataaaatgaaaagtactaggagaaacaaatatttcattccgcctcaagtcagagaggaaaaaggaaagggaagggaagagcacagagattaaaaaccgtaaaggagagaatgacttctccaagaagataaaacaaatgggtacttcagacaaagaactatatagccaagacctaatcaaagtatgtaactttttaaagagagtcctaaatagtcacatttattgaaagcaagagaactcagctgaggttgaacctctatgataccataaactctgaaataataaagtaattttggaaagctatttaatcagagatcattggtataggtaaaagaaaccaaaaaggtgagaggggtgcttactgaagtgtggaagtacatatcacagaacatgagaaaaattcaagtaactgaatcagagaataaatgcatatatctgaacacaagagttcaagggaccttcattgttgttaatacttttcagctcctaactctttttattaagatgattctctgctttacttctacatggccaaaacattcctatgagcaagagagacaaaacactatataatcctatttttccatgaccaattccaagttcctgagagaggggaattcatctgctcaggtaagccaatgggccggttgaccctacatcaggtggccacctctgatctaactgacggtaatatatatggggtgagggggtaacatcctggtctatacacagggagatgtaacagaaagcactggtgtcctcatggcatgccacctcttatactactacttatcatattcactgtccttaaccaacatagaacttcaaacaaattcaggcccaacatgatgtaattattagtatactagacttatctagtgctacagctccagcaattggaatagtgtctagtacatacagggcattcaataaatatttattgaataaaagaatgaacaaataaaaaaatacattcacctcttctcctttaggagtgaacccaaagttatagccaactacttcatccagaagtcatgccataggactattgtactctaaatccacactccctccctgtcatatccagtctaggtatgactcctcactatcttgccatccatatataaatgagtactgaaacatctccaatgtatcaaatactcaaaggtacatcaaaaaggagagtaactggacatttaaaaattctcattttaaaaacagggggaaacaaaaaaaaaaaaaaaagaatccccatgagatgagaataacaaggcttccaccattctgggatggggaactggcagtcaacactgggagtagcaaagtagctggctaaaccactgctaattgcatcttgagactcaagtgacttatggcaaagctttgtggtattgtcagcataagtctcaaactgttaaaaatattaatttttatacaaacagtaatcatgcatcaaagttttatctaattcattaatgaggtaatcagcagaataacacttcaatcagaagagtctaatgaaaaaaggaatgctggctgttatatagagcagtaaaaacataacttctctttgcaactttattctctgcctacccactcctcccaaaaaatcatttcactttatcagttttttatgcaccaacttctaaatatacagagttgtaaaaggtctgggatttaattaattgtgtgtggtatatcaaatagtcattgttttccaagagggtagcaggagggctcattaaacactcttgcatggtataaaaaggtcacaatcaccattttgtgttgctttgtattaattttcctgaagagcattttgaggcaaagtctttaaaataaaatggtattccctgcctttataaatgctaaaggaaagaaaaactttaatcctaggcttcccaggcaaaaaaaatcaaaagaagccctctacctaaaattgtaagctagaaactagacaagaaaaataaacatttaaaacatccttctctgtactttgatatatttaagattattccaacaaagtaacctacagaactctcagaaagaacttctgtagtctagttatgaaagctgttattttatcccctaacggatcactatgagagatctattcctaaaatacacttgggccactcatgggatcacatactgtggcttctccatattgtttttgttcactttagcctaacatcacctctgtacgtgtaaattcattttcagactgtagaatggcagacaataacaaaggggatttccagtttcattgatatattcacatctgcttacaattcctctcaggtaactccatgatgtgagagtctgatggagatgttgaagaagtcatgtgacagaagcaaacttagaatcattgacatatatgcctcttgtacatacccaatactttccaaaagggcagtttccgtggttaggacaaactggtatgtggtcccatacacaaaagcagcttccatgactgctctgtgctctgaagaagagataagagagttgggagacacatggagataatgtgtgtgactctcttttgaatattgccctacatcctttcagcctctattataaagaaaaattccttgtagggatcccatctggggaatgcaggcagttaaagaaattatgaaaagtctataccattcaaagaaagagaagagctaagaggaaatagaaatgagttatacttgaggatataacatataataaatctgtgagggtttcctcctcatagcaggggtgaaattatgcatccaccttccaatttttttactatattttatatatgtatgtgccttattgtttgtggcttggttttcttttaatcaaatttagtcttatacatagctttaaaaaaattctacaaaacatattaagaaaaacaacaatttctcccccatttccaattcccaagggacagctgctttcaattcttttactgtttcttttggtatttgccttcctttgatattatccattgacattcttacactcttttttcctgatttttttttttttaagattttatttattagagagagaaagagaaaacaagcagtagggaagggcagagggagaagcaggctccccgcctgggatcatgacctgagctgaaggcagatgcttaactgactgagccacccaggtgcctctatttccagatttttaaaggtgttattaatatatctattgatgccccactatggcagatgagaatttagctctttcccaaaacctcatctcacaaacatacacacttctatcccctcaataatcccaatagttgatttttattacaattacctgcattgagattgttataactcagtaaatactatttacaagtgagccatacagtacaaaatgagtatttatccttttttgagcaactttctttttttttcaccagttataactttttaattacttaaacttatttctaatttatttctaaattcttccagtactggctaacgctctccatacttcaaacagatcaggcacattattagctcccccttcttggaaaccttcctgcagagcctatggacttgctgcagtatggatgactgcaacatgacccgctaaacaacttttatcctgggaactcgctacccacatcatcatcatcatcctagggactctcttactcttttctcttgtgttgggtcctttggcctgttgccatccacatcttcttgactgatttgctccaattttctagcaccttcttatgagaggatatatgaaatacacatgttctgcaatcctatacttctgaaagtgtctttattttctattgtaactaactatagttgtctgcatattgaattctatgttcaagtcatttccctctgagaatcttgaaagcattgttccattttcttcattttctaggactgcaactgagaagtccaatgtgattttgattcttgatcctttaactgtatactctttctgtaagattttagaacagtgtttgttcccactatgctgaaattgcaaactgagatgctttgatgtggctctaagttcccccattatgctgggattcagtaagccctcttaatttggaagctcaacttcttcagttctgggaaattttctcaaagtatttacttgaagtatttcttcctttccattttattttcccttttctcctcactgccatttggagacagtcaccttcccctccctgactggatcttctaccacaagagtttcatcacagtatcccacttaccattctgacttagggttatcaaccacctcagccaaaaacaatccttctcattccacaaagaaatttagcttttgtcacactgtcattctctccaatactgctacctcataatccttcatgattttattatctccataggtgatacttgcaaatcctagcctctcagtctttggtcctctctagagactccagtgatctctcttcaagtctactttaaacaatcgctgctgtggtcccacaccaagccttgtcattaccaatcacttgcaaacccctccaaaatctcaatgtctagcatccccccaaccccctccttccataaacacacacacccctccatctccaggtcactctgtctagcacataatcctccaggaactatggtcctatcattttcacagtccttcattccttcaaattttctcctccgtcttaacccagcttacattccatagttagtcttccctgcctgtctggctaaaacacaatccatgttaaatcagatattctgcttattctgtacttacactcataaaagtaaatgtggctggagggaaaaaaaataacaaaaacaaaaacctgttagcatcaccacactaatgatctcactttattttttatttatttatttgagagagatagagagagtgcacatgtgaacagaggaaggagcagagggagaggatctcaagaagactccgcacctatgccaagcacgatcctacaaccctgatatcatgatctgagccaaaatctagggtctgacacttaacatactggctcacacagatgcctcatgatttcactttagattactgatatcaactattattgttgcctggcaaccattctcttttaagattttatttacttattttagagaacacaagtggggggaggggcagaaggggagaaagaatcttaagcagactccccactgattgcagagccctacacggggctcgatctcagcacactgggatcataaacctgagctgaaatcaatggtcagatgcttaactggactgagccacccagatgccgcaaccattctttattttcaggcctcctaaaacaactgtttcatctcttctttcctcaagctgattttatttttatttcactgagaaaacatagccaattaaaaaagcaaaaccaaaaaaactcccacaagcatatttatctacccacttagcaaaactgatgtccatattctttgtcttccctccttttaccatagatgaattttctgtgttcccagcaaagaaccacaccttccctcattcactagattccatcccctcttatctacattgttccagcaattctccccgctttttcctccatgctgtagtttccgctttctactggatctttcttgtcaacatataaatatgcttcttaagaaattcttcacttgaggcacctggatagcttagtggttgagcgtctgcctttggctcaggtcatgaccccggggtcctgggatcaagtcctgcactggactccgcaggaggaacctgcttctccctctgactatgtctctgcctctcattctgtgtgtctttcatgaataaataaaatctttaaaaaaaaaagaaagaaagaaattcttcacttgacccacatactcttccagccactgccccattttctccttcccttaatagcaaaactttctctaatgaatctccgtatttacagtctctagttgctctctattctcttgtacccctatcaggcatttaccccaccactctacagaaactgtgcttgtcaaggtcaacaacaaattccatagggctaagtataatgaggccaagtggcagctattatcttcattaacctttcagcatcatttgacacaactgttcctaactcttccttaaaaccctatcttcatttgacttgcaggacatccctaccacacagtccattccttctgtctcttttttggttctatctaacttcagtaacctgtaaatgttgatggatctgaacagttcagtcttctctttgccatctaacatcacttcctttgtcatctcttctggtctcacagctttatcacacaaatttataactctaatctgtatctccaccatcaaatgcagactagtaatatccaactaccttactatggtaccatgaggaccataaggaaataaaaatagtaactgacacaggacactcctatatgtcgggaactattttaattatttgaattcatttggtcctcacggtaacactaagaggtaggcatagttattttcaccaatcttactgattaggaaactaaagttccataagttgtataaggtcatattgtaagtcatagaggcagggtgtctaacctaggcagtctgggctccagggtttttgttcaatcagtatactatgctgcttgcttaaagaaaaaaaacatattggtatggatgctattttaagtcctgcaacatactgagacaagtgcagaggcacaacaaagattaagagaaaagttaaatacctggtgttccaatggctcttacgtaggcgaatgcaatgttggcttttcctttcagagcattttctatgttctgcaggtcttccagggtggtaatatattttacttcattaaaaagaagagcactgaaataaacagagatgtaattggtaaaagaatctgatacatagttatttaatatgtgttttcagtaagttaaagatcctaataaaaaaaaacttttttttaagattttatttatttattcatgagaaacacagagagagagaggcagagacacaggcagagggagaagcaggctccatgcagggagcccgaagcgggtctcgatcccgggactccaggatcacactccaggccgaaggcaggcgctaaaccactgagccacccagggatcccaaaaaaataaacttttttgaacaaattatcagtagttagaacctaagtattttaatactgaattaaaaatcactctctcaattattggtctgtccctgagaatatcaaacaggaacagtcatgagaaatgatgctccttctccacaagcatcttaatgtatttaagttgtattcactaacatcctactctggcccagtaatccctgacacactctcagcctggagcacatttgagccatttacacatctaaactgaaggcttctttctatggcatataaggctctgcataacctacttctccaactccattttgtgttatgttcatttcaccatactttaggcacacctcaggcctttgcacacacagttctctttgctgaaaactattctctttgctacttctcatgtatctggtctcagtttaaacattgctgcctcagagaaacctaacctctcagtcctatgtaattaggtctgtaccatttttctcttttatttcacactatttgatcctttgtagcacttatcacaatttataattgcttatatatttatttacttgtttatctctgcatctcttattaaactgttaccttcctgagagaggccttgcatattttatcactaaatccataataatttagaatagagcctagtatactataaataatcaataaatatttgttgaatgaattaaagaaaaagcagggtgggtattatttattcctagtcatttgaagaaatgcaaatccaaaacagaagagcttactcactcaaaaatacatttacagaattaggagccaggaacagaacataaaacaggtctcttcattcctaattcagtgacctttcatttaaccataaatcttccaaaacatcttttcaatgtgtagataaattattcatatttcttcatctaaaagaatttactttttaaattttctacttctacataatctatccctaacaactcattccacttaatccctacatgcatgcatgcacgtgtgtgtgtgtgtgtgtgtgtgtgtgcacacatgcatatctatatttttgttaggcttaacttttaaggatttttaaaacctgtttcaagtccatgtacttaaataatcaaactatctccaataaactcatcaactatagttttctcttatggaaaatatggcattttctgagaacacaacagttctcaaactttttaatctcagaatccttttgtacttttaaaaatcactgagctcctcgaagagcttttgtttatgtaattatagttaccaaaatagaaattaaaagtataatttagaaatatttgttaattcttttaaaaataataataaacaccactgcgtattaatactctatttaaaaataactaaattttccaaaacagtcataagagtggcattgttttatacttttgcaaatctctttaatacttggaatatacagaaaacagctggattctcatatttgcttcttcattcaatctgttgtaacatcacacaacatatcatatagcctctagaaactaaattcataagagaatgaaaatgaaaaaggcaaatgtcttagcattattaatacactataatgacttcatgggtaccccgaaataggtgccttaaattacactggtttacatagttacctatacattatagatttctttaagttttttaaaagaaatgtaaaacttaatcttctgtaattcccagggctcttgttttgtttttaaaagcaatacttactgagcagtacccactatttgctagatattttcacatgttttcatttaaatcttcagtgttattatttaaatattttttatgaaaaccgtaaatgctattttaaacatttttgtttacaaaaaaaatcaattattagtatctttttacactctcagattccttaatatggacaaatttcagaggaaggaaagaattctcaagaaatttaagatagactgtcctgaaagttgtggggcagggtttttgttaggttttatttcatttttgtttttaagacacaagctaaaaggtcaagtctctgggtgatatcccccttatagtttcagtcaaggagtgtatcagagcacagaccaggagaccccagcctggtgttgactggttgcctcagctatcccacatatttggtattgctcgggttgagattaactgggacaatcacacttcacatctccttgctggctgctggaggcaggtactggatccatactcattgatgaccaccagagctcccttcaatgtggctcagtttgtaaccaacatagtattccagggcaaacaaggcagccatctgatgcatgatccatttctgcttttgcttcctgcgctgcatgacaaagtactgtctgagctgcctgaggctggctgggaaacacttccaggagagaatacaccaggactatgatgaggaaggagaagatgtgggccatggtgcctatgacccacctgtggatctgcagtgttctcagcatgctcactgctggggaaagtaaagtcacagtagccagttgatgggtgccatcaagttgcctctccctgctatcagtaaccatgatggccagattggcgagaagccccaggtcactgcggttgtcacagctgagagtggataaacgctggtggactcggccccatcctcacataggggaaaggtatacacagcagctaggacatcctcatcctgcacatactcctggttggcacactgcacgtggctattgtagcacccctggaagctgctgagccatgagccagcctgcacacattgtgcccatagtcccacaggttcctggccaggatgatgctcatcaatgattgccaagagttgaggatccagggctcgatgtaggtgaggcagttggagtccagctgcagaaactgaaggtgcagcatggtctcgaacacatggggctccatgtacttgatcttagtgtccaacagatccattttctccaggtttcaaacccagtccaatagctaaccacaatggccaccttgtgcctctttaggtagagggagtgcagggagatgaggtacagaagagggcaaagttcaccttgaccaagtctttgtgctccaggtgtggctcagtgcacaccacacttttttgttttttcacaccagacttttgagctgactgtatccaatctaaatattctttattatacacacacgaaacagtctgaggaattaaatgacgtgtccagatcatagtggtagtcacaggtagagctgagattcaaatccggtcttccaacactaatgtcagaacttttctaaactatgtttattactgaccacgcaaaaatgggaaaccaggtaaaaatggaggcaactaatgaatggcaagggaatcttggtggcaatctggattgttgctgcttatacattttggctaccttgtctagaatttcccttgaaatatttcaatccagacagagatgccatccagtgaactcaaattagactaccatgtaaattcgaggcttgaaaattacatttgcccatttacctttattgctctagcagctctaatctatttgcttcaaaaatcatttctgggaatagaaatctccctaaacttgtttctcaataaaactggcaaatataaattaacaaaagctaacattttgggggtacctcccacatatcaggcatagtactaagcactccatggtagtggtaattttatcagtttggggactgcccagctctgaactcttctcttttgctttggagatttccagttttctatgtcttcacagtgagcagagcctaagtcccctcataaaagctaaaatataaacttgctcttctaggctccctgctgcaaggcatggccatatgacccagaatcacttgcctgacattctggatcaggagccagtgatgtaagaataagggacagtacagaattatttcaagaagcggtagagcaatagtcagctttaaaagcaggaatgacagcagtgtcaataacagccccagaacaggtgatgcaagctgtggcatctgaccctcagcagtaatgcaacagtcaccccagactggctatgtgttatgcttttgactataatttagaactgtattaattctgagtccagttctctagccattctatcgagcctgagatttcctatatccactccaaatccttttctgcttaagccactcagacccagattttgaggcttataactaaaaacactcagaaaggcactcagtcttgcttaattttcattgcaaccatctgagatcagtactatcattaactccattttagagataaggtcatggggctcagagaggttaccctgcctaatgtcccaaagctcattaagtagtcattatccatgaggtaataataaccaaacctaatgacattcataatctaatgatctccatgattgttcccagtggcttcctaactttaatacattttttatgttaatttctagaatatggggacatctaaggatccctaggatccattctcaggcctgtgctccttcagtcacaaagaggaaaattactgacagaaatgggtaaaaggaaaagtctgtcttggcattttcttgtttaatgatggggtgaaagagcctggggctgctctgacctgggagctcttcttgccctagaaaggcttttcttttccttggcatgcttttcctgagatcttcctatcaccatcattataatattgcccagacctgaatgggtatccaagaaagaaagaaagaaagaaagaaagaaagaaagaaagaaaagaaaagaaaggaaaagaaagaacgaacaaacctgaaaagtctatttgaccctgcttttggagcagcagactgttctgcctttaaaaaaaagaaagaaagaaaagaaaagaaaagaaaaggaatgaaaagaaaagaaaaagaaaaagaaaaagaaaaagaaaaagaaaaagaaaaagaaaaagaaaaagaaaaagaaaaagaaaagaaaagaaaagaaaagaaaagaaaagaaaagatttgaccctactttagaagcaacgaaactgatctagctttagaaaaagaaaaagaaaaagaaaaacaatttgaacatgtatatgacaatcattattccaagaaaaagaaaaagaaacagaaaaagaaaacgaaaaagaaaaagaaaaagaaaaagaaaaagaaatagacaccgaaaaacagatgttgaccctcgattttgccataccaaatccccatgacaaagaaaaagaaaaagaaaaagaaaaagaaaaagaaaaagaaaaagaaaaagaaagaacgaacctgaaaagtctatttgaccctgcttttggagcagcaggctgttctgcctttaaaaaaaaaaaaaaaaaaaaaaagactatttttacattttgtttctgtcattattcctaaaaagaagaaggagaaaaaaaaaaaaaagaagaagaagaaggaggaggaggaggaggaggaggaggaggagaaaggaaatgttaaccatctattttgccataccaaatccccatgacaaaaaaaaaaaaaaaaaaaatgttttttgaaagaaagaaaaaaacagagaggggagaggaaggagggaaacaacacattttcgaaattaatatggctaaaataacaaacagaagccacctttaaaatataaagggagagtacaagtcataacaaattcacaaatactggtcttgttcttactgccatacattgtatattctactagcttattccttatgaaattttatcaccagaaacaatcttgcaggatttctgctccttccatttttaacaaccaaaaggtgaagtttccaaattcattcatccatcaatccagtattttatgaacacctaatacatgccatgcatggtgttatgcactgatataaggacttggaggaaagggcactgtttggggaaatacatctaccagttaacatagggctatgaggaattcaaatgcaagacaagtaattttttattaaatttcccagtaaaaagtatgtcaaacaggaacccacctgacaatattaaccataaacaaacttgacacagatgaaagaataagcaatagtccaaatctattgagaaaagaccaacatgggcacagcttaggatcttagaagaagacatttctaaaagcagctttctccagaggttctatataggttctaggtcatatcatctttagactcaatagcctggcttggcaataatatgttgaagaataaaatattagcagaaattatgatagttgaaaataattcctataatatttgaagttcacaacattttaggtaggatgttaatttaaagggaaagaaaccattttgtgacaaaacaccgtcacaagaataccaagtaccacatttttttttccaagtaccacattttaatgaagagttaatgatatttcattgtttcttatagtacagataatctttcctttttgcatcatttcatggtttttaggaatcaacaatgagtataagaatggcctttctttgcaactgctacctcatggcaaacatcacagcaactatcacagcatgaactaaaatgaactcacttctgttggcactgtgtatgaaacagaaccacaggtagatacctgaatttggattccttttttttttttttttccataattgcaaaaggagacttcctgcttttacacagagaaaagcaattaacacttgtggagtagtgggtaaaacccacaatttattttcacaggcattaccttatttgatcttcacaacaacctcaagaggttgcaattgtaacatttaaaaatgaggaaaactagcaatcagaagagataaattgttcagatcacactatgggaaataaggaacagggactcaaatcctcaggaaatcctgatttcttcatatatcatacaactttctaatccacatttgagattatagtgccttaatctcctatacttctacctgacctgcctcaccctggttagatatatgatactctcaatcaacaaataaagattagttgctattttaactttctaagtattaccttttttcatctagaatctgggagtaaaattttcctcatatagttatcaaaccactcaattctactagttttgaccatgtaaatttttggaaacaggacaaagaacttttagactataaatcccaattctcacttttaaattttatttattttgcaaatttgtaacactttccatatgcttcaaaacacaaggtacaagagttgaagagttaagagtctacccagcttccccattccattctgataaagaagtattatcagtttcctgtgaaccttgaatatgtatactacatacatataagccacaaacatgtatttatatatgcctctgttagaagacaatcctccctggatatttccatgttcctacacagtccacgcctccaaaagatgaaacctggcatgacataacattggagactatctcctctgcaccttctaagcttgtctcctttccactgaagccatcaactcccattcaagaagcaataaaacctttcctatcttccctggggccaaagagttaaatttagggacagagaccttctgttcctatcctagaaagaatttgtttaccagagaaaaagataaactgagcactctacctccagaaagaaagattagatatgtcagctcccataaaagcttagagattactaatttctgggttctctttctccaaaccttgcctatagtccaggtatacacatatggctcttactttgttgctctgaggagaactggataagagggatctagtactaccacgctaccttggctgctgtcactgctgtgtggtctgacttctgattcagagccctggggcttctgcaattatatatacaagtagggtaatatcagagacccttcagagatctagacataacacctgatgtcttatatacatggtgctgtactatattttaaacacttggtttattccatttaatatatcctgaaaaataatgcaagaaaaaaatttttttagagagaaagagaaaacacacatgcatgagttgggatgaggagagggagagagagaatcttaagcaggctccacacccagcacagagcctgactcagggcttcatctcatgaccctgaggtcatgacctgagctgaaatcaatagtcagaagcttaactgactaaaccacccaggtgacccaatgtaagaaaatgttaatagaccagtaagtccgtatattcttgatcaatgatattttaggaatactttaaatatcttaaccaaaaaacacttcttaactggccataatggtccaaaattagataattctttaaatattttgtgtaaagcttaatctaactttatatgttattctattattaaatttttactaacttaatcttttttccaaatgcaattttcctatattcagagaataaatgttagctaaaacctgatcttttctgttgccaaagaagcaaagttcaaatataattgcagatcactgatctcaatgaaaacattctacataaagaacaaattcaaatgctttgaagaaaaaaataatagcatgcgtttacgcatttttaaaaagcaagccaaataaagcaatataaatattctaaagtgcaagttttaagaacatatacaagtattttgggaaatataaaaacaatccaagtattatctacaaatagttcttcttaattataagactaagaagtggatttaggtaacaaatatctgacaagttaattgaaattaacatatttgaataaatgtcagtaagttttggctcatcagtttattacctaataaaatactgaacttaaacttagaagaattatttatatataactatattatatacaatataatatatatacagctctctctatatatttaatatcagataatggtgtcttagaaaaaagataaacattttatgtatatatttaacataaaataacaatgttttaggaaaaaacttaaggatataaacaaaaatttaaaaaaataaataactgtttagttctgagtaatgggattatgaggacttttaggtgaggttttcatggctttctatatttctcatgcattctaaaatattctgttactataatctaactagtttgtttttccagtcttttttttattttttaagatcttatttactgggcagcccggatggctcagcggtttagcactgccttcaaccagggcgtgatcctggagtcccaggatcgggtcctacgtcgggctccctgtatggagcctgcttctccctctgcctgtgtctctgcctatctctctctctgtgtctcatgaataaataaataagatcttttaaaaaaatcttatttattcattcatgtgagacacagagagagaagcagagacacaggcagagggaggagcaggctttctgcagtagcctgatgcaggatcggagcccgggaccctgggatcatggcctgagccaaaggcagacactcgaccactgagcaatccaggcatcccatgttttgccagtcttcttaaaaataataaaaattttaaaaaataacactaataaaaattcagtaaggtcaaagggcataaacttaatacataaataatatacttctatcttttacatacacatattatacatacatatacacacataaaatatcaatatgtatattctagaagacaatgaaaaaaagaacccatttacaatagaaactaaagagataaaatatctagcaatacatttaagtgtccagtcataaattttgaaagcatgaaaactctactgcacccaggacaatttacacgtttaatgcaatccctatcaaaataccatggactttcttcagagagttagaacaaattattttaagatttgtgtggaatcagaaaagaccccgaatagccaggggaattttaaaaaagaaaaccatatctgggggcatcacaatgccatatttcaggttgtactacaaagctgtggtcatgaagacagtgtgatactggcacaaaaacagacacatagatcaatggaacagaacagagaatccagaagtggaccctcaactttatggtcaactaatattcgacaaagcaggaaagactatacactggaagaaagacagtcgcttcaataaatggtgctgggaaaattggacatccacatgcagaagaatgaaactagactactctcttgcaccatacagtaaaataaactcaaaatggatgaaagatctaaatgtgagacaagattccatccaaatcctagaggagaacacaggttacaccctttttgaacttggccacagtaacttcttgcaagatacatgcacgaaggcaaaagaaacaaaagcaaaaatgaactactgggacttcatcaagataagaagcttttgcacagcaaaggatacagtcaacaaaactaaaagacagcctacagaatgggagaagatatttgcaaatgatgtatcagataaagggctagtttccaagatctataaagaacttattaaactcaacaccaaagaaacaaacaatccaatcatgaaatgggcaaaagacatgaagagaaatcttacagagtaagacatagacatggccaacatgcacatgagaaaatgttctgcatcacttgccatcagggaaatacaaatcaaaaccacaatgagataccacctcataccagtgagcatggggaaaattaacaaggcaggaaaccacaatttttggagaggatgtggagaaaggggaaccctcttacactgttggtgggaatgtgaactggtgcagccactctggaaaactgtgtggaggttcctcaaacagttaaaaatagacctgccctacaaccctgcaattgcactgttggggatttaccccaaagatacagatgcaatgaaacgccaggacatctgcaccccgatgtttctagcagcaatgtccacaatagccaaactgtggaaggagcctcagtgtccatcgaaagatgaatggataaagaagatgtggtttatgtatacaatggaatattactcagccataagaaatgacaaatacccaccatttgcttcaacgtggatggaactggagggtattatgctgagtgaaataagtcaatcggagaaggacagacattatatggtctcattcatttggggaatataaataatagtgaaagggaatataagggaaaggagaagaaatgtgtgggaaataaaagaaagggagacagaacataaagactcctaactctgggaaacgaactaggggtggtggaaggggaggagggcgggggctgggagtgaatgagtgacggacactgagggaggcacttgacgggatgagcactgggtgttattttgtatgttggcaaattgaacaccagtaaaaaataaatttattataaaaaaataaaaaataaaaataaaactctactgcaggtcacaaaagaaaagctaatgtaaagacatcaggttctggaatggaaagattcattataaagatgtcaactgtccctaaaataatttataaatttaatgccagtaggatttagtcagggaggggaagaaaccaaacaagataattttaaatgtcatatgtaaacaaagcaaacaaacaattctgaagacagaaatatgaagggcctggacctttcagatattgtattataatgctttaataattacatatataaaatatatatatttaaatgaaacagtccaaaaatagacccaaatatacacacatgagagtttagtataaaaggtaatgtcttgaatagtgaagagattcactaatctcagttgtattgagacaactatatagccaactggataatatagagctaaatccattctttatactagttaaattccaaacatcaaagatttatgtttaaaactgaaactgttaaaacattgagaagaaatacatccacacaaatagaagctcatctttgacaaaggagcaaaagcaatttaatgaaggaaggatatctaaaacaactggacattcacatgcaaacaaatgaaattagacaccggctttatattttcacaataactcaaatgaatcatagatctaaatgtaaaacatacaactataaaatttacagaagataacatagaaaatcttggtgaccttgaatttggcaaagagtttttagatacaacacaaaaagcaaaatccatgaaagaaaaaattgtaagctggatttcattattattttttaaaaccctgctttgtaaaagacactgttaagaaaatgaaaaaaaaaaaaaaaaaccaagcctgagagaaaatatttgcaagatgtctaataaagaatgtgtattcaaaatatataaaagaaatcttaaatggcattgggaaaactagataactatatgcaaaagaataaaactggaccactatcttataccatgtaccaaaataaattcaaaatggattaaagtcttaatgtaagacctggaatcataaaactcctacaagaaaacataggcagtaagtctttgatctgtcttagaaatattttgggggactaatctcctcaggcaaaagcaacacaagctaaaataaacaaatgggattgtatcaaccataaagctttacacagcaaagaaaatcatcagcaaaaagaaaagacaacctactgaatgtaagaaggtcttagcaaattatacatctaacaagaagttaatatccaaaatatataaagaccttatacaacttaaaataaaaaaaaacaaataacccaattaaaaaatagggagaggacttgaatagacaattttccaaaaaagacatacagatggcaaacagatgcatgaaaagatgctcaatatcactaatcagcagagaaatgcaaatcaaaatgacaatatcacctcatacctgtcagattggctattatcaaaaagacaaaaaaaaaaaaaaaagtgctcctgaagatataaaggatcccttgtacactactggtgggaatgtaaattggttgcaaccactatggaaaactgtatggaggttcctcaaaaaattacaaacagaactaccatatgacctagcaattccatttctaggtatttatctgaaggaaacaaagacatcaaactgtaaaaatatatgcactcctatattcattgcattatttacaatagccaaaacacagaagcaacctaagtgtctatggatagatggattaaaaaaaagtgatacacacacaatacagtattactcaccacaaaatagaatgaaatcttaccatttgagataacatggatggacctagagtatattctgttaattgaaataagtcagagaaagacaaataccatatgatttcacttatatgtggaatctaaaaaacaaaagaacaaaacagactcaaagcaggaggggttgagggcaaaatagatgaggaggattaaaagtcaccaactcacagtaacttcttgcaagatacatccacgaaggcaaaagaaacaaaagcaaaaatgaactattgggacttcatcaagataagaagcttttgcacagcgaaggatacagtcaacaaaactcaaagacaacctacagaatgggagaagatatttgcaaatgacatatcagataaagggctagtttccaagatctataaagaacttattaaactcaacaccaaagaaacaaacaatccaatcatgaaatgggcaaaagacatgaacagaaatctcacagaggaagacatagacatggccaacaagcacatgagaaaatgctctgcatcacttgccatcagggaaatacaaatcaaaaccacaatgagataccacctcacaccagtgagaatggggaaaattaacaaggcaggaaacaacaaatgttggagaggatgcggagaaaagggaaccctcttacactgttggtgggaatgtgaactggtgcagccactctggaaaactgtgtggaggttcctcaaacagttaaaaatagacctgccctacgacccagcaattgcactgttggggatttaccccaaagatacagatgcaatgaaacgccgggacacctgcaccccgatgtttatagcagcaatggccacgatagccaaactgtggaaggagcctcggtgtccaacgaaagatgaatggataaagaagatgtggtttatatatacaatggaatattcctcagccattagaaatgacaaatacccaccatttgcttcaacgtggatggaactggagggtattatgctgagtgaagtaagtcagtcggagaaggacaaacattatatgttctcattcatttggggaatataaataatagtgaaagggaaatatagggaagggagaagaaatgtgtgggaaatatcagaaaaggagacagaaacgtaagactgctaactctgggnnnnnnnnnnnnnnnnnnnnnnnnnnnnnnnnnnnnnnnnnnnnnnnnnnnnnnnnnnnnnnnnnnnnnnnnnnnnnnnnnnnnngaacaccaataaaaaataaattaaaaaaaaaagtcaccaactcagagagggaggtaaaatggtagaagagtagaggatctcatttcatctggtctcttgaatttagctagataactattaaatcactctgaacacctgtgaattcaacctaagatataagaattcctggaattctacaaatagaaaagagactgctttttgcaaggtaggagtatggagaagagaaagaaagggggtatattggaagataaacagcagtggggagggagcctctgaaacttgactatcaaaaagtgatacagtcctagggtacaaaatcagaacctttagaaatcaactccagtgagagacctccctgtgtgaaaggtgctcagtggtaaagtggggcagaatcctaggtgacctcgggatccccggggtcacagagagaatgggggtgcctgagccagcagagttcccaatcactggagcaagaaacccttaacggtctggagcccaggagagagctctcagctgagtttgccataaacctcaactactgcatgatttggcaacagcactcagtgtggggggcatgaaggtgtcttgcgaaggacaaaaaaagtggcagccctctgccttccccggagtgggcaccaccaggcgactgctctgcatacaagggcctggcaaagaacaagtgtggcaaatgtgcgaccctccaccttcccccaggaggatcagtgcataccacctgcaaagtgtggcatgcacaaaactgaagactgcttatccttaagggtttactgaagaaaggagaccacaatcttcagctccagggctgaagatctgggcttggccatttttattctcatcctctaaagaggcacagggaaccttcagggaataaaagtcacattaaaaaaaaataaaataaaacaacccagaaacagcttacactgagctcaagcccctgggcaaggggtggtacaactctgcccaaagtcacttgagaatccgtgcagcaggcccctccctcagaaaactagctggaagaaaagggaacaccaagtatagggagcacagggcactgcaaaactccagtgctaggggaaaacagtatatagaattcgagggtttttctcatgagtcatttatatttcaatttaaaattttccttttcttgggacgcctgggtggctcaatggttgagcatctgccttcggttcagggcatgatcccagaatccctggatcgagtcctacacgtcaggctccccacaggaagcttgcctctccctctgcctatgtctctgcctcttctctacatgtctctcatgaatacattttttttattttattttttttccatttcaactagtttattttatcagctctttggttttaagtcttttttaatttattttttttaaagattttatttatttgttcatgagagacacagagagagaagcagagacatagacagagggagaggcaggctctccatggggaacccaatgcaggacttgatcccaagaccccaggatcatgacctgagccaaatgaagacgctcaaccactgatccacccaggcgtctctaagtcttttttttcactttcattttttatatttacatttcatagatatattcttcatttttggcttcctttcaccatattcaattttatttttgtacatataagttttgctttctttatagtttcaggatttattgtcttctaacacacaaacaaaatacacacaggaccaagtgggtcaccctgttttgtccacctggaagattatgctctctcccctccccttctgatttcttttttttttttttcctttttttttttcttttttggtttctgaccttttcagatttatctagtgtgtattttgtgtggaccgtggttgatatttctgatttcatttactcattcagccattcttctctgggcaaatgaatagaaggaagaattcacaacaaaagaaagaaacagaggtaatattctctgccacagatctaatcgatatggatgcaagtaagacgtcagagctggaattcaggataacaattacaaagttactacctgagcttgaaaaaaagcataaaagacactagagaatctcatagtgtagaaatgaaatctaatcaaaccaaaattaaaaatgctatgagatgcaggttatattggatctctaaacagtttgggtaaatgaggcagaaaagaaagcaagtgatacagaaaacaagttaatggaaaggaaggaagctgaagaaaagagagaaaaacaatgaatggactgtgaggggaggctttgagaaatcaatgatgccataaaacaaaacaatattagaattattggagttcctgagggagaagaaagagagagagaatgagatagaaggtgtatttgagcaaatcatagcttagaatctccctaatctgaggaaggaaatgacattcaagtctaagaggtagagaagacccctcccaaaaatcaataaaaatagatcaacaccctgataaataatactgaaacttgcaaatttcagaaataaagagaaaatccagaaagctcaagataagaactccttaacctacaggggcaagaacattagactagcagcagacctatctacagagacatggcaaaccaggaagggctagaatgacatattcaaatattaaatgagaaaagcatgcagccaagaatacttcatccagcaaggctgtcattcagaatggaagaaaagataaagagcttccaggacagaccaaaactgaaagaatatgtgactactaaaccagccctgaaagaaatattaaaggggaatcctgtaactgaagagggagtccaacagtaacacagaccagaaagaaacaggaattttataggcaatacaatggcactaaatgcatatctcttaatagttattctgaatgtaaataggttaaatgctccaatcaaaagatatagggcatcagattggataaaaaagtaacccacccatatgctgtctaccaaagactcattttagacctaaagacacctccagattgaaagtgaaggggtagagagccatttatcatgctaatggacctcaaaagaaagctggagtggcaatccttctatcagacaaattagattttaaaccaaagactgtagtaagggatgaaaagggacaatacatcatacttaaagggtctatccaacaaaaatatctgacaatcataaatatttatgcttctatcttgtgagcagccaattacatcaaccaataacgaccaaagtaaaaaaacacatttataataatataataatagcagggtatttcaacacccacacaccacaatggatagatcatctaagcagaagatcaacaggaaacaagggctttgaatgacacactggaccagatggatttcacagatatagagaaagggagcattccgccttaaagcacaatatacattcttttcaagtgcacataaaatattctccagaatagatcacattctgggtcacaaatcaggtttcgactgataccaaaagactgggattcttccctgcatattttcagaccataatgttttaaaactggaactcaatcacaagaggaaatctgaaaggaactcaaacacttggaggtaaagagtatcctactaaagaacaaatgggtcaaccaggaaattaaagaagaatttaaaaaattcatagaaacaaaggaaaatgaaaacacaactactcaaaactgttgggatgcagcaaaggtgatcctaagagggaaataagtagatagcaacacaagtctctcaaaaaaacagaaaagtctcaaatgcacaaagtaaccaaccttacctaaagaagccagagaaagaacaacaaataaagcctaaacccagcaggagaaaagaaaaaataaagattagagcagaactcaatgaaatagggcagcccaggtggctcagcggtttagcactgcctttagcccagggcgtgatcctggagacccagcatcaagtcccatgtcgggctccctacatggagcctgcttctccttctgcctgtgtctctgcgcctctctctctctctctctctgtgtgactatcataaataaataaaaattaaaaaaaaaaaaaactcaatgaaatagaaaccaaaagaacagcaaaacagatcaatgaagctagaagctggttctttgcaaaaattagtaagattgataaacccctagccagactcatcaaaaagaaaaagaaaggacccaaattaataaaatcatgaatgaaagaggagagatcatgatcaacaccacggaaatacaattttaagaatatattatgagcaactatatgccaacaaattaggcaacctggaagaaatgaatacattcctagaaacttataaactaccaaaactggaacaggaagaaatagaaaacctgaacagacccatagccagcaaggaaattgaaacagtaatcaaaaatttctcaagaaacaagagtctagagccaaatagcttcccagaggaattctaccaaatatttaaagaagaactaacacctattcctccgaagctgtttcaaaaaacagaaatggaaagaaaatttccaaactcattctatgaggccagcattaccttaatcctaacaccagacaaagacctcattaaaaagtagaattacatgggcagcccaggtggctcagcagtttagtgccaccttcagcccagggtgtgatcctggagatccgggatcgagtcccacatcaggctccctgcatggaggctgcttctccctctgcctatgtctctgcctctctctctttctctctctttctgtgtctctcatgaataaataaaatctttttaaaaaaatatgcttataaaaaaatagaattacagaccaatatccctgatgaacatagatgccaaaattctcaccaagatactagccaataggatccaacagtacattaaaaggattatttaccactaccaagcaggatttaatcctgatctggaagatggttcagcattagcaaatcaatcaaaatgatacatcacattaataaaagaaaggacaaggaatatatgatcctcccaactgatgcagaaaaagcctttgacaaaatacagcatcctttcttgattaaaactcttctaaatgtagggatagagaatagaagaaacatacctcaatacaataaaagccatctacaaagagcccacagagaatatcatgctcaatagggaaaaactgagagggtagccctggtggcccagcggtttagcgctgcctttggcccggggtgtgatcctggagacctgtgatcaagtcccacatcaggctccctgtgtctctgcccccacctctctctctctctctctctctctctctctctctgtgtgtgtgtgtgtgtgtgtctgtctgtcatgagtaaataaataaaatcttaaaaacaaaaaaactgagagcttttcccctaaggtcaggaacacaacagagatgtccactctcactactgtcgttcaacacagtactagaactcctatctcagcaatcagacaacaaaaggaaataaaaggcattcaaattggcaaagaagaagtcaacctctccctttgcagatgacatgatactgtatatgaagaacccaaaagaatccaacccccaaattgctagaagtcatacagccattcaacaatatggcaagatacaaaatcaatgcacagaattcagttgcatttctacacactaacaatgagactgaagaaagagaaatttaaggaaccgatcccatttacaactgcatcaaaaaccataagatacctaggaataaaactgaccatagaagtaaagaatctacaaaatacttatgaaagaaattgagaaagacacaaagaaatggaaaaacattccatgctaataggttggaagaataaatattgtgaaaatgtctatgctaccaagagcaatctgctcattcaatgtctccatcaaaataacattgacattttttacagagctggaacaaataatcctaaaatttgtatggaaccaaaaaagaccccaaatagccaagaaatgttgaaaaagaaaaccaaagctggaggcatcacaaagcctgacttcaaactgtatttaaaatctgtaatcatcaagacagtatggtactggcacaaaaacagatacatcaatcaatagaacagaatagagaacccagaaatggaccctaatctctatggtcaaataatctttgacaaagcaggaaacaacattcaatggaaaaaggacagcctcttcaataaatggtactaggaaaattggacagccacacacagaagaatgaaactggaccattctcttacaccatacacagagataaactcaaaatgatgaaagatgtaaatgtgagatagaaaaccatcaaaatcctagaggagaacagaggcagaaacttcttgcaagacatgtatataaaggcaagggaaacaaaaacaaaaatgcactattgagacttcatcaagataaaaagctcctggcacagcaaaggaaacagtcaacaaaacagcagccttaggataaagaagatatttgcaaatgacatatcaaataaagagctattatccaagatatatgaagaacttatcaaactcaacacccaaaaacaaataatctggtcaagaaatgagcggaagacatgaacagacatttctccaaagaagataaacaaatggtcaagagatacatgaaaaaatgcttcacatcactcggcatcagggagatacaaatcaaaaccataatgagataccaccttacaccagtcagaatggctaaaattaataggaaacaacaaatgtcggtgaggctgtggagaaaggggaatcctcttacactgttggtaggaatccaagctggaaatgcaagtcactctggaaaacagaaggtcctcaagaagttaaatatagagctatcctacagctagcaattgcactactaggtatttatcctaaagataaaaatgtagtgatatgaaggtgcacctgtaccccaatgttcatagctgcaaggtccacaatagccaaactatggaagaagccaaaatgtccatcaacagatgaatagataaagatgtagtattactcagccatcagaaatgattgatacttatcatttacattgatgtggatagaactggagggtattatgctgagtgaaataagtcaatcatagaaagaccatatggtttcactcatatgtggaatctaagaaacagcactaaggatcataggggaagggagggaaaatggaatgggaaatttcagagaggaagacaaaccatgagagactcttaactctagtaaacaaattaaaggttgttagaggggagaagggagttggggtaattgggtgatggggattaaggaagacacacagtatgatgagcactgaaggttatatacaactgattaattattgaacactatatccgaaactaatgatgtactatatgttggtgaattgaatttaaattttttttaaaaaggtataaaccctcagttataaaataaagtcgaagaaaaatccattggtttgatgagaatctacaaaatcatgagtttcttgatctgtccctggtatcataatgtgtaagaactgcctattccaggatttctctagaggctggcaagagtcctgaacccgctgtcatttctatcttgctggcctgacagggttgagaagatactagccttggacccactttcctttcttacctaatgttttcctaccagaatgctctgggttgtaattgccatgagttggaaacagtttgcatctacaagtataaatttattcatccttttaacttatgtaaggcttttgtacccaattatcaattctttaaaatatgacactaaattttggttttctactgtcatgtgagaacattaggacccagaaaaacatcattgtgtgaggaaaataaagtgctgcagcaaagaaaataaaaaataaaatcatggagatacaacgtccaagatggtgacagtagtcaacagtatcataataactttacatggtgacaaatggcaattgggacttatcgttggaataattttgcaatgtataaaaatataaaatcactaccatatacaccagaaatgaataggatattatgtcaattatacttcagtaaaaaataaaattaaaaattaagaaataaagagtcttggttgtcaaaaacaagacttccaacaataagaaaacaaccccattaaaatatgggcaaaagatggggtgcctaggtggctcagtcagtttaagcatccaactcttgattttggctcaggtcatgatcttagagttgtgagatcaagctccatgtagggctccatgctcagcagggagtctgcttaagattctgtctctccctctccctctgccccaccatccctctaaaataaagaaataaatctttaaaaataaaataaaataaatatgggcaaaagatctagatactctaccagcgaaaatacacagatggaaaataaggatattaaaagatgccaaacatcatatgtaattaaggaaattacaaattaatacaatgagataccacaacaactggaatggctaaaatctgtttttaaaatggacaatagtaaatgctgacaaggatgtggagcaatgagaactcattcgttgtaggtatgcgtgcaaaaatggtaaagccacactggaagacagtttggcagcatcttataaagttgaacataattcccccatatgatcacacccctaagtatttacccaaattagttgaaaactacatccatacaaaaaaagctacacacaaacatttatagaagctttattcataattaccaaaacttagaatcaaccaagacgtcttcaataggtgaatgtgtaaacatacactggtataactatataatgggatactattcagtgataaaaagaaatgagccatccagaagaaatgaacagatatttccctgaagaacacatccagatggtcaacagacatgtgaaaagatgctcaacatcactcatcatcagggaaatacaaattaaaactacagtgagatatcacttcacacctgtcagaatggctaaaatcaaaaacacaagaaacaagggtgccttgcgatcaagccctatgtagagctccatgctgggcatggagcctgcttaagattctctcttcctctctctctgctcttcccctcaacactctcccaaaataaataaataaacacaagaaacaagtgttggcaagtatgtgagaaaaaggaaccatcatttactgttggtaggaatgcaaactcatacagccactctggaaaacagtacggaggttcctcaaaaagttaaaaatagaactaccctacgttttagtaactacactactaggcatttacctaagagatacaactacaaacactcattcaaaaggatacatgcccccctgatatttattgcagcattatttacatgagccaaattatggaaacagtctgtgtccatccatagatgaatagataaagattggtatatatatacaatggaatgttattttatccataaaaaagtatgaaatcttgccatttgcaacaacatagagctagagaatataatgctaaatgaaataagtcagagaaagacaaataccatatgatttcagtcatacgtagaatttaagaaacaaaccaaaaaaatgagcaaaggtaaaaaagagaaacaaaccgagaaacagactcttaactatagagaaacaaattgatggttaccggaggtgaggtaggaggaaagacaaataaaataggtaatgaggattaaggagtgcacttgtgatgagcactgggtgatgtacagaatcactgaatcaatatattgtactcctgaaactaatatagcactgtatgttaactatgctggaattaaaatttttttaaaaatgagcgatcaaaccatgaaaagacatagaagaaccttaaatacatgttgctaagtaagagaagtcaatctgaaaatctacatctgtattattccaactatatgacactctggaaaaggcaaaactacagagactgtaaaaagatgagtgggagggataaatagatgaagtatgagatttttttaggctaatgaaactattctgtttgataccataatggtggatatgtgtcattacacatttgtcaaaactcacagaactgtacaacagaaagcctgaatcctactgtaaactaggtgcttttattaataaggtactgatactggttcattgattataacaaatgtaccatactaatgcaaagtgttaacaataagggaaactgagtaaagaggagaagagagtcataccagaattctctgcactatgtgctcaattttctctgaatctaaaattactcaaaaaaaaaaaaaaaagaaaattaaggggcacctggatggcacagttggttgggcatccacttcttggttttggctcaggttatgatctcagagtcatgaggtcaagacccacatcaggctctgcacttaacacaaagtctaattgtccttctcccatcctctctgcccctccccactgatcatactcatgcatgctctctctctaaaataaatacaatcttttaaaaaatagtccagtctcctctaaattggaagagtaagagactagtagtagtgtgtgtacactcatcactatatctcaaatagagttcattccagcaccatggggagaaatttacaaattgcagaacctaggtatgactaactaattcttctctttagtcaagttgttaaggacaaaaactctaaaactggaaaaaatggaggaaaagctaagagcagagtagtaggaggaccctaggcttgcctcatctctcaaacacagctaatgaaactattatataaagatcaaatcattctaaatacccaagaaatctgaggactgacagaacaaactgtacaaatagagggagagaagaggacatatcatagaaggtaggagatgcagagatgtggtttggggagagaaacagatcgtgggtgctgcagaggggacagagccctgctcacagataggagggagagggagagacagacagaaaggagtgcacaggagattgcattaggaaaacacttccccagagccactgattgggaaaactgatttttgtgaatttttacaaccagtgggactcaaaagactggagctttagctatccacagcaaagcaggtatggagcctggcaagcactgcagttctcctgtagagaaggagatcagatagcctgtgatctgaggattgcctgggatgcactgggagagacagttctccttcttggagcacatctgggagagcatcttttcttcctctgtgtctcagcatagctgcaaagacacctgctgagggaagctaatctggaaactggctctttgctatgttttacaccaaactccaaacccctgcactttggcgtatctaccctttgggacaaacctgcatcacccccagcacagtgagaccctcccctggagaaccaacacaggtccctgctgcaccaggtctctaaagtttggagttttaaaattcatcccatctgcctaggatagaccccaaggtgcactatatgatcaggttgacagacagggttaaggtagggatttgagggatgcctgggacacactaaggggagattctctgctcttctgggaggggttcctggacagtgacaggcttgaactcccatctctagagataagggagggggctggccccatttccctcccctacgcctcagcataaactaatttcagtaagcagcaaagtgccaaaagtggtagcctaaacagtttatgccaaacccattccctctgctctgctggtgctgctttcttgggcaagtgtgcctaagaaccagtatggcagcccctccccaagaagaccagcacaaaccccccaccccctacgtaccacatctaccaaccataaagttccacaaagtttccactctagtggaaatagcatcaggtctcttttaacaagcagatcagaatacaactagttaaaactcaccacactctggccaaggccaaacactccccaatgcaggcaagatgtaactgtgcagaaaactgacctgaggaaaagaggtgccaaaacacacagtagcccagtgcacactctgaaacacttactaaagcaccaggccctggacagtataggacttcttcttcataaaaccattactctcaggaacagtaaatataacaggctttcctaacacaaagaagacagaaacctggacaaaatgccaagacagaggacctaaaaggaagaacaaaaaatggtcatggccagggatctaatcaaaacagatataagtaatatgcctgatccagaatgtaaagcaacaatcataaagatactacctgggcttgacaaaagtatagaagataccagggatacccttaccgaagagacaaaagacctaaaacctagtcaggccaaaatgaaaactgtaataactgagatgcaaaactgactggatggaaggaccacaggatggaagaagcagaggaacaagaaagtgatacagaagataaaattatggaaaataatgaagctgaaaataaaaatattggatcacaaatgtagacttagggaattcagagactccataaaacataataatatttgtatcatagaagtcacagaagaagaagagagagaaaggaggcagaaagttatttgacaaaattacagctgaaaacttcccctatctggtaaaagaaacagatatctaaatccagaaggcacagagaactcccatcaaactcttggccaacaccaagacatatatcatagtaaaatttgcaaaatacagagataaagaaaaaaaactcttggcaaacatcaagacatatagtaaaatttgcaaaatacagagataaagaaaaaaatcctaaatgaaggaagacaaaagaagtccctaactaacaagggaagaagaataaggttagcaacagttctatccacagaaattcagcaggcaaaaagagagtggcaggatatattcaatgtgctgaatgggaaaaatatatagccaagaatactctatcctgcaaggctgtcattcagaacagaaggggagataaagagtttcccaaacaaaagaagttcatgaccactaaaccagccctgcaagaaatattataagggactctgggtggaaaagaaagaccaaaagtcacaaagactacaaaggaacaaagaaaatcgccaaaaaaaaaaaaacaaaaaaaaaaaacaaaaacaagtaatacaatggcactaaatttgtatctatcaataatcactctgaacgtaaatggactaaatgctccaatcaaaagacatagggtgtcaggatggattaaaaaacaacaacagggacgcctgggtggctcagcggttaaacatctgccttcagcccggggcgtgattctggagtcctgggattgagtcccacatcaggttccttgcatggggcctgtttctctctctgcctgtgtctctgcctctctctctgtgtctctcatgaataaatagatagaatcttttaacaacaacacaaggcccatctatatgctgcttacttcattttagacgtaaagacacctgtagattgaaaatgaggggatagagaaatatttaccatataaatggatgtccactgaaagggagagtagtcatacttatgtcagacaaactagattttaaactaaagactataacaagagatgaagaaaagacactacatcataataaaggggcctatccaacaaaaagatctaacaattgtaaatatttatgcccccagcttgggagccccaattatataaaatagtaacaaacatgaaagaatttgggacacctgggtggctcagcagtttagtgcctgccttcagcccagggtgtgatcttggggtcccaggattgagtcccacattgggctccctgcatggagcctgcttctcctctgcctgtgtctctgcctctctctctctctctctctctctctgtctctcatgaataaataaataaaaaataaaataaaatcgtaaaagaattcattaataatataattctaggggactttaaccctccacttacatcaatgcacagatgatccaagcagaaaatcaacaatgaaacaatgggtttgaatgacacactggaccagatggacttaacagatacattcagaacatttaggcccagagcagcagaatacacattcttttcaagtgcacatgggcccttctccagaatcgatcacatactagttcacaaatcaggcttaatgagtacaaaagactgagatcacattttctgatcacaatgctataaaacctgaagtcaaccacaagaaaaaacttggaaagaccacaagtacatggaggctaaagaacatcctactaaagaatgaatgagtaagggcgcctgggtggctcaataggttaagcatctgactcctgatctcagctcaggtctttgttttgtttgtttttttaaaaaaagattttatttattcattcatgagagacccagaagagagataggcagagggagaaacaggcttcctgtggggagcctgatgcaggactcaatcccaggaccctgggaccacaacgtgagctgaaggcagatgttcaaccaccaagccaggcaggcatcctgatctcagctcaggtcctgatctcagaattatgagttcaagccccacattgggctctacttaaaaaagaagaataaaaaaatgaatgggtcaatcaggaaattaaagaataaaaaaaatacatagaaataatgaaaatgaaagacgatggcccaaaacctttgggatacatcaaaagggtcctaagaggaaagtatatagcaatacagacctacctcaagaagcaaaatctcaaatatgcaacctacacttacatctaaaggagctagaaaaagaacaacaaatgaagcctaaagccagaaggagggacataataaagatgagagcagaaataaatgatatagaaacaaaaagaaacagaccaatgaaaaccaggagctgaatctttgaaaaaattaaaatcataaaattaagaaaatttatcaatataaacccctagccaagaaaaaagacccaaatgaataaaatcatgaatgaaagaggagagatcacaatcaacacaacagaaatataaacaattataagagattatgaagttgcaaaggtggttcaatatttgtgaatcaatcgtgatataccacattaataaaagaaaggataagaaccatatgatcctctcgatatagaaaaatcatctgacaaagtacagcattccttcttgataaaaaccttcaacaaaatagggataaatggaatatacctcaacatcataaaggctatatataaatgatccacagttaatatcattctcaatggggaaaattgagagctatggtcaggaacaagacagaggtgtctactctcaccactgttatttaacatactggaaattctagcccctgagcaaacagacaacaacaacaaaaggcatccaaattggtaaggaagaagtcaaattcactatctgcagatgacatgacactctatgtagaaaacccataagactccaccaaaaaaactgcaaggactaatatacaaattcagtaaagtcacaatatacaaagtcaatgtacagaattctgttgcatttctatatgccaataatgaagccatagaaaaagaaatcatggaatcaatcccatttacaattacaccaaaataataagatacttaggaataaacctaaccaaaaaggtaaaagatctgtactctgaaaactatagaacactgataaaagaaattagagagggcataaagaaatggaaaaaacattccatgctcagagattggaagaacaaatattgttaaaatgtctacactacccaaagcaatctatacatttaatacaatctctatcaaaatactcaccagtatttttcacagaattcgaacaatcctaaaatgtgtatgggaccacaaaagacctcgaatacccaaagcatcataattctgaacctcaagttatattacaaagctgcagtcatcacgacagtatggtacagacacagaaacagatacacagatcaaaggaacagaatagaaaacccagaaatggacttacaactatatggtcaactaatcttcaacaaagcaggaaagaatatccaatggaaaaaatacagtttcttcaacaaatgctgttgggaaaactggacagcaatatgcagaagaatgaaactgatcacttacaccatacccaaataaaattcaaaatggacaaaagacctaaatttgagataggaaaccatcaaactcctagaggagaacataggcacaaacctctttgacatcagccatagcaacttcctactagatacatttctggaggcaagggaaagaaaagcaaaaattaactattgggacttcatcaagataaaaaatttctgcacagcaatggaaaccatcaacaaaactaaaaggcagcctacacaatgggagaaggtatttgcaaattgcatgtctgataaaagattaatatccaaaatctaaaaagaacttaacaaattcaacatctaaaaaacaatccagttaagaaatgggcagaaggcatgaatagacattttcccaaagaagacatccagatggctaacagacatgaaaagatgttcaacatcactcatcatcagggaaatacaagccgaaactgcaatatctcatacctatcagaatggctaaaattaacaacacaggaaacaacagtgttggcaaggatgcagagaaaggggaaccctcttacactgttgatgagaatgcaaactaatacagccagtctggtaaatggtatggaggttcctcataaagttaaaaatagaactaccctaagattcagcaatttcactactaaggatttacccaaaggatacaaaaatactgatttgaagggttacaggtgccccagtatttatggcagcattaacaacaggtaaattataaaaagaacccaaatatccatcaactgatgaatgaataaagaagatatggtagatatgtacaatggaatattactcagccatcaaaaagaaggacatcttgccatttgcaacaatatgaatggacccagagtgtattattacactaagaaaaaaagtcagttagaaaaagacaaatgctatatgatctcactcatctgtgtaatttaagaaacaaaacaaatgaacacaggggcaaaaaaggagaggcaaaccataagacagacctctaactatagagaacaaaactaagggttgatagaggaaggtgggtggaggatgggctagacaggggatgggtattaaggagggcacttgttatgatgagcactgggtgttatatgtaagttatgaatcactaaattacatatttaatgaaactaatataagactgaaactaatattacactgtatgttaactggaatttaaataaaaatttgaaaataaataaaaaataaacctggaaaaatgtataaacaaaatctataattttttaaatgaataaattccttcaaaactacggtataagacaaaccacagtaaaactcaaattctacaattctgaagagaaaagataaatttgaccagataattctttaaggaatagggaaatttcaggggtgctttggtagttcaactggtaaaacatccaactcttgatttcagctcaggtcatggtctcagggttgtgagatcaagccctgcttggggctctgcactcagggcagagtctccttgaaattctctctctctctctctctctctctctctctctctgccttcctcttcctcttgtgagctttctctctcaaataagtaaaatcttaaaaaaaaaaaaaagaatagagaaatttagatgataaatgacaacttggggggaaatgtagtttgtttctctttcatataaagaaagtatctaagacacctggatgactcaatgtgtgaagcctctgactcttcgttttggctcagattgtgatctcatgggatagactgcctactcagcagggagtctgcttgaagattctctccctcaggccctcccctcactcacttgcatgtgtgctctctaaaataaatctttaaaaaaaaaaagtatcagaagctaatacagttcaaatatgacagaaaaatgggcaaaagattccaaatcaaattccaaatgttcaggtccatttcaatgaatagtatacaactacaaaagagtacaggagagggaaactgcttgctaggcactagatatttcaaattgatggttttagcacataaaagtaggatgacaaattgaaaggtatcgtttttcctcatggttatttggaaggtgtagctaggatatggcacactattaagcacagttcttcaacattctgaatatcactacagagaatttttgtaatatattccaaagtcatttttcttacattgcctttttgcaattttatttccttgacatttattccccccccaactcagtttctttttcccataagtgctggtgttgtgtaaggtgctacctggataacctgtatcttgactatacctacatctgtactcctcagttcaaaatcccacagctgcctactggagactcacatccgatgggcattccccttgttaaagtcaactcctcttcccctgtaaatctgttcttcttccttgcctacttcagatgttgatcagagaggattcagggttgagtaggattggaaagacagaaaagaagagattagggattaatttcaagtttgtagttttgctgactgttaccaaattagctcttaccaaatccagttaatttcaccttctaagcattaaaaagaaaatctcctccttgctatctatattttacctccctaaatcatataatagacacacaatgatttctatgtgtgcttggacttcacaaatctattcatgtccaccagaaagagctttcgagtactaatctgattatatcacttttctacctataatcctctgtggagcaatcacttgttgaggtggtcaggacagtgagccgaatttaacaatcaagcctttattcactcactgtggtagtacaagccagaggccaaaagtgaggcaacagttctacaatattctattccttgccccacccaccattggccagcattaggcaaaagtcaaaggggtgcagtgcaggtgcaggggagcatctcatttcaagaagccccaaacaaaggctcttgactctttatgaactcatgggctgaggagaaagaaagggagaagagccaaaagaggaaatatactaagtggagaaaagtgcctcaatcaaagacccctgataaagaggtcttagcagaagcacctgggaggtgcctctgtcaaggtcttttcttataatgaggcctctgaatggagacacttgagctaaaaatacaggttacataggagcatgtctggcctatgtccctaagtcttggacctcaattttctctataaaactgcaatgcactggatatgcaccgagtctggtgtgggtagggcacctttaccctatgagtcctgccagacaaagcctgtaattgcctgtgggcaggactcataggccacataagtattctggcctggagctaacctcctcacccttcagggcctatcccaaagccttaacttcttctcatggtaaacaaagatcccttccatctgacccccatacctacttttctgctgtcatctcctgtttcccatttcatactccagtaaaaactgccccccctctccaggggtgcctggatggctcagtcagttaaatgtctgcttttggctcaggtcatgatcctggggtcctaggatcgagtcccaagtcaggctccctcttcagcaggaagtctgcttccccctctgcatcttcccctgctcattctctctctctttctctctctttctcaaataaatcaataaaatcactaaaaaaaaaaaaaagtattaaaaaaaaactactcccccaaactattctaacctccatgcctttggtcacagtttcccctgctttccccaccttctgtttcttcaccaagcaaactgccacttatcctttaagactcatcccaagtgccacctccaccaggaagcattcttaacaaatacccaccctcattctagacacaggtaactcttccctgtgctgggaatacaagcgctcaggcatacaaacttctaccaatttacttactacacagtattttctgtttatgtatctgtctatgtaacaaaacactaaattcctagagaacagaagccatatccttttctattctgtatccccagtgcctaacaagtatctggcacatagcaggaacacgaggaatcatctatttgtggaattagtgttctatgaatcagcattaacacagcaacaggacactacagcaggattgaataacacaagccccacaagctaaccagttcccagcacgggcagcctctccacactaaggcccaactgtttcaaaaccaccttgttgtcaggttatccaacatggacctgctggtccaggatctgccatcaaacttctcaaagacaatcttagtacctaaggataacatccttatccttcaacgaatcttctttctctatctcttcaaccctcatatctggctctaagactatcgtcagatacctgctgtaaaaacagcagaaaccagtaagcttcccgagaacaagtatcaaatctactactggggctttttgctaagcctttttatgaccccaatcctcaagccagccagccatccttctttaagagaaaagcctctatgcagcctaacagttctttggaattcctctcgaaaagaccaccattcacttcttacaattggcttcgtagtctacaggcctcagattccatggttgtcaggaatttctaaaaacttttcatttatatatgatgtgtactggaacatttaaaagtgtccactagcgaagtgataactacaacttttcacctgtaagttctgagtttcctatcatttaactttcacccaatttttatgggaatccagtcagagagtagaaggaagaggagagccaagcagaaaacaaagatactcaatgtcagcaaaggtcttagtggccagcagccctaacacaacattaaactggaaaggttcatgtaaacttgtgtccctaatgaagtcatggcttcaaactttgtcactgaagaggtaatcagacttcatccaggaggagactgcacaaatggactccacataggcctaaatcctagacttccaaattccatgttaggaaagttaaatttagatattctctctgtttctctctctgtctcgctctctgtaaacactaagacgtgttccgggactactggcgctgtttctgcatctactgagtagacacagaactacagaccccagaaaaatcaagctgggatgagaagcatgccagatattttaaaaatcccagtgagaatagcaaagattagcttcttacctagtaaaatccttactccacaggtatattcaaaagcaaaagcaatactatgaccatgtgattgtgttctctcctactttttaaacaaagatgtttttgtatcctttgccattcaagacattttagatcctctacatagggaaaagacagatcagtaattttgtgtgaaattaatgcctacaaatataatgttaaaaccctaaaatattttaatggattatgattgcctaaaatgaaatcgagataaataacaataaatcaatgagtaccccctgtacttacaagagaacatgggcaacgatggcattcacatcaaacaagacatcagtagggaattctctaagtaagatgttgcccctattaaaaaaatttaaaaagcattacagaaatatttccttggaattcacttttcttgtctctccaatacggtaggttataagtcctttgacgttacagccttggtatttatccattatctcatgcacctaccagcatgctgactgtaaaaaacacacaaatatttattgaatatacactcactacgtatgttgactttgaagagcttaggctctgggctaggcaaaaagattgggaaaacacatgagtctcaacaaggcgtcctaccatactcccagtcacatacacatacattccctaaatgagctggggaggagacaagtaggagagagaaagaagtgtcctcagcagttgatctctgaggagagagactctgcccccacttctcaggccaaatcccaacagtttgagaaaaagactttgagaaacctcagagactagcagatcaaaatgcaggggaatctgtaactgggacattggcagatctctcaaaaatacatttccttcacacccaaatatggacatgacagatccactcaaaacactaaatttgttaagtgcttactttcccggcacttatagtaggagtttacataagaattctcacgtaggggcagccctagtggcacagcggtttagcgccgcctgcagctcagggcctgatcctgcagaccctggatcgagttacacatcgggctccctgcatggtgcctgcttctccctctgcctgtgtctctgcctctctctctgtgtgtgtgtgtgtctctatgaataaataaattaaaaatctttaaaaaaaaaaaaaagaattctcacgtaatattcaaaacaagcctgtaaggtaggttttatagctattttatctcatttcatagataaggaaggtaaagtgcaggtaacaaatctatgacttagactgtttgctaaacttcatatggccttcattgcataaagctttattctggcttagtgacattttatacattttaatattctagaagtaaagctttgtatctatcacactcaaaaaaatactttacctgaataaatatgctttcatcaaatccttttcttttccacagtatcttgatgtttcttctttgacacaattaacctttaaaagattatatttaaggtttagagtatatatcaaaaggtcaagtttcttggttagagaaacaagaaggaaaattaaacagtagtttgtctccaggtcaaattttttattttacttttctttctgatttatatcctataattgctcatttattcaagtgctcaaggtaacccagagaaagaaattgtttccacatctaagagttatatttaattatacttaagagtttacatttaattcaaacttatagaacaagtaggaggtaaccaggtagaaaaggaaagaaacaataaggcaggacaaaaaaatcatgagcaaaagccaagaagcagaagtaagctgggagcatgaaagcatctcagcatctggaatacagatactgctggtttcttatccaaaatccatccttcatttttgttttactaacagaacttccctaaacacaagtgcctcaatgaaagaattttccagacgctccaacagctacagatggcccaatagtgttagaagtcactggggttggattccagacggttcttaaaagggagctgacttatactcttttcccacttcttcctgacaaaaaacagacaaggcagctggggaccaacagtaatcatggaccataaagcatctttaaaggagaaacccttgctgaggatggtaaaacaaagaatgaacctgagtcattgatgatgttagggtagccatgacagtccctgatagtttataatctagactctgtgtgaaaaatataaggataatcctggcagcaacatgaaggtacaatggaaggcaagagagcacaaagataaggaagcaggttaaatgaatatgatatcataaagggcaaggatgactggcatctgaagtaaagcagaagaggacaaaagaattcaagagacttttcaccaatcgagcaagtagaactagggaggagactgagcatatgtatagagtatgggatagagggggaaggaaagagatgaagagaacgaagaggttttaagatggggcaatgggtagccaccaacaaaacgtaaactaaggctggcagaaaaagagttatttcattttgtaagtttttggtctttttaatgggttgaagattttgtgtgtgttcaatttaattttaatagagtttgagggagcagaatgacaactggcgaagctacatttattttcaaaagctacaagagaatggacagtcaaaaaatattgagaatagagaattagaattaaaagtcagaatacaggaaaaaaaagtcagaatacagctacaaccaaaaaagatggaatgttagaaagaatttttaaaagtcagagcataggggatggctgacatcacgacaatagatatttttccattcatcccgtgcaacatatatatgaacacctaccatatgttagtcactcttctagtcactgggggtacagttaagttccaaataaagatctttatctttagaacttacattctaaaagtagagacagacaattttaaaaactaattaatatgtagtgttaagtcccataaagaaaaaatagtaaggggatactgtgtgacaagacattttagataggtaatcaaggaaggcttgggggagagggtgggccttgcacaaagaacagaaggaatagaatgatgcatctgattatataaatgtgtggaagagaggaattctaagcagaaagggaaatatttgaaaaggccttttggaaataacacttctagcaggttcaggtaacaaaatgatgacttgtaggtgccagaaaaaactgagaaaggtaaagggatgaaaaatgcaattagagaggaagccagtgtccaaaagagtgaagagtttctattttatcctgaatctcacgggaaatctttctgaaggggtagcaaagtgacctgacacatctgactcatgtgtggagaaaagtttagtgggacaaaagtaaaaggagaaagaaaggccaattattagaagactactgtagtggggcagcctgagtggctcagtgctttagtgctgccatcagcccagggcatgatcctggggatctggaatcgaatcccatgtcaggttccctgcatggagcctgcttctccctctgcctgtgtctctgcctctctctcgcgcgcgctctctctctgtgtgtgtgtgtgtgtatgtgtgtgtgtgtgtgtctcatgaataaataaaatcttaaaaagaagaagaagaagacgacaacgacgacgacgacgactaccgtagcttaccagatgagaaatgatgaaggtttggataagggggggaaggtcacagtggaggtgaaagaagtggtcagatttgggaagttttgataatagaacttaaagatttattgatggattagttatgacaaaaatgaaaaatcaaagatgattcaaagggtttttgttttaaaatctgctttgaggtgcacctggatgagttagtccgtttgttaagcggctacattcagctcagatcatgagcttggggtcctgggatcaagccatcaggctccctgcccagcaggcattctgtttcttcctctccctctgcctctcatcctgcttgtgctttctctctctctctctcaaataaataaaatcttaaaaaaaaaaatctgcttcaatacagtaaaatagctacactagctttcttttggttattaattacatgatacatctttttccttcatttactttaaagatgtctgaactctaagatacatttctaaatagtacagagttgggtttggttattatactcagcatggcgatttctgtcttatcatttagtccaatttagattttagggtttttttcatctatgtctgcctcttgaaatcttaacttttaaagactatctcaaaatgctactgtttgtcaagtctttcccaatgccatacatgaccttctgccctgacaattagatatgagctgcccttcctttaaacttcagtggcattttatttgtatcacaatgatcatgttctgctaattattgaaatgaaatgtgaatgtattttttctcccctatttaggacctaaattcttcaaggaaatagactgagtcttagtcatatacctatctaagagactaaataaagtcagctcatttcaatgtcataaacatttacctagtatctattacagaccaaagagtgagctaagtccttactagaggcctgtcttattcaccagtctcctttccacatagtttagcatcctcaactgtaaaatcaagaccaagttttgtcagttcataaaggcaaaaccctgggcatgaagcttaatattctattgttagttagttagttgatacatggttactagttactagataaacagcaggactaccccttttgaatgtcatatcaacctagtatttcatgtgtaaactgtagaattttattaaaagttcctcaaagatgggcaccattatcattctggagtataatcagttgttcaaagtcaacaaagttacatacggaattgacttaaaagatttccttaaagtattttgcagtgatataataagaagagatcattggttttttccgcctggtttctgatattgttatttcctgagtgatgggagtgcgaggaatatcttttattctagtatttggtctttaaccccagtttcttatataagagcttctaagaccttggaaacctctgcagtgtttaagagtatctttctgcatgctaatgaggtgactgatccctaggggcccccatatagctttgagatgggagactgctcaccaaaaagacaaacgcatgattagaaggttgaactttctatcccacctcctatcctcagagctggaaattgagttaatcaccagtggccaaagatttaatccatcatgcccacataacagacccccataaaaaccctaaacaatagagcctggagagctttcaggatggtgaacacatccatgtatgggagacactccaaactacaagaggatagaagctcctgtactcaagacttccagaccttgcccttccagacatcttgtccatttggctgttccagagttctatcatttataataaaccagtaatagtaaagtgttctcttcatcctgtgaaccattccagcaaattattgaacccaaggagggaattgtgagagcccccaatttgtagctgagtcagacagaagctgtaggtaacctgggaatcactccttgtgactggcatcgaagtggaaggcagtcttataggacttagtcctcaacctgtgagatctgggctaagtgggcagctggtgctagaacttaatggtgaggaaaactcacacctttggtgtcagaagtgttctctgggttgaggaaagagcttccctttaatagtcaaggttagttaaccttcctatgcttcccgccccaggaactctaactgcagggactaagtaggacagtggccatctctcagaggtagaaagctaatgaactaagaaagaataaatgtacacagaaagtcaggtagattctaatctaagataacttaataatcattgggttttaatcattcaactttctgaggtacaaattctaagattaaagttaatgaaaagctcaggtagctaactatgatgcatgtggagattttccgtaatactcaatgacaaatttgaacattttttgagaaaaaaattaaatatgtcatttcaagttaggttgttttgactttgttctaaaaaaaaggaaaaattacaacataagcaattacaaagacttaaaagaacagacaaggaaaaatgcttcaactacctcaattttggtaacttagtttgtgctaatagaaatttagtaaatagttgaatgtggagatctattaaatttgtcaggcaaaacaacacaaaaaagcctaactataggattgaaagctgaaccatagcctcaataaaacagtttacaaaataaaataagttctaagctaaagaattttgacagctttttttccttcatgtaccaatttacccaataatctggaactatctttctgcgcttctgtttttttcatataaaaagggcagaaaaattatttttccagtttggaaaaaggtgtgaaacataagtatatttagatactcagccttcagtcacacaattgtcaaatgtttgtcactaataatttagtaacaaaaatgtctttctacctttgcaactgaaattccatagtcctggagaggtgtaacagcctcattcagttcttcaagaaatatagaggttcttggagaatctaaaataagaaaggttttatgaatgttttatggctcgctccttaggaaagacgaatttttaaaattaaagcccaaagctgcaaaccatagatgaaatagattagttcacctaacaagtatacaaaacaaataatacagtaaacatacctatatatatttatacccttatttcctattgcctcattattcttgacatttaagggctcctaggtggctcagtcattaggtgtctgctttctgctcagctcatgatcccagtgtcctgagatcaagtgccatgttgggctccctgctcaatgcaaagctggcttctccctctcctccctggcttgtactcttgctgtcactacctgtctctctctcaaataaatggataaaatctttaaaaaataaagctaacatttggcattatttttccaagtttaataccatgtacacaacacacatgtacacatgcaaaaaactttcaaaatgagtttaaaactttttttatgagcgaaagagaaaacatacatgcaagtgaggggaggggcaatgggagaggaagagaaactcaagcaggctccacacccagcatggagcccatcttggggattgatctcacaaccctaagatcatgacccgagctgaaatcaagagtcccacacttaactgacttagccactcaggcacccctcaaagtgattttaaaaaactatttttcaaaccagagttataagagagtcaacagaaatgtggatttatttcacttactaattccaagaataatattttttttaagggatacaggtttaatgagaccatcacaatctttagttatgttcaatacttacactggttaatcagtataattaatggtacagctacagtagagtattaaacaaaagccttactaatactacatttaaagttttaaaacactttaaaaatatttgttcaccaaaaataccaaaaagcatactttcagaaatgactagatggaaatcagatgttattctactaatcattcattctcatctagtatttattatggacaagtcacatgagtaaattcatttaatcctcacaacaaatttacaaagcaagtattatttcctcattatagatgataaaaacaaagaggctaagtgacttgatcaaaatcacacagtggcacaatccgcatttaaactcaggcagacatattttagtagcagctttatagcacatattaatcctaacaataaatttccactgagaacactgattaaatagcaatagaaacatcacaaaaatcatgtagaatataaaaagtactcaccagcttgacaaaaataagctaaggaagcttttcctggttgcaatgtactgaaatatttctgaggactcagttctgatagagagtctactgctgacttataaaaaatgcacattatgacaaaagagatgccaactctaaatatattgaaactggaagacatcatcagctgtagttgtacagaggcaggagatttttctctgttttgttcagtgttgtggtcctgttgcctaggataatacctaggaagagtaggtgtttaacaaagttttgctgaataaatttgttaaacaaatgaatgaagtaaaatctgcaaaaaataataatataaggcattacttatatatttgatttttgccagtactttcctatttccttctattaaacaattgagagggatatataagatgacattaatttaataatactattgatttttgatacttccaaaagacatgaaggatatctagaaagtacaatacgaaatacttaagtttaaaagatatttactagagtatgttaattgtcatttttaagggttctaaaattaattctcaaacattattcaattcttgttttaaattgggcattttaactttctctacctagaacagatttacaatcaatactcaagtagttatttaataccattaataggggagtgagacatccaaaatctatgtctaccatgtttacatcctttttactttaaattccctagaagatagctattaaaactacttaagaacattccttctaaatatacttttaatacatgacttagacttatttatgcagcttagaaattcaagtatctttatcaaaccatattttaattcaactctatcttctgaactcggatctgttttagatatcctcctctcatcttctttcatgctgtacttacttccatgctatcctctgcatctgttgtcaattcctcgtcttctgtttttgctactttcaaatttctcttgaacaatttcttctttcaggaagtttttctactgatgatctatactacctaagtttaaaagaagatagttggggaaagttagtataaatatatcataattctagaaggtaaagacatacataccagcataggtaagaatttcaatttttaaaaattttaaatagaacccctatctttcaaacaaaagatcacaatcacaaaacagaaaacaaaaaaaatagctaaaaattactcataaggagagggtagactttctcaaagattaaaatgataaaagaataaaaaattaagggaaaattatactaaattggacatttatttcactcttaatcttatcagtaagcatataacatctctcaagaagcaggtattccttaaaaaggaactacttactcattaattacttcttagcattttttttattagagctattttatatcagtgaacaaatgtgccattgatagttaataatgaaccaagagttcaaaaactcaagtagaatgagtgaggactgtgagtatatataaaaaagtcattttaatgatataattaaggggtatcctcaacattaacactgattacacattatagccattttaaaccagtgtgttttatagccactttatactaatgggaacggtttaaaataggtcattcaatattttctttattagggggtaggatgggaaatgcatgcatcctgaggctaagggaataaccatgtaacatttgttactatataaaatagctaaaatgtaatgaaaagataaactttttaaataaaagtgcatttgaacaattccagtataaatataactttgactgggcttctggttacaattcaattatttaacactgaattggacagtagggttaacatatgattcttttaccatatgatgggttttgtagcagcaaaaagtctaactgcatattcagtgctacaatactttcccacacttatctcattggacaaatgaaattatagatgtgaaagtactatgcatttgatcaattagagatgttaatgattattcttacatacatactttcaggtataggaacttattagtaactataacctttgcagtttgttccatctttgataaatttgattatctaaggaattacataaggtagagaagattgcatgggtcagccagaaatagaatttgcatggttgtaataaaataaacactgaataatgatttaaccaaattcaagacaaccacagttcagaggatggagaggcagaaaataagggaacacacagagtgggaaaagagctaaatcttcactttcacaaaaccaaaagccaagtatattagaaataggaagatcaataccaaaagaaacagggagcaattgaaataactgcctctaaggaataagaaattgcaagaggaggataccaagaggacttctgaaattttatatagaatcatctgactctttaaatagtataccttttcatttttatttaaagttaaagtcattctatttggactacatcaaaataaaaagctctgcacagcagaggaaacaaccaacaaagctaaaagacaaactactaaatggaagaagatatttgcaaatgacgtatctgaagaagtgttagtatccaaagcatataaagaacttaacatcaaaaaagcatgcatccaatttaaaaacaggtagaagacatgaatacacatttctccaaagaggacatacagatggctgacaaacacttcaaaatatgctcaacatcactcatcatcagagaaatgcaaatcaaaaccacaaggagatatcacctcacacctgtcagaatagctaaaatcaaaagcttaagaaacaagttttgacaagaatatggagaaaaaggaaccctcatgcactgttggtggaaatgcaaagtgatacagccaccatggaaaacagtatggaggggatccctgggtggctcagcagtttagcacctgccttcagcccagggtgtgatcctggagtcctgggatcaagtcccacatcgggttccctgcatggagcctgcttctccctctgcctcattatctctctctctctctctctctctctctctcatgaataaataaagtctttaaaaaaaaaaacagtatggaagttcccccaaaaattaaaaatataactatgttgtgatccagtaattacactactatttacccaaagaatacaaaaacactaattcaaaaggatttttatacacacttttgttttttgcagaattatttgcaatagccaaattatggaagcagcctaagtgtccatcgctagatacaaggataaataagacatagtatatatgcaatgaaatattattcagccataaaaggaatgaaatcttgccatttgcaacaacgatagatctagagggtataatgctaagtgaaataagtcagagaaagacaaataccatatgatttcaatcaaatgtggaatttaagaaacaaaaccaatgaacaaaggaaaagagagagaaagcaaaaaacaccctcttaactatagagggttaccaaaggaaaagtgggttgagagggataggtgagacagatgaaagggattaagaattaagagtacacttctcttggggcacctggatggctcactctaacttagttttggctcttgtgatctcaggatcctgggattgagccttgcaatgggctccatgttaagcagggaatctgcttaaggattcttcctctccatctccctctgcccctccccaagcttgagtgtacactctctctttctcgctctctcaaataaataaatcttaaaaataacagggtacatttctcttgatgagcactgagtaatatatggaattgctgaatcattgtatcatacacctgaaactaatacaacattgtatgttaactacactggaattacaaatataaataaaaattaaagttattatttgtatgtaatcaaattttccatagtttctactcatattaacccaacctatccctgtagggccacagaagaatgttcatttcacatgcatgaaaaataaaatgcatttgcctagagacatgttgtccatataaaaatattttcaggggcgtctggatggctcagtcagttaagcatctgccttcggctaaggtcatgatcccaaggtcctgggatcaagccccacatcaggctcccttctcttcagggaacctacttctccctctccctttgctgctccgtctgctaatgcttgcttgcttgcttgcttgctctttctctctctctctctctctctctctccccctctctctctgtcaaataaataaataaaatccctaaaagatatatatttaaagagaagggaagtataagtgggaaagggtggagaatgagaacaccagtcagaacagagtaaaaacaaatatacagaaggtactcggtgatttttttccctttggtaagtagaaaatagaataaaaaacaatacttaatgattcaaaatctaaatctcaacaaagagaggagtaccttgggagaaatgtgacctcggtactttggtatagtagtagttcattggtatggggtatatatagttccagttctgctgtagaaggcaggattacacttaacttcctacctcccacttgtagtaaattaattgtggctgccaggtgacttactctggccaataaaatgttagcaaaagtagcatgtctctttcagacaacagtttatcagctagcatgtggtagggcaggccgtattttcttctcacacaggcattaaaattgctcatctggtggctattcctagaatgagcacaacacagagaatggaagacatacaccagtctgatatgcaaggagcatgtaacatgagaggaaatccatctttctgtcataagccactgagatttgagggcttcttatggcagcataatctagtttaccctcactagtatacaaactagaatgaggtgccaccttaacaagaaccccaaaatactggctcagaagccacggagcaagaacttaatcaggacagactggagtttggcaatccacattaaggagtgacaaaacatttggtaaaactgttaaccacaatcatttgaaggtgacatatacctcatgaatttgtaatgagcagttaccccagtgtggtacggctaatgaacttatttatggccctaatagaagaggcttatagataggaggtgaggcaccgaatgatagttgctgttggttatgtttaataaggagttcaaagaaaggtactcaaaggaccactgccatccaagagactaactgtttaaaacttaaacagtcctttagaccccacccttctatcattaggaagcaagctgacaaaactgctcagccatattctccaaagccaacttcaggtgtggccaaggataataaacatggaaggacgtcttgcagagtaatgccaaggaccatggagaactatgccctagggcatgtgccagaatacgaactgtttgttactggtccaaaataatcagataaacacagaaattgagtgtaaatgtcaaaaatctattatagctcattttacatggtaattttctgtctgttgaatctaaaaattttttaattgggtttatcatttgttatgtgttttcattccatttttattataattcatttttactgtaacaaaattcaaatttagattttgaatcattaaaaaaaaacaatatctggtcattcatgacagtttgagaagcactgacctacagaacacagtgaacagaacaggagccctagcaatacctgcccagtgagatttcaaaactcctacagactagagtctgtgtatagtcttccattcttcccctctccaaatgggtacacttattatagttatttgtccctacactactctatgtattcaactgggggtgggagacagagaacttataatgtccagactgataagagattagcactactggacattaatcagaaatcctggactttgagtctgacacagtgactggatgagatttgggggttatgtctactgggaagggccaacaatgaactatatgcaaggagagtatcggttcacaaaaagggtggactgtttaaatgtttctagttctccacacctgttaaaattgtacttccccacttccttgaatttggtatagccatgacttgactgacttgacatttcatgacaatgaaatgcgtgatgacacatgttacttccaagagttttcaaagtcgacatattttcatgcctcgcaacacacttcctttctgctgtgatgaatgataacactcaaaataaagccttctctgttgaaccaagtctcagaaaaagaacaacatggggaaaaactcccggctaatcaagagtgaacataaattaaacactgttgtgttaaacctcttaaagtttcagggttgttattacagtataacccagcctagccttactggttttaataacagccaagaggagagtgacttgaacataaatacatatactggatttttaaagcactaaatatcaaagaattaacaggaaactgactcaatttcactgtaggacaattctaaaagggaagagaactcttgcaaatgcaactgactataaccacaacaggtgccgacaccaaaatagggaagtcataggcaaatgtcttccaatactacacacatacatcacccaactacatgcagactcatactgagcctggagagggctctcaacttgttggtataatgctccttgtcagcactaatagagttggtatgcaagatgtaacttttgccttatccctaaactctaaacaagaatgcctgcacagttcatttaaaagttgataggggcagggcgcctcggtggcccagtggttgagtatctgcctttggctcaggtagtgatcccaggaaggatccagtcctgcagcaggctccctgtagaggagcctgctctccctgtagagagcttctctctctgcctatgtctctgcctctctcactctgtgtgtttctcatgaataaataaaatcttaaaaaaaaaaatagttggtaggggcaccaactgagggtagctcagtcggttaaatatctgactcttgatcttaggtcttgatctcagggtaatgagtttaagctccacattgggctccatgcttggcgtggagactacttaaaaaaaaaaaaaaaggaaaagatgtgtgacatttaactaagggcaaatacaagagggtgacaaacactgggaattggaacaatgaggctatagtacaaaaagagttaaagcttgcaaattaaagactaaataaaatgcaacaaaattctggagcacctgggtggcttagttggttaagtgtccgactcttgatctcagctcaggtcttgatgtcagggttgtgagtttggccctacattaggctccatgccccgtggggagcctacttaaaaaaataaacaaataactaaataaaggcaacaaaattttgttcagcaccaaaatactgagggtccccagagggcaatgaggagaaagaattttcaacagaaaaacatttatcttccagctagtgaggggagagggaaggatctgccttcatgtgttccacagctggaggagctggtaactctctacagttagaacaatctcatttggggcttgggtcctatttataatatcacttggcaaacagctcttctacttttaaatgtttggaagaccagtgtgctagagtaatgtaccctcctagaacaatattcaaccattgtgcatttggacacatttcaaattttagaataccaagcagcaagcttttctagaagaccttggttagtttcctctttatagacttaaatttcccttacaattaaccacaaaactaaaagttttccctctcaagaaaaaagaggaaatgaacaactgtaaacattaagcaaattatagcaaactctgtgggcatcgttctctgggaaaaggcacatttcatattttgcaacaaatggggcatataatgcttacgaacgtcctgtaagaacattctggcaaaaattagcttacagtttaatgctgctactggagaaaacctgctcactgaaccagtttcaaataaaatgttgattagatatcatcaaagtttatcatttaagtctggatggaggcaataaaaggagtcaacatctctctacttcaaagccccttcaaggcaatggagcaaaatcctctatctgtatccctcatgccccccctcaaaaaaagaaggggaagagcgatagctatctggacttgctctgaaatgaaaaatttcacaagcaaagacctaaaactagtatggatactctccagatgttgtttactatgagtagagaatataggagaaaaagaaaaaccagtttatggtaaaaatctattcgtgaaatgaaacaagtacctcatcattatggaaaatacaaaaataggcatgtcaggaaacaggaggttcccctgattttgatgagtgccaaaaatcacagaactccgagttcatgcttaagcacgtaactgcttaactcactttaactcactgctgccacgagcactcactccatcccttttcaaaaagaaatgtgtactgccctaaccacattctctaaaaaatctatgaggtaaatctcataaatttcaaaaaaaaaaaaaaaagtgattcttctttgttaatgttggatcagagccatgaacttctttcagaaagttgtaccctgctctaggctgcactgtacaacctgctcagctgaatgtttcatctgagagatccacgcaactgtgccaggcctaaacatcacattttgtcactatacctgtaaagaacccaaaacacaccagtatctgacagggggaccactgtcccagaatctggagtacagagtagactttaaagttccctatggatcacttagctaggaaaaaagacagcaaaactcttcctacacaaagcattaggcaaaggatggcaagttagggaaggctgtcttggttgcaccagtaaatgtagcagtatctttcaaaaggatacggactttgtgatgtgccactcattctaagaacacagatggttttctcatcatttttcgttacttcgctcattttattaccaaacacttaaaaaggaaacaaatcagcaaatgtcgtcggtccaatacacgctggaagatctattcctcacttatttacagcaatagcataatatagcatttgttttgtacctctcggagccccaggaagggcgccaccatccaccaatacaggaccaaggcttgaaggaatacatgtggaatttaaggagtacaaactgttctgcttctttctccctagacattcctcaggcttacagttcttttttccctaaacttatgcccagggcatccttccaaattctaagtttcaaagacccacattcctcctctttacatctcatctggacatccatctcatcctaataccgcctcgtcctctaagagagatttccccaaggaagaattttgcttaaggtgtcagttcatccttctctctaagagaggatgctctctccctcacgtttttctcgccctctcaggctgggggggggggggggggggaccctgaagacgaagaagaagaagaaagcctaatgcccctcaaaaaatgcaggtgaggccccttttaacccaaactccaaaattcactggcggggcacagccgccagggtgaatccccatccctgcaggcagaaaccacagcccctcgactgaaggacccgcgcggccacctacctgcccaagacctgcgggcaagatctagtcagaggaagccagaaggttcccgcggccgacggttcccgcctcgcgaaggagaagcagaaggcggggccgagtctcgccggagggtagcggcgagcagccgcgcctacctgctagggcgcagcactcccgccctccgcgcccgcggccaccaccgcacagcggggtcggcctgcgagcgaaaaaacaaccccgaggctccgccttctcctcgtgctccctacgtgcggcctctccagccaatgggaagcgcagggggcggagcgagagccgccccagctgacgggcgaccaccgagtcctcccgccggcgcgagcgggccgtgcagttgctgggccaatcggcagtgtgggtgggaagtgaaggggagggagaaagtgaggcaagcggctgtccaatcagatccggcagccttcgagcgacaggtcccgtggcccgtggccttccgagcgcggcgcgcagggggcgtgcccgcccgggccaatcggcgcgagcccacggtgcggagcgagcgcctcaaatgctcgggtttctcagctgattgtctccagccgagagttgttttttgcagctaccgagccgagccgcagcaggaggagccgagacccccggggggggcggggagaggaggcggggtccggggagccgcggctgctctgcgcggggctccgggtcctgtcacggcgcttcctggggtcggaggttggggtgggtggggggtaagggggaaatctttctccccctcgacggcggctccgagtccggccccttccttcccgcgctctctcgtccggcccccagccccctcatgagggtgtccgtgccgggtccggcggccggccgcgagccctcgacgcccgggggcggaggcggaggcggaggcgccgtcgctgctgcctcaggcgccgcggtgccgggctcggtgcagttggcgctgagcatcctgcacgccctgctctacgccgcgctcttcgcctttgcctacctgcagctgtggcggctgctcctgtaccgggagcggcggctgagttaccagagcctctgcctcttcctctgtctcctgtgggcagcgctcaggaccaccctcttctccgccgccttctcgctcagcggctccctgcccctgctccggccgcccgctcacctgcacttcttcccccactggctgctctactgcttcccctcctgtctccagttctccacgctctgtctcctcaacctctacctggcggaggtaaggcgggaggaccggcaagcggggccgggcgggtgagcggggctgccgcgatcaactcgggctgaggaccgggaagggggcggggggggggggagggggccggctatgaggcggacctgagagcagcttggggaaactgaggcacgcctggagtgtgcgcgcgtatgctcgccctaaacttaagcggtagattgactcggtttttgagaggctggcggggttgggtgagtgagagtgcgggctctgacaacttacgacaggacaaccctttgttcggtgttttggccccccaaggtaaggtgttggtggcagcaacaaagtggcatcgcaagaagtagcagccccggtagctctgctgaagctgaactgtgttgagagaggttggatgctgaggtagcagcagctctgctgaagctggactgctgccagccattacgtcaccaggcagagctgttcctctgctattgttgctgcgtttcttttattagaagcttatattccctcctgcatctcctttcctgtggctcgataagcctcacacagattccgttcgatagttccccagcagggttaatgatcgataaccaaagccgagggtcagtataaagacctccataaagctcttaatgtttgccccacttgctccaagctttagctatttatcctacctcttacagcctagtggtttttttttttttttttttttttttttggagctaattaagatagaaaatactagcttaacctgtgactattgcagaaacaaaccaccaaactgtttttgcaataacttgcttaatagctggaacctaatcacaccccctttctcttttatggggaattgctggctggattgcattgttctgcagcgcttaggtatttgacccatttcaaacaggtttgagagtgtaaggttgtcaatcatgtgtgtcagctagtggtatttaagccacagaattttgagaattgcccaaaactctcccttccccctcccccaccaaaaaaaaaaaaaagctgaggaggggaggaaacaaggtgacatcatatgcttaatactgactaatatagagcaatattggtctatgcagctaatcctctcaaaggcttttggaggtgatgagaattaacatagttctgagcaaaagtaaaaaaacatttgaggcagattgtttatatttcctgtgtaaaccaactcttttctcccataatagatggaaagtaggatgcataattttaaaattacagtcataacttcagctttttaccacattaaaaacaatacttgaaaataagtaacaaaactaatttaacttgaattcttttccttccccatcctttggaagtccaagcaatacaatgacaaaacccagtgaaaagcaaaaataaaaaacacgggtaatcataaatcaaataatcatgccatagtcacgtcacttatttgatgatgctctcatcttctagttgctgtttaagctgttataacatttctgtccttcctagttaaattgatacattgtattcttcctgacaccatttttgatagaataccagtgacctcttattactgaagctgtaactctagcttcagatataatttacctgaaagtgctagcaatccttatgtcataagcatcagataatttgtttttccctatacattttgacttgtaaaatcatattaatgatgtctcgtaaaataccatttcataaagtagctaaacactcttttttactttttttgagaatacaacatatgccatagagagcataaatcttaaggatgcagctatgaaattctacatatacatacactcatgttatcatcccctggattaagataaacataatttctggtgcccttgtgccctctcccagtcatcctctcaccctgaggtaattataaagtggctagaaactatcacaatagaaaaagcatccatagttaagctaaaaattctaaaagtatgcttctacaggataaactacatgatacccagattaggttttcatattttagttgctgatattccaagagaagaacttaaatgtcttaaagtcttcctattaaatgaatcttttgtgtgatgtagtttttcaaaaagcaataaaactcaataaacctagaaaatataatttggaaagacgatagactaaagcattttccttttgcagtgtctcctaaaaagagtgtagattgtctatgctcgtctttttataatcaaattaacaattttaagattcataactgtacttaaaagaacaaaatttcaaatgtttaaagagagatatcttgaccagaaatcatttccctattcattagaaaaaatccagaggaatctgtatttaaaagaatatttgaactcaaatttttatatcaattccaagtaactggaagtatactttctattgatctgatttaatgaagctttttttcagtaagttcttggtattatagaagtatgtagggagaatctggtgagaaataacaaaactgacacttgattttttttgttttttggtttttggtttttttgtttggtttttttactaaaaggccctatatctgttttgaatagttgtgcttcttgattgctaaatcactctgtatttactatctatcattaaataccaatttcaatttgcttttggcctcttttaagcgttgcttgcatgcatttctcaagattagaaacattctaactttaaggacttagttacaaagaactatggagcagaataaaaataaagttagaaaaacaaccattacactttgaatgcattttggtggttcttctaaaactccttaagttttcaaagagttaagactgcctaaatcacttacttttgttgactacacttgagtggaattgagataaggagaagtagcccttctaaagtaattagacttctcaatctcctagaacagatacttggggggcggcggtggggggttgggtggacaacaaaacccactatacagtaatctaaaaacacctactgaactttttctggcatgatcaatagaacgtgtactttaccagagaaaggtttacagtcctgtacttttaccagggaaggcttaagtctttaaaacagattatgtgagaaaattgatgctacgtactaccggaagaagtaaaaaggcttaagatgagagttggagtattgttatatatgccaaaatcaatgagttcatcgtcaaggcccacattgacattttttcttacagttttgtaacatgaatgccagttgcttgattggaataaatatggtgatttaatcatgatgccaaaacagctaggaaaattaaattcagaatcttaactcttacgctcatagatgctatcattgtctctgacaatgaataccttcttccaaatattgataatatgtcaaatattacgtgtagattaactgacatgtagttaggtgtcattataatgttctgcgatttctcacaaaagtgtttttaccacctaacatggaaactccttaaggataatttatttttacctcatagcagctagaacaatggtgaatatattatcgaatgacatttttgagaaggccaaatctcgaaaatatttagccacctgaaatttgggggttaacttgattttgatgaacatttcaggtaaattatttgtgtacttcctgggatctttattttctgcctaaaagattgcctattgctgagattctcttagattatcatggtttaattagataaaagttaattttgattaccgcaggtaaaatattactaatgaaaaccacttgaatatatttgagttttgcttagcaatactatttttacatcatggcaaatggcccattttaattaggtctttgctaatttggcttcaaattctattaaatagagaagtctgtaaaataagtttcacatcatgagtgagttatttgctggaaatagtgatttagttcagtgttggattttataacacttgtcttcacaatacttatgatatagatagatacaaacagggtgatttgtccaaggttatactactaacatgtatcagatataaggctaccatatagccaaaggttataacatcttatcaaatgatccatccttatgaactttcctggataccatcaactctttattagtgctttacttttaatttacttccccccattttaaacctttcctctccagcaaactttcttccctcttcattctcaggatatgacccttaacttctagtttataaaagaaactagggccatctggctgaacaaagattcagaaagataccttaaaatgctgcagagtatttaatttttttcaatgaatgagctgaaagtgaggaaattcttcagaggcaagaaaacacacacaagaagtgaatgcagaatgataaagtaacacagatgtttgtcttggggttaggagtggttattggctgctttctgctggcttaaagcctggattttaattttatgcattgggggtctgagaaggtgacattgagggcaataccttatggtgaggtctaatcagagactttgttccctccatcttaatcccagaattctcaaagtatttatcttcggtggatgggctaggaaaaataagcagattctcaaaggttgatgatgggctttgtgcttatctctgccttggttttgggtgaaggaggtacaaattgggaaagaaaagtcttccctgagaatgcacaagtttattctcacaaaagtttgaaacctgaattaacaccacttctgtgaccttggaggaaaaaattaataaaacccaacctgaaaatgtagtttagaggtatccaggcttggtagtaacctcaagaacctggaaggagcaaattcaaatcattcgttgagtataatttaaatacagaatcctgacagataaaatttcacagaacatgagctcaaagtgaaaaattacagaatctacctacaaggtttaaagatattacagtgatcaaatacatagtataaaatattcattcatgtgaacttaagtaaacagtattgacatgatttttaaaagttaactaggcacatttggaaataaatcatttttagattaaaaatataattaaaaacaaatgagtggttaaacaacagattaaacaattaaaaagaaattagtgggggcacctagtttgaacatctgactcttggttttgactccggtcatgatcttagtgtcatgtgattgggctccacgtgcagctcagagtctgcttggccttctctccctttccctctgccttgccccctgctcacgtgccatctctcttgctccctctctaaaataaataaaatctttaaaaaaaaaaaaagtgaagatctgagaaaaaatcacctcaaatataccccagaaaataaataaaaaatatgaaaaaaaaggattaaggaagaatgaaaataaacagatccaatatatatctaactgaaatttcagagaaattgttcaaaagaataatgatttagagtttgcccaaacttacgaaagacaccaagtttcacagtaagaaagccccaaaaattcaagacagactaaacgaaagtgaacagagagtaaaatttgaaaataacaatgacagcatattttttaaacaagtagaattaaaataaaaaacacaagaaacaagtgttggtgaggatgtggagaaaaaggaacccttatgcactgttggtgggaatataaactggtgcagcaactgtggaaaacagtatggagatgcctcaaaaaattaaaaatagaactgtcataaccagtaaccttaccactgggtatttactcaaagaatacaaaaatattaattcaaaaaaatatatgcattcctatgtttatttgcaacattatttataatagccaatacatggaaacagctcgtgtccctcaataggtgaatggagaaagaaaatgttgtgtatatataaaatagaatattattcagcattaaaaaaacaaatcttgtcatttgcagcaacatggatggatctagaggtataatgctgagtgaaataagctgagtgaaagacaaataccatatgatttcacacatgtggaatctaagaaacaaaacgaatgaacaaagggaaaaaagagacaaaccaagaaacagattctttactatacaaaactaatggttaccagaaggaagtgcatgaaggaatgggtgaactaggtgaggggattaagagtacatttatcacgatgagtactgagtaatatataaaattcctgaaccattatattgtacaactgagactaatagaaccctattaactatactggaattcaagtaaaattaaaaacatattatctattaaaaaactttaaaaaaaactagacggagaagatattacaaaggaagagaattagtttgagggttgacatttcattaacaacaaaaaaaattcaggacacagtgaaaccatcaaaatgctgaaagagagaaaccagcaacatgaaattccacccacaatgaaactatcaacaataagggtgaaataaaagccttgccaggaggaacatcagcaagatggtggaataggatgccacggaccctccttccccctacaaacataccaatttggcaataattcataaatctcctttgtaagaaatccagaaactaattgaaaggcttctgtcccctaggtgaaaacaaaatgacaatcaccaaaatgagtaaggaaaccagtccctgaccctagtgcaataccgtataacgcttcttttcagaggagggaaggtgtttgttcattcatctagcagcctaagttttcccaagtgattccccagatgtcaagcttctgtctgtccagccttggagctctgatgggtccaatgtggtctaaccacctagaggaaaacaaagacagcaatttaaactagtaggagatacagctcccctcccaaatttcagcacagaccaaaccagaactatagcttcctttattgccttcgggaggaagagttggtagtggcccccagaatctctggacaagctgaatggtgagagtcttctatataaagacagtctctgaagactgaaagaggtgactgttttgtctgttgcatagacaccaacagagaaagtgaagaaaaatgaataatcaggcaaagatgttccaatgcaagattaagtcttcagaaatcctaaagtgttacatgatttgcttgatagagaactcaaaataactgctataaagatgctgaggtcaagagaaaaaagcatgaacaaattcaacaaagcatgagaatttcaaaagagaaaatattttaaaagtgtgagagagacgcctgggtggcttagcggtttggcgcctgcctttggcccagagtgtggtcctggggacccgagatcaggtcacgcatcaggctccctgcatggaatctccttctccctctgcctgtgtctctgcctctgtctctctgtgtctctttttttttttttgaaaaaaattttagattttacttatttatccatgagagacagaggcagagacacaggcagagggagaaggagattccatgcacagaacctgacgtggactcaatcccaaggctccaggatcacaccctgggccgaaggcaagagctaaactgctgagccacccagggatcccctaaaaatcttttaaaaattaaaaagtataaagtatcagggatccctggatggctcagctgtttggcacctccctttggcccagggcatgatcctgaggtcccaggatcaagtcctgcattggactcccagcatggagcctgcttttccctctgcctgtgtctctgcctctctgtctctctgtctctcatgaataaataaataaaatctttttaagaaaatataaagtaaaaaaaaaataaaaatatgaaacaaatcatggagctgaaaataacaaagtctgatgtgaaaaattcatttgaggggttcatcagcagactagatcaaatggaagcaaggatcaatgaactcaaagacaagtcactggaaataatttagaagagcaaaatgaaaatagaatgaaaaaaatgaacaaagctaaagacttatggtacactatcaaacagaccaatatatatacactgagtcccagatggggaagagagaaaggaccagaaagcttattcaaagaaatggctgcaaacttcccaaatctggggtagaaagtggacatccagatccaagaagacaaaaaattattaaaaagaggaatccaaagaaattcacaccaagaaaaattataatcaacttgtcaaaagtcaagatgatttttgaaagaaaagagaaaaatagagacttatcacatacaagggaatccctataggaccataagcagatttttcagcagtcttacaggccagaaaaaagtgggatgacctaattcaaagtgccaaaagacccaccatttgcttcaacatggatggaactgagtgaaataagtcaatcagagaaggacaaacattatatggtctcagtcatttggggaatataaaaaagagtgaaagaataaagggaaaaggagagaaaatgagtgaaaatatcaatgagggtgacagaacatgagagactcctaaatctgggaaacaaacaagggatagtggaaagggaggtgggtggggggttggggtgactgagtgatgggcaatgaggggggacacttgacgggagcactgggtgatatgctatatgttgacaaattgaactccaattaaaaaaaaatttaagtgccaaaagaaaaatactgccaaccaagaataaaatgtttttgcaaaactatccttcaaaagtgagaaaataatgacttttacagataaaggctgaaggagttcatcaccactagatctgccttacaaaaagatgctgaaaaatatcacaatagcttaagtatgaaactcttggtaaagttaaatatatagacaaatacagaatactgtttcattatgtttttattaaatcacttttgattccagtataaatgtttagaaaatagtattaaaataacagttaaaatgttaaaagatacacaaaataaatagatacaaattgtgccaacgaaaaatgttaaaggggagaagttaaagtgtagagttttatatataattgaacttaagttattatagcctcaaacttactagatatttttttgtccactccaaggtaactacacacacatgcacacataaaaacatatagaagttatacaatagaaaaaggaaaaggaatcaaagcataccaatacaaaaaaatcaacaaatcacaaaagagggcagcaagtgatgaaaaggcaacaaagaatgacaagactaacaaaaatatcaacaaattgcagaagtaaatccttccttattaataattactttgactgtaaacgaataatgggcacctgggtggctcaagagttaagtatgtgactcttgatttcagctcaggatcatgagatcaagctctgtattgggctccatgctcagcagtgagtctgcttgagattctctccctctccttctgctccacacacacatatacacacacacacacacacacacacaaataaataaataaaatgaattaaactccccaaactacttagagttgctaaatggattgaaaaaaaaaataaaagactcaactacaccctctacaaaaagctcactttaggtttaggtatatgcatagactgaaagtaagtgaagagatagaaaaaaatattccatgcaaatagtaaccaaaagagagcagtggtggctatacttagacaaaataggcttttagtcaaaatctgtcataagcagaaaaagccattatatattaataaaagggtcaatccaccaggaagatagaacaattatatctatactcaacttcaaaagacctaaacatacaaagcaaatattgaccaaactgaaggaagaaatagacagtaataccataatagaaacttcaataccccattttcaataacggatagaatatccaggcagacgatcaaaaaggatcaaagcacttaagttaacactttataccaaatgggcctaacagacatatacagaacattttacccaataacagaatacacactcttctcaaccacatatagttctttctccagggtaggtgacatattaaatcacaaaataagtctgagctaatttaacaagattgaaatcatactgaacatcttttctgatcataatgaaattaaactaggaattgataagatacttaaaactggaaaattcacagctatgtggaaattaaatagcacactcttgaacagccattgggtcaaagaaggaaataataaaatatcctgtgacaaaggaaaatatatcaaaaattatgtgaacaaaagtagtactaagaagtccgtaactataaatgcctacattatcaaagaaaaaagatctcagataagcagcctaactttaaacctcaaggagctacaaaatgaaacaaaacaaactaagcccaaagttagaagaaagaaggaaataacaaagatcagagtagaaatagagaatagaaaaacaatggaaaaagtcaatgaaacagtttttttaagatttaaaaatctttgacaaactcttagctagaccaataaaaaaagaaaattagcaagagacattacaactgatgccacataaataaaaaggatcataaaagactgctatgaacaagtaagtatacaccaacaaaatggatagatttctggaaatgcacaacttaccaagactgaatcataaagaaacagaaaatatgaaaagacctatatgtgatatggagagtgaatcaataatcaaaaatctcccaatagagcaaaatttagactaagatgatttcactggagaactacaccaaacatttaaggaagaattagtaccattttttctcaaacacttccaaaagaaaattgaaaggatacttcctaactcattttatgggtccagcatcaccctgagaccaaagccagatgaagacaatgcaagaaaagaaacctggaggctaatatcctaataaatatagatgcaaaaatatgagtaaattgaatccaatcatacaataaaaggatgatacacaaagtaggatttatctctggcatgcaaaaatggttcaacataggaaaatcaattactgtgatacaccacgttaacagaataaaggataaacatcatgtggtcctttcaataaatacagaaaagtatttgacaaaatttaacatttttttgtgatagaaactctcaacaaagtaggaataaaaggaaattacctcgacataataaaggccatatgtaaaatgctacaagtaacatcatttttatttatattttttacatcatttttatatatcttcagatattgcctaatttcccttttgtttttgtttttttgacccaaccattgttcaagagtgtgttgtgtaatttccacatagttgtgaattttccattttcatttctgctgttgaaaaatataagcaacataaaaacttaagtatataaaatataagggaatacaaaaagtcatcattcattgaatacaactcccaataacagggtacactttctttttattgacacatggaatatttttagaaattggtacaacctagaacattaaagcaacattacaagttagagatggtgagacagtgattaagagtgcatctagggggatccctgggtggctcagcagtttagcaactgccttcggcccagggcatgatcccggagtcccgggatcgagttccacatcgggctccttgcatggagcctgcttcttcctctgcctgtgtctctgcctctctctctctctctctctctctttctctctttctctctttctctctctctgtctctcatgaataaataaataaaatctttaaaaaaaaaaaaagtgcatctcaacacttaccagctagctgtgcctatgctccatctccataaatgggtagtaatgtctatcctatagggttgctatgaggactaaatgatatcaaattcagaaaaagtaattatgaaaaataactacaaatatctctcatgaacatagatgcaaaataccatagcaaatcaaatccaaaaatatacataaaagataacatatcctgaccaaattttatccccagaatgtaacattggcttaacatttaaaaatcaaatttaatttaataaaccttattgacagtgtaaaggagaaaatcatattatctcaatagatacagaagagaatttgacaaaattcaacaaccgtgattttttaaaactcaacttttagcaaactagggaaaaggagaaactcctcaatctaacaaaaaacatccacaataaacctacagccaacattatacttaataacgaaagattaaaagattactcccacacctggctggcttaggtctagagcatgcaactcttgatctcgggatcatgagtttgagccccatattgtttgtgaagattactttttaaaaaaaggagaacgattactccctaggacaagaagaaggtaacttcacttgtcctagccattatgctggagatcctagccattgcaataggtaaggaaaaaaaaaaaaagacatacaaattataatgataggggcaccttggtggctcagtcagttaagcatctgcctttggcataggtcatgatccagagttctggaaccaagccctgtggcaggctccctgctgagtagggagtctgcttctccctctgcccctctccctgctcatgctctttctctctcaaataaataaaatgttttttaaaaatcacaaagacagaaaccaaaaaaaaaaaaacaaaacccacaaataatctaatttaaaaatggcagaatacatagagacatttctccaaagaagacatacagatggccaacatacacatgaaaagatgctcaacatcactgatcatcagggaaatgcaaaacaaaaccacaatgagatatcacctcccacctgtcaaaatgggtaaaatcaaaaacataagaattgtttttttttaaatattttttctttatttatttatgatagtcacacacagagagagagagagagagaggcagggacacaggcagagggagaagcaggctccatgcaccaggagcccgaagcgggattcgatccccggtctccaggatcgcaccctgggccaaaggcaggcgccaaaccgctgcgccacccagggatccccagaaataagtattgttaaggatgcagagaaaaagaacccttgtgcaccattggtaggaatgcgaatagtgcagccactgtggaaaacagtatggagcttcttcaaattaaaaatagaactaccatataatccactcctaggtatttacccaaaaaatacgaaagaatactgggtatttacccaaaaaatataaaagaatacaaaaccactaatttgaaaagataaatgaacccttgtgtttatcgcattatttataatagccaagacatggaaatagcccaagagtccatcaactgacgaatggataagatgattgatgaatggataaaaaaagattttatatatatattccattgtgtgtcttacccataaaaagaaagaagtcttgccatttgcaacaacatggatggatctagagggtataatgctaagtaaagtatgccaaagtaagacaaaatatatgatttcactcatatgtagaatttaagaaaaaaaaaaaaaagagaaaccaaagagaacagactattatagagaacaaactgatggttaccagagggtgagtgtggggggtgagggatgagtgaactaggtgaaggagttttagagtacacttaaacaatgatgagcactaagtaatgtatagaattattaaatcactatattgtacacctgaaactaatatatccttgtatattacctatactaaggttaaaaaaaaatttttaattagaagaaaaggagcaaaactctccagttgtaggtaacatgattatttagatttttaaaaaatcctaataaatcaacaaaaagttgtaactaataaatgaatttaagaagcttgcagtatatgactattttatatactagcagaaaacaattggaaaatgaaattaaaattccattaacaatagtgccccccaaattaaaatacttaggaataaatgtaataatagatgtgcaagtcctctacaatgaaaactaaaagctactgagagaaattaaagaaggcctaataaatggcaagatataccctggaaagttcattatttttaagatgtcacttgtcctccaaattgacctatatatacaatgcaatccccattaaaatatcagcaggaatttttggtagcagttgccaagatgatttaaaaatgtatacgggggtgcctgggtgactcaatcacttaagcatctgccatcagttcagattatgatctcagggtcctgggattgaaccctgagccctccatcaggctccctgctcagcagggagctggcttctccctctccctctgctcctcccccaccctcacccccactcatgcagtctctctctctcaagtaaataaataaaatctttttaaaaatgtatgtggaaacacaaaggacttataaatgaaacaattctgaaaaagaagttggagaagcatattacctgattataagacttactgtaaggctacagtaatcaagacattgtaatagtgggcaaaaatagacatatagataatagagcagaataaatcaaagtcagatatttatttatttacttacttacttatttacttacttgatttttttttaccgtgttgttccaggttcattttatactactgtgttcctccttatccctcaccactccaaccatacttagcattctttcagttctttgtatatttccttctacccccaaacctttccatattcttttccctcttcttggaatattatttcctttgcttagttaaccctcagctccagagtgacatttcttcaggaaagatttcacccaactatccaaccagattagattccaaaattatagactctcagagcactatgctcctttccttcatatcattcacacgtttgcaactttgtatttgtgtgatttatgtggggagtttactgaactgtgtaagcattatagaaatagggaccaaatctgttcatgctatatccctagtagctaagttaatacctggcatgtattaggtgtttaataaatattcattgagtgaatgaaaccattgttcaccataccttaaatattctggggtaaaggaatccctgaatatataatttcacaacagaactttctctacccatgttttcttttttatattttcctttatctacctcctcatctcaaaaagaacatttgctttaaaacagaggtacctaattcaaatgcctagagaatcctggacactaccctttgagagataacaggatggtaggtgagtgtagtcaactagacagctcatatctaaagagaacagccacattaattcaggtccagctgtgagctggcattgcaaaatcatcatgagaaatcaaaattttgaatttatttatttatttttaaacattttttttttgagagaaagaaagtgagagacagagcacaagtagggagagaggcagagggagaagcagactccctgctgagcaggaagcccaccacagggctcaatcccggggctccaagatcatgacctgagccaaaggcagatgcttaaccaactgagccacataggcacccagaagtttggatttttttttaatgggaaatctactttttaataatgacagagtattgaagtattgttcaaaataccacagactaacactggataagtcaaacaaaacattttttttaagagtaagtctttttttattattttgtttatttatttgtgaaagacctagagaggcagagacataggcagagggagaagcaggttcttcacagggagcctgatgtgggactcaatcccaggtcctgggatcatgccctgagctgaaggcagatgctcaaccactgagccacccaggcatccccaaacaaaacatttcgtaggtaaaacccaacccatgggctactaatttgtattttcttctccccattttacttctgtgttatcttgcttaaaggaacaaaacaagtcagcacaatcttgtctttataatttccatgtaacaaagctgaattatagttaatactcattaacattagttaaaatgaactgaataatttgcacttttacttaagggaaatttacagtgttctgagtctgactaaatataaagaaagtaccacatatcacatgacataccattgatgtctgcctccctccactacactatatattatttaggtcagccactattgtacatatattttgaaggaaattttgcatgtgcttaagcgtctaatactgttatgtatgtgatcaatgcattgatttggacagttgaacaaattcacggaacttaaatgttttcttctatcttcacaagaaaatcagaatctctaactcagcaaagtataagttttcatctaatttgttttaaataaagacaaacttttataaatcaagtgtccttgttatcttctaattttaactttgtttagagatctgtttaaagtagtgtaactttagtagccctgaactagaagtctgatcatctgagttctagtccaaagtctgttttacttgactaattgatgtttaccaaatcgctactcttctgggccatttgtttaatttgtaaagtgattagtctccttgatatccaagacatctttaattctaatagtctgacattaataaagcaatctagaatttaagggttttatttttttaatattttatttatttatttcagagagagaatgtgggggggtggaggaagaaggagaagcaaactccccactgagcagagagcccaatgtagggctcaatcctaggaccccgggatcataacctgagctgaagacagatgcttaaccaactaagccacccagacgcccttggaatttgagggttttaaaaaagaaaaactgttcttaccttatgacctagttctaagatttaatacagtgtgaattgtgagttctgagttgtgaatacactgtgaattctgtgtgatatgaatgtcaattttattttttaaaagattatttattttagagagagagagcacatgagcagtaggggcagagggggagagagaatctcaagcagactttgcgctgagtgtggagcccactgtagggcttgatctcaagatcctgaagtcatgacctgagccaaaaccaagagtcagatgattaaccaactgcatctcccaggagtctcatgaatgccaattttaaaaagttatacctatcatgttaaaactaatcaaagtttggtttgtttaggacataagtaaacatttagaattacttgctttctaaaataagctccggctggatacttcaaatatatgtgttacaattttttacaaaaactcagttatagaatgcctgggtggttgagtgtctgctttcagctcagggtggggtcccaggatggagtcccacgtcaggctccctgagtggagcctgcttctccctctgcctatgtctctgcctctctctctctctgtatctctcatgaataaataaataaaatcttaaaaaaaaaaaaaactcagttataggtgccatttttaatagcacattgagcacactctagaattttttttcagcttcagtctcagggtaaaaatgcttaagtaggggcacctgggtggctcaatcagttaaacatccaactcttgatttctgctcaggtcatgatctcagggttgtgagattgagcagaggtcagctctgagctgggtgtagagcctgcctaagatgctctctctctgtatccctctgtcccctctctctgtttccctctgtccctctccccttcccactctattaaaaaaaaaatgttaagtaacattttcttaaacttttttgctctttccttcagttattgtataggactttattcaattgctaatggaaacacttgggctaatttgaggtgattcgatgtcctctggggaacttttctgtcataccatggaattagaaagtgttaagctaatgtaattacgttatgttcaaactgattttgttcaaactgttgctgcttttaacaaaatcaagatgaaaagaaagtaagcgcagtgttccttctgttccttcctttcctaggttattctattgcttcttctgatatattctgcctattttttctccaccattatcagtcagaccaatattctccaatgaatctggctctatttttctatcttttcaaaaagcaatctgctatcttcctagttcaaaaagcatgaaaggctttatgaaaaatcagtaatatacaatgggggatttggtattagaaaaacctttttaaaggataaaacagtttcaacacaaattcaatttaaatcagtttcctaagaagtctaaatctataatgagtgagactctcagttcagaaatagattctgtatattccttaacataaaatatgttaaattatcttcaaaaagctgtctatactaaactaatgaagagtccatagtaatctattatatttcagggtgattcttgataatgaaagctcacaaatttttcttctcattcataaaactaatacttcattcctggataattttatttacgcttttaaaaatacttatggttaagtaaagggtgtggtaaaggaccttggtaccatccaaaacaacacaaaatgaaggtgttaaactgcttcaggtcattacattttactaaacaatttggtttctgaatacatttttcttggacctttcaattcttcaaatcttgaacaactaacaagtagttgctgtgacatatggatgacaccactgttaataaagcagtatttgtcaccttaaaaattagggaattaaaaaaattagggaattaacttgaagtatatataccatcacagaccaaaatgtgcaaatatattaaagaaaaccaacattcctatgagtcttgaattaggagtcaggacacttggattttaatcctttcaatttcctatgtgttccttaacaatgcatttaatctctaaagctcatctttgttatttgtgaaattaaattattggattaaatcccaaagtttcttttagtacagaagagaccagggacaagctctggttgtcctctccaggcagagtcttacatatagcatttattctacaacaatatatgacaacacctgtgaagtattactaactgggagagcttacctaaggcacagtgtccagggtttttattgggaggtcagtgatgtaagcatggggtgtctttggggcagacctttttttcttaatctccagcctcctcaaagatcaaagttggtaccatttgacccagggtttccacaataaatcacattattagcatagattatttggtgtggcctgaggctctaggtaaacaaagacattggtatcatggaggatttatgaattaccttccaagagccagggaagggcctttctttgaaatatgcagagttaggcagctcaggcctcctgagttaatcattcactgcctatcttttgttcagcgaagtaatcctccagtaccttcttgagaaagggtgcttggtaagcagttttttgagacttttcatgtcaaatatttttattctgtcatatttgattcatagtttagacagctatagaattctaggttggagataattttccctaaggattagggaaaattaggaattatttcttcatatgagtctgttttctatccattttgatggacattgaacaggctctttcaatttagtcacatatatccttgagggatacattctttaatttttcaatgattttctctcctcctttgtttctgctctttctggaactcctaacatttggctgttggacctcccaagacaaatccttttacctcttctctcttattttctgtctttttgctctacttttttgaggtgatttcttcaacttccagacctcttatttttcatttctatcaacatatttaatttatatgagctcttttttagtctctgaattttttattaatagaatcttattttgtttcatgattacagtatcttatctttctattaaccataggattttttgtttaggttttttctttctgtatagttttctttttcctgcttgtttgatctctatctttaattaaaaactcttgagctatacttggatttttattcataattaagaatggaagctctaaacatgggtgagggatgtacacattgttgggtgatctgactggtcaacttgttagggaacgattgatgttggtaaatttgggtctttcctctttggatgatcagattcttcatggtgaaaaactactctaatcctttaaagaatagaggtctagggatccctgggtggctcagtggtttagcacctgcctttggcccagggcgcaatcctggagtcctggggttgagtccagcattgggctcctggcatggagcctgcttctccctcctcctatatctctgcctctctctctctctctatgtctatcataaataaataaattaattaataaacaaacaaacaaatatataaataaatctttaaaaaagaagaatagaggtctagtttacagcatttttgagaacctaattggggaagagggtaagagatgagagaattttgtacttggttttcattgttaaagtctctgcttttagtatgatgccaaactatcaactgtgcctggcatctaactttcatattccaggccagaggaatctctctagaaaataaacatccagatatctgtcaggatgaataaggggcatttttccagggcatggagtagtaaatagatttagggatttaactgccattaaatagtttttatctacctgttttagcaacccccattctcagtttcagtagtactttattttcttggctcctatatcttttgaagattctgaaatatatattaggttggttgtgaaccctactccctactgctttgggattcatcctttttggatagtcacatattctcttgggagtttccaagactatccttagccttgataatttgctagaaggactcacagttattatactaatgattatagtttattacagtgaaaggatacagtcaaatcaacaaagggaaaagacacatggagtaaggtccagaggaaaccatgcacaagcttccagcattcctctctcagaggaatcataggatatacttaattccttctgtaatgatatataattacacatgtgaaatgttaccagagaatctcattagaaactcagtgccaaagtatttttattgggattaaagcaggtaagcactctctgcctaagacataccaaaattccaggctcccaaaaggaaagtagatgttgagtatataccttactgtttgcacagtttaggcatgatgaaacacccttatcatttagggaatggtctgaatcctcctgaaatccaagttctcaaataccagccaaagaacaatcttacaaacaggcttttctaaattaacagtcttaagcatgctatgttaacttttctttctttttttttaagattttattcattcattcataagagacacaaagaaagaggcataggcagagggagaagcaggatctctgagggaagcctgatgcagaactcgatcccaagaccccaggagcatgacctgagccaaaggcagacactcaaccactgagccacacaggtgcccctatcttaacttttctgtacacacatgggcctgctttctagcttccaaatttttattattgtatcctttcccattctactcaaacttgggggtttatgccttttaagaaaatccctttatttattgttttagtggaatttcaggtgagaacaaaattacatatgttatattcagtattaacctggaattttgtttgactataaaacaaaacaccccaatttgattgtataacatcatttttaaacaacttgaaagaaaacagatgaagcagagagaagaaacttgtttttaattccagttagttaacgtacaatgttatattagtttcaggtgtacaatatagcaattcagcaattacatatatcacctggtgttcattgtaacaaatgcacttcatattctccatcacctatttagtccatctcacacccatttcccctctggtaaccatcagtttgttctcttagttaagattctgtttcttgatttctctttctctctttctctctcttttttttttttttccttaaattccatatacgagtgaaatcatatggtatatatctttctctcattttgcttagcattacactctctagctccatttgtgtcattgcaaatggcaagattttattctttttaatggctggataatatccctgtgtgtgtgtgtgtcttctttatccgttcatcaattgagagacagttgcactgctttcatagtttggctattgtaaataatgctgcaatgaacatgggagtgcatacatctttacaaactaatgtttccatagtctttgggtagataccaagtcatacaattactaaattgtagcatagttctatgtttaactttttgaggaaccttcatactcttttccatagtggctgcatgaatttgcattcccatcaacagtgctcaacagttcctttttctctacatcattccagcacttgtcacttcttttgctgtttttcttagcattttgacagatgtgtgtggttttgtattaccaatggtaagggatgataaacatctttgtgtgtgtatgttggccaatctatatgtcttctttggaaaaatgtctatgcgtatctctgcctatttttttggattattttttggatgttgagttgtgtaagttctttatatattttgaataataaccctttacaaatatcttcttccaccgcataagtcacattttagttttttgattgtttccttcactgtgcagaagctttttattttgatgtagtcccaatagtttatttttgcttttatttcccttgcttcaggagacatatttagaaaaaagttgctatggctaatgtcaaagaagttactgccttccatgatttttatgctttcatgtctcacatttagatttggaatttatttttgtgtgtggtaaaagaaagtggtctcatttctttcttttgcatgttgctgtctagttttcccaacaccattttttgaagagactttttttgccagtgggtattcttttctgctttgttgagattaattggtcatacaattgtaggtttatttccagattttgtattctgtactattgatctatgtgtctatttttgtgtcaatatcatactgttttgattactacagctttgtcgtattacttgaagtatgtaattacaatgcctccagctttgcttttgttttttcaagattactttggctattcaaggtcttttgtggtgccatacaaattttaggattgtttgagttctgtgaaaactgctattcgtgttttgatagggaatacattaaatgtgtagattgcttttaaaatattttaagaatatttgttcttctaatctatgagtgtggaatgtctatttctttgtgttgtcttgaatttctttcatcagtgttttatagtttatacagtagaggtcttccacctctttggttagagttattcctaggtactttatcatttttggtccaatagtaaatgagattgttttcttaatttctcttcctgctgcctcattattggtggctagaagtgcaacagatttctgtaccttgattttgtattccacaactttactgaattcgtttatcagttttagcagttttttggtgtagtcttcaggctttctatatagagcatcatgtcatctgcaaatagtgaaagtcttactttttccctaccaatttggatgccttttatttcttttggttgtctgattgttgtagctaggacttctagtactatgttgaataaaagtgatgagagtgaacatttttgtcttgctcctgaccttagaggaaaagctctgtttttctccattaatgatgatgttaactgtgagtttttcatatatggcctttattgtgttgaggtatattccctctaaacctaatttgttgagagtttttatcatgaatggatgttatactttgtcaaatgctttttctgcatctattgaaatgatatatggttcttacattttcccttattgatataatgttcttattgaaacccaggaataaatcccacttgatcgtgatgaatgatttttctaatgtgtcattggattcagtttgctagtattttattgagaatttttgcatctaagctcattagggatattgaccagtagttttctttttttgtgtgatgtctttatctggttttggtatcagggtaatgctagcctcgtagaatgaatttagaagttgtccttccttttctgtttttttggaatagtttgagaagaatagttattaattcttctttaatttattagtagaatttacctaggaagctatccggtgctgggcttttgtttgttgggagtttttgattacagatttaatttctttgctggttatctgttcaaattttctgtttcttcctgttttggttttggtagtttatatgtttctatgaatttatccatttcttccaggctgtcaaatttcttagcatatttttttaataatatgctcttataattgtctgcattttttttggttgctatttctcctctcttgtttgtaattttatttatttcattttttttcttttcctaataagtctggctagaagtttgtcaattttattgattctttttttcctaaagaaacagctcctgggatccctgggtggtgcagcggtttagtgcctgcctttggcccagggcgcgatcctggagacccgggatcgaatcccacgtcgggctcccagtgcatggagcctgcttctccctctgcctgtgtctctgcctctctctctctctctctgtgtgactatcataaataaataaaaattaaaaaaaaaaatctttaaaaaaaaaaaaaagaaacagctcctgatttcattgatttgttctttggttttttagtttctatatcatttatttccactctaatctttatttttcccttgcttctgctagttttatatttgttgttctttttctagttccataggtctaagtttgggttatttgggatttttcttgtttcttaaagtagtcttgtattattataaatttccctcttagaaccactttttctgcatcccaaaggctttgaaccatcatattttcatttttatttgttcctatacacttttttatttcttctcttatttcctagttcaccaattcattgtttagtagcatgttatttaacgtccatatatttgtagtctttccagactttttcttttggctgactcttctaatttcatagcgttatggtcagaaaagatgcatagtatgtctttagtcttcttgaatttgttgaggcttgttttgtgagctaatatgtgatctattctggagaatgtaccatttgcacttgaaaagaatatgtatagtagacttttagaatggaacattctgaatatatctgttaaatccatctgttccagtctgtgattcaaagctattgtttccttattgattttctatttagataatctatccatcgatgttagtggtatgttaaagtcccctactattattgtattaaaatcagatttgttccttcatgtttgttattaactgttttatgtatttgggtgctcatatgttgagggcataaatatttacaattgtcatatcttcttattggatcatctatttattattatatagtgcctttgtctcttgttgcagtctttgttttaaagtctagtgtgtctcggacacctgggaaactcagttaagcatctgcctttggctcaggtcataatcccagggtcctggcattatgtcaggctctctgctcatcaaggagtctgcttctccctttccatctgcccctctcctccactcgtgcactctctctcaaataaataaaatcttaaaagaaaaagttattagtatcctaagagacaaaaagatattatatcctatgtatcctagaaagaacaagctatggtaaagaaaaaatactttgaaggttaaaagaaagagttcttaaaaatgaaatataggcattgaaagagaacatctgaaagaagtccatcaattcaatttataactagaggagctaaagcctcatttttttttttaatgcgagcaatagcaacggtaaggttgaaaatggtgcactactcttcatgggaacttaagcaattgagatggaaactatgaatagctaggtctgtgaaagtaatctacatagatggatatttatgtctatctattcaccatggagaagagattatattcaccataattcatttttgcatcaattccgaattttccaataaagtatacatttgaacattccaatgaaaactccaataaagtttttttttcttttttttaagattttatttatttattcatgagagacacagagagagagagagagagagaggcagaaggagaagaaggctccacgcagggagccctacgcgggactcaatccggggtacccaggatcacaccctgggctgcaggcggcgccaaatcactgcgccaccggggttgccctccaataaagtttctatttgaagttaacaaaagtggaaaaatcaacttgacaaaaagaaattctataaaaatcattcgttctgtaaggatttcagtacctaccatttcgaagcaacatagttacacatgcaatgaaaaacaataaataacatatagttccagtttaactcttcctcaaatcttgggataccttcactaattaaacttacattagataacattcacaaataaaacgtatttgtcatactctgatctttcttccctttatttgaggaggagagacaaaacatggagttgacattttaaaatggaaaaacaattgcagataacttattagtattttaaggggcacctaggtggctcagtcagttaagtgtctgccttcagctcaaattgtgatctcaggattctaggatcgagccctccatctggctccttgctcaatagagaacctgcttcttcctcttcctctgccccacccctcgaacatgctttctcttcctctgtctcaaataaataaaatcttttttaaaaataggttaaaaaaaatttttaagtttttatttactcatgatagacagagagagagagagaggcagagacacaggcagagggagaagcaggctccacaccgggagcccgacgtggaactcgatcccgggaccccaggatcaggccctggaaaaaaggcaggcactgaaccgctgagccaccagggatccccaggttaaaatttttttaataggatcagcccaggtggctcagcagtttagcaccaccttcagcccagggcctgatcctggagacccaggatcaagttccatgacgggctccctgcatggagcctgcttctccctctgcctgtgtcactgcctctctctctgtatctctcataaataaataaataaaatctttaaaaaataaaataaaataaaaaattttaataaaagtatgctgataacagtattttaaatatttattaattcaaaaattctaaatatttttttctgaattaagggccactattttgtgggagaaagatgggttatatgatgaaaaacatttgatacacaccaacccatataattcttcagactttttaaaaattatatttaaattcaattaacatatagtattttgttagtttcagaggtaaagttcagtgattcatcagttgcatataacacccagtgttcattacatcacatgccctccttaatgcccatcacccagttaccccatcccctcaccccattcccacaaccctcaattaatttcctttagttaagagtctcttgtggtttgtttccctctctgactccatcttattttatttttccctcccttcccctatgatcctctgttttgtttcgtaaataccacatatgaatgaaatcatatgataatttgtctttctctgattgatttatttcaattagcataataccgtcaagttccattcatgtcattgcaaatggtaagatttctttttttgatgactgagtgatattccattgtaattcttcataccttcgtaataaaaaaacaatatccttctataaatggcccatttatttagtttttctgatattaagaaacacctaggaagaagatatgacccctctgtcataaattgacatcagcaaggtacttagatgtatgttatttactattctaaacttcaaaaaaatctacgtaaagtacatgtttattatgtttcatgaacttcccttcactatcttaacaaataatatataattgcttgacttttttatattactaatttcttttttactcaagatcacattttattagctatatttataaatacttggaatctactcagatcattgtttttaaccttattatactctcagtgtgacttaagcacctggttgaatctatgatgcattgtaacattctgcatatctcagctgatagctgacctttaattctttccttattctgctcaactccgtctcatgcccattatttatccctgtatatgatctgtaatcttattacacttcccaccctcttcccattctgttcttcatttgaaacttttaaatgccttcactaaaatctagctttttccagatcacactttgtatataaggataagctccccccatctcaattttgggaagaacaatcagcctatattatgtttcccagtactacctactgatattgtactatcatcatccctgaaatccatgccatctgattaggtcatcattggctataataataacttccactttcctggatgaatcagcttttctttcttctggcctggtctactgttatatagatcttctttcaaagccgatattgataatccatccaatgtgtctcaattcaatggcttcttagagccctaaaaccctccccttctatttgagccacccaacagcaaggccacaccttgggtcgactattgcaaaagaagcagggcagcccaggtggctccgcggtttagcgccatctttagcgctgcctttagcccagggcctgatcctggagtcccgggatcaaatcccacttcagcctccctgcatggagcctgcttctccctctgcctgtctctctctctttctgtgtgtgtctctcatgaataaataaataaaatctttaaaaaaaaaaaaaaagaaaaagaaaaaggagcaagtctttctaaccagtctttctaacctcttttcccttaaacatcttggaatcatccttttatctgtttttcaccctcatactaacttttgattactttaccacttctgttttctctactccgttttcttccttgtgatgtcttttgtacttagaacctatggtcaatctagtattccccttctttgctttatgctgtgacaatatagtttactcacccactttttctttctctatgatagttttacatcttacaggtttaaattattacatgaaaaatgaaatctagttatttgaactttttataacggcatccattttttttcctattaggttgtttcaattttaaaattaggaaatcttgcagactgtatccactgtcaactacctgactttagctggacctatattcttctcaatatattcctttataacccttctgttcatgtgttccaaatgttttccatattataagtgcttaaatctaacatcccttcccaggatatgaccttgcctcctactttactagaaaaaaatagaatccatctgcccaattctctcatctatcttctctatatcaaaatgattatatccatgctacatccaaatttctgattttaacagagctggtttatagattattctaaattttctctgcagacttcctactttttcaagtgtctcttctaacctcttgactcaaaagtatgttttccttttcagggctaaccaacttcttttagagccttctttaacaattgaactctcccttcctctcccctgctctccatttatcatttcactatctctagtttatctctggccagcagattattaaatcagaaactgaaaagtctgagactttaccttacttgaagctaacagattagcttgccacagttatatatacatatactgacagaaaacgcaaggcccatgggtcagagaaaaagaccatttattactcatggcaaaaacaacaaccaaagtaatatcttgcatcaggtcattagccccaattcccacatggttaacacagtaagggcctgatgttatttgtgcctgcagcaaggtatgttacagaggaagaaccctgaaatgaaaggaggcggacagtcagatcttatctttactctggaaagtaaacaaggaaggataggaagaccatcacctgccctcacacctgaatatctccagagagggagatattctctattcttctagtcaggaaacaaatcttccctctggacttaaggtagacaccatctctatttcaaggatgtttgctatgcaaagccctttgctcagaagacctataccacgcagaaatatgtaatattcatagagaaatatttctcaacatagattttcccaggtttcccttaacttcaaatatatctcatatggcctcttcccactgtcttaactctattaattcatcgtactttttattctattattccactgaaaaccattttctccaaggtacccatgacatactggtaactcaaccaaatggtctttttcttaatcattcttgactttttgtggaatttaacaaagattatacttgctttctattacctctaaactgctatgcaggggcgcctggctggctcagcagttgagcgtctgccttcagctcagggcataatcctggagacctgggatcgagtcctgcatcaggctccctgcatggagcttgcttctccctctgcttctgcctgtgtctctgcctctgtgtgtctctcatgaataaataaataaaattttaaaaaataaaaaataaactgctatgcagttttctatgactgtctcctttgcctatctcttttcttccctctttgtgatttttcattctgacattagatgtgaacatatcacagggtgactttctattccaaattgttctctcaaatgtcttctagttgaagtttcagttgtcacttctgtaggtgattgtacttccttcttatattcccagtcacctaacttctcaaaatttctgcctatatgtaataaattttaaacctaagaatcaattccacaatctgactttttgaaatttttgtcagtggggcactcattctatcaattctttactatttttttaagaatgaatgtattcgtatgcatagcaatctacatgcatctccaaagaatcatggtgagtgaaaaaatccaattccaaaaggttatatactgtataattccatttatatgacattcttttcttttttatccagtataactatgtacagtgttatcctggtttcaagtgtacaatgtagtgattcaacaattctgtacattactcactactcattacaataagtgtactcttatatttcatccatccttccactcaccttccctctggcaaccactaatttgttctctgtattttctctgagagtctttttttgtttgtttctttttttctttgttcatttgttttgtttcttagattccacagtgagtgaaatggtatttgtctttctctgaaacatttcacttagctgaataccctctagatccatccatgttattgcaaatggcaagatttcattgttttctatggcagagtaattttccattatatacatataccacatcttctttatccattcatctatcaatggatccttgggttgattccatgtcttggctatcgtaaataatgctacagtaaacatagaagtgcatatatcttttaatattagtgttttcatattctttggataaatacccagtaatgacattactagatcatatggtaattctacttttatttattttttttacttttaattttttgaggaacatccatcctgatttccatagtggccataccagtttgcattcccaccaatgttgcacaaagggttccttttatcccacatctcaccaagatttgttgtttcttgtggttttgattttaggcattctgacaggtgcaaggtgatacctcattgtgatttcgatttgcatttccctaatggatgagtgatgttgagcatcttttcatgtgtatgttggccatctgtgtgtgttctttggagaaatgtcttttcatgtcttctgttcatttttaattagattatttggttttgctggtgttgagttgtagaagttcatatattggatgtatcaattgcaaatgtcttcttccattcagtagattgcctttttgttttgttgatggtttcatttgttatacagaagctttttattttgatgtggtctcaatagtttatttttgcttttgtttcccttgtctgaggagatacagctagaaaaatgtagctatggctaatgtcagagaaattactacctgtgctttcttctgggatttttatgttttcaggtcctcacatttaagtctttagattcataacctgaaaaggtggttgagtagactcactcaaattcaacagtatttattaactagagttcttcccaccattctaatccattttcaccactttacctaagaaatcactcaaacataaaatcgtattacagaatttgtgggagttaaagactaattctttagcctttttctacaaggcttccgtgactgagcaactgcttgcccctccaatttcaacttgtgttgtatttcacatatcagaatacttgctttaacctaaacccactgctcatttattccaacattttctgaaaacttactatgaaccaagcattatgctaggcactggagctataaatatgagtaagttatggtctctcttaagagggaaataaaaatgtaaataaatgccataaaatgtgactagtaaagcaaggatacagagtggtgtttcttttcctaagtcacttaaggtgacagtataagagatgacacttgagtaaagtcttgaaggatgagttggaatttgttatatgacccagaaagctgatttcaggtaaagtaaaaacacacaggaaagcacagagttgtgaaactgaatcccttatttgaagagttgtaaataatccaaaatgaccagaccatgagattgaagatgggataaaaagatgaagtaatgggaaggtagggtgggatgatgaaagacctgttatgtcgaaaggagtgtgagctttgtcctggaacagtatcagatttactttttaaaatgaaaatgctccattttaagaaatatatattcagacaatagatgccaaaacaaatggatgaaagtttgaataacagaagatatttatattgtaaatatttctccatgtggtactcattacaatgagaaaaatgctaacttagtggagaaacttggtagacactaccttaaccaattgctcaaagtatcacaagaatgggacaaatcaacaccatgaaactcctgatgtaattcactgagaagaacatagcaccatcatttctgtggtattcctaccaaaatgcatatcctgaatctaattatgaaaaaacagacaaattcaaactgagaagcatctacaaaatcactgtaaatacaaagggaaaaactgaaaattaaaggaggttatattcacaaattagcacataatcctggtattttttcctcccataaatggcattattggaacaaaaggcgaaatctaaataaggtctggaaattagataatagtattatatcaatattcaattttataatttttgtaattatattgtagtcacataagagaattttattttttaaggaagtatacattgaattacatatttagggttaaagaagcaacacacatacatacaatttactgtcaaatgatttttttaatcatataaaaacaagttcatgtgtagaatatattgtttatagcagcattactcacaataccaaaaaggtggaagctactcaagtgtccattgatggaagaacagataagcaaaatatgatgtatacatacagtggaatcttattcagctttaaaagaaaaggaaaatgtgacatgagttataacatggatgaactttgacgacattatgctaagtgatataagccaatcacaaaagaacaattattgtatgattcccgttatatgaggttactagaatagtcaaattcacagacagaaggtagaatggtggttgtcaggtgctggaggagggaggaattaggagttattgtttaatgaatacagagttttagtttaggaggatgaaaaagttctggagatggatgataatgacggtgtacacaacaatgtgaatatactttatgaagtttaactatacacttaaaaatggttaaatggggggcacctgggtagcatagttggttaagcacctgactcttggtttcattccaggtcatgttctcagggtcatgagatctcccatgttggactccaagctcagcatagagtgtttaagtttctctctccctctctcactgtgctgccctttctctccccctctctctctataaaataaatatgtaaggtttttttttaatgattaaagggtgcctgggtgcctcagtcagttaagtatctgcctttggctcaggtcataatctcaaggccccaggattggctgtcaggccttctgctcagctggaagtctgcttctccctctccttttgcccctccctcctgcacatgcatgcacacacatgcacagaggcacatgcacactctcaaatgaataaaaaaatatattttaaaaatggttaagtgaaaaaaataaaaatggttaagtggtgagttttgtgttatacatattttagtacaatttataaaataagaataattaaaattaaatgtagacaggtgagaataaagaaaaagtagtaaaatgaacccttaccttctaaagatataaatggagtaaagaatggaagcagagagaccaaataaaaaggtgttgtaatatgtaccttagtagtggagacagagaaaatggatatatctgagaatgattaggaaattaataggataatattttagatgcctgtatcacatctagcttctgggttaccaaaatacacagatatgggtacatgcataagctactatctttgcctgagcatttacctaacaccaaatttacctaatttgcccttcataacttggttctggcttaaatgtgatttcctgagaagtcccccctgactacacagtctttcccctttctccttacctcacaccatttcttggactgaattagtctttctcccttcttagatgaggtgatagcatcttttgcattgataccacaaagtatcagaataagtggtttatctatttcttcagtacactgagcttcttgggagtagaaagttactatatttatgaatccacagcacctttcataatgtatgctcaataaaagcttgaataaaattagtaagttattgagtacttatactatttttctttatactgttttatacttgactctttccatgcccccaaagttaataccttatctaaatagtcctataactagtctttttactcctctccttgcccaaatttcctctgtactagcctgtgcattgatgccagattaatgaaatttcatattttggagtgtctacataaaaaacttcagtattggggatccctgggtggctcagcggtttagagcctgcatttggtccagggcgtgatcctggagtcccagaatcaagtcccacatcgggcttcctgcatgcaccctgcttctctctctgcctgtgtccctgcctctctctctctctctctctttctctctgtgtctcttgtgaatgaataaataaataaaatctttaaacaagcaaacaaacgtcagtgtcttctcattatctaaataaataaagtccaaattcactagtaagaaattaagaccttccacactatgctctcagaatttaccatgttcattttattcaacaagtatttgagaacttaccctttgcaaggctttgtgaaggaagaaagtttactaaatatatatgctcattatctttgtgttcattttttttggtcccttgtttccttttactacttcatttcatcttagggaaaaataatctttttttaataaatttattttttgttggtgttcaatttgccaacatacaaaataacacccagtgctcatcctgtcaagtgcccccctcagtgcccatcacccattcacccccaccccccaccctcctccccttccaccacccctagttcgtttcccagagttaggagtctttatgttctgtctccctttctgatatttcctacccttttcttccttcccttctattcccttgaaaaataatctttgaagaacattcagccatattcatttttaagtaagtagttccattttaagacaaaatgtaagtaatataatgaagtttaggtggtaagctatccagcacaatgtctggctcataataaaagttcaataaatgtttcatttattctgcttaaaattttaaagatagaaatttaaatttaagactataacaaagaaagttattactgacttaagcctttggaaacctgcttattttgcttcatggtagttcagatgttaatatttgaatttactgatctaatgttatttggaacatattatttgtagttgtatcacttgaaacacaaagtcaaaacaagtttatgaatactatattacaagtgttttttcaaaacctttttctatactttctttataggttatatgtaaagtcagatgtgccactgaacttgacaaacacaagtaagtttcatgagtagcaagatctaatttttttcacaatagacttctcaaggtagaagggcatggtagttgaaggtgctgtagtagttttataggaagtccagtagttagattagcacatgggaaatgaattgagtaaccacagttctcctccttcagccatattgctgcttaacaccttcttttgctgctctgctactgtgctgctttagatgtgagatatagtttcatagggcccacacatactaaagttagattttactgtttggggcaagcatgtatagaatagttccatgaattaaggaatgtttcagtactgattaacctcaaaaatgagaatgctaagctggggagtcagaaatttgggtttcagaccaattctcccactaacttgttgaccgtgcaactcatttagcctctctaaatcttggactcccctggttatatgaataacttcaaggtcccttttgggttttaaattacatattattacttatgtaatctgaagagaatattaagatataaacttcaccaactaaaatctttatactttgtacacttaacaaagattgcttgttatagattacacattaccttcaattaacctcttataaactatttccaaaggtcgacaacattttatgatttccactcttgaaagtgacccaaaatagaagatatgaggatgccaaataaatttctggctcatattaatttaggttataaacatatttgaactgggaatagatagctgttacagctacttaatacaaatatctacagcttacctgaaaggtaagatcactttatgcagtgatctcatttttcttagggagctacagttaaggcatttcattttcagagttgctctgtatgcatagtaagtataactttataagaagctgaggtatcaatgaggtgcttgaaactctacatatactgtacctatgttcttctttggtgatgtttgaaagtaatggttactatggatagtcagaagatcataaaagttgaacattatttaaaacacatttcccttaacctcttaaaactaatgttagtgatcaatttaaatttagatagagtttattaattttccaagcagattataaaagcctggtaattcttagaatggaaaggtaaatgaacatatgtttagtagttataaaaatgaaaagtagggatgcctgactgggtggctcagcggttgagcatctgcctttggcttaggacatgatcctgtggtctggggattgagtcccacatcgggctccttgcatggagcctgcttctccctctgcctctgtctctgcttctctctctctgtttctcatgaataaataaataaaatctttttttaaaaaatgaaaagtacaggattactttaattagtattaaaataatcttatattattcttcctggcatggacaactaagttcaagtccacatgtgattatccttaaattaatgttttaaaacctaatgccatttttaaattgcttagatattaattccataatagcaaagatatcccaagtaactctgagtcattattaaatttgtatttaaatgaaattataaagattttaaactgaaggtattattattgtatctgaagtaacacactaattcagaattaaatctagtctctcattagtatataaacatctaataaatttattttttttctttcagaattctgttgcatttgggctttatattggcaagccttctttttttagtggtgaacttgacttgtgcaatgttagtccacggagatgtcccagaaaatcagttgaaatggactgtgtttgttcgagcattaattaatgatagtctgtttattctttgtgccatctctttagttagttacatatgcaaaattacaaaaatgtcatcagcaaatgtctacctcgaatcaaaggtaagtatatttcttatatttacacctgagaatctaacttcaaatcctcatcctgtgaagcatattttaatggaaagcttatgtttttttaaaacatattctgaatgtaaggtacatttttgagtttgaaagaatggtcacaagacattaaaaggcattcaaaacttggccctaagtaatagtttttttaaaagtttgtattgaacatactgttattttctgtgacttatatcctctgcataggaggataaatgaaagaaaccaggatttacatgaatatattataaatggtctaatatataaagccacactaacaacttaagatttcgtcagtaagggtggcaatattgccattaaacaaatttatcagattatgtctacatacctttgggttagcagtgttaaggtatcatatgtctaagatggtgtttatttgtatcaggattcagaaaatgttacttcacctcataatatgaagacacaattattttgaaacaactaatcatgtaattaaatttataaatgccttgcttctgcctttccttatactttggatcagcaaacagaggccaatgctaacctattaacaaagaacaatagaagtttctacaatcgattgaccatgttgttgagcagtgaatcagtcatcacagtgatatatggcactaggtgtgtggtataaatgtgtagatttgggggtgtgatttatacacacacaagcttgctttaatttggtatcattatctattcacagaaggtaagcaagatagtgtcttaaacagaacagttctctgaaatatagttagacttctgtattgtcatctctcatataatcctagtgaagtaaggtgctttaattaaatgtatggtaaccaacttgtcctttaaatttaggaagagactttaattttattttttaaacatgtgtcagtagaatgcaggataaatatagaaatagaaacaaaaacatatatacagagagagagactttcaaacctattaatcttacctagaaaattattttattccatttatgttctaaaaagttcccaaaatgtaaatgtttttgctaattctggcttcagtgtaagtgttaaaaatgataatgtcactgttacagtatataatctttggtgtagcaatagcatctccacttaatgtaataatatcaccataacattcataccttgtgcttatctagtgataaacagataaatagatgtggttgaatttaaaaggcttcctctctggatatctaacaacttttaaagttttggtttatttgctttgaaatagatatttctgtgaatatagtaaagtttccaatctaaaaggaaaatctaatctgataactcctccagaattattttaaacatcttcccctatcatataaaaggtattgacttttttattagtataattgtagaagtcttacatttaaaaagtgtgtggattcagaattctctaggaacattacagagagacatgcttaaaacatacttcaattttaaaggtaaacataatatgaaacactagattatttgtatgacattgtactattatgtagttcttggtcttcctaactaggttataaagttatatattcaaagagtacatcatcttgctttcatgttctcctagtgaaatcactaggcccatttttattgtttgacctctgtacaggaatagccatttctttcattcagtcgacaaatataggttgaacacctacctcttccacgttcaaaccaactttgcttcctactgtccctaagaacatttccttaaagctcaaactttggtcttctgtttttctttttattcttcattccttcttaatgagatcttccatgatttgtttcaattaaatcttacctaccttatttctaaatggcatacaatattctttcctgtctctatatccttaggctgtttcattttccagaaatgtctctcctctacccggggctctatacctgttgccatcatcttaaccaaactttgaaggcataactctaatgtttccccttttaatgaacttaatttgattccttcctccttgcttccaaaataaaatttagaaataactatctgaattctctataaaaaacttatttttattcagttagcagctagcacagtgctgtgtattagttctctttttcaaagtagcaactctaacaaggtttttaaatattagttatcaattttgaggatccctgggttgctcagtggtttggcgcctgcctttggcccagggtgtgatcctggagtcccgggatcgagtcccgcgtggggctccctgcatggaacctgcttctccctctgcctgtgtctctgcctctgtttctctctgtgtgtctcttatgaataaatgaataaaatctttaaaaaatacattagttgtcaattttaatagtttatttcttctctttaatttttaaattttcttacatatttaaggtttttactttgttctttgtctatgttcttatatagatacataatttattattttgtaaactaataagatatttacagcaatatgttttctctagtactgctttggcagctttccataatcatgttatatagtaccaacattcttatttaacaaaaacaaagaaaacattctgtttcaatttcagtcatgactccaacattacatatttacacatcaatgtgaattagatattgtctttaaatatagggtcttccttcaacttattttggtggaaagtctaaaattcagacatctaatcctattcaggtcccctgaccttcctgagaagttatcagttttaccctctgtttgactgtctatgcatataaatctggcctactacacaatatagaatttctgtactccaggttcttgaaataaactctcaactgttaaattcaaaagcttcattccagaaaggttacctgaagaaatgtctagtctttccatctccctatctattctacattttatctttagtccagtccagacgttttatacttaagattacattgtaccatggatagaattaattgtctgttctaacctatactttgacatcatgctttggcctgtactaagaaatatgtaagaaacatttatcttgaaagccactattgtgtaatgttcttgaggatattgtctacacagtgttgtgcagaaaatatctttttctccagctcagtaccaggtaaaacaatattgattaaatccttcttttctctggccactatgccattcagaagcaaatatgtggctcacctctatatcaatcatagatgaccttatgatatccactttgggttctggctctatctctagttatatttcatttttttattccccatcaccatcacacacatacatattcctgtatatttttttattttgtattcttctctgtaactacttcaaattctccttggtgaatgagggtggtataaataaaaaatatgatattggattatatctttggatatgtttatatcttttttcagatatattaattttaattaatttggaaaggccttagtgagagacaatgtatcatagtgatgaagagccggaaacctgagatcaaagaaataagaccataaatctcatctcctgtttactggctatgtggcattagacaagtaacagtatctctaagcttcactcagctgatctgtaaaatgaaaataatgatagtgttgatctgataggttatatagagtttttaggtatgtagttttagatatatatactgtacagtatagatatatatagtatatctaaatattagatatatttagatatagtatatcttaaaactctatactattagagtaagaatagtatcttctaattaatctaaggattaagtgaaattttatgtaaggcattagtataatgcctagcatttgagaaatgcttataaatattagctattatgatctaacatgtactaaggaatggtaatgtacttttgggaagttcttgaatatctgaaattgttggcaaaatttatctagagagaggtcctatatacgtaatcaatcctcaaaaggaacagagatccagaaaaaaataagaatcattgaagaaatgaatttctctttaaatatttaattttaattttaatgtgactccacctaatttatgtaccattccacacagattttgataagggttgaagtctaacaggttacatgttatctaatttttaactagcttccctttcaaatttttagaacaaatactactgaaattatgtaatggcatttttaatcataggtatttttgttctgaaatgtgctgtatcttttattacaacttttttctttatttgcatggtcatgaaatatgatgctatcttaactttttatctattgcaaacattttaagtgtgtctcattagtttaaacaagatagagttgttgggtctttttttttttttttttttttacaaatcctttatatggtaaacagttaatatttattgacatgattgtgtgttagtattggtctcccattaggtttttttattgctgttttctttgccttcatttctatgatttctgtgctacatttgaatttatttaatttttgtcagaattataacttaacattattaaattattatttatcattaaaatgcataatgatggggctcctaggtgggacagttggtttaatgtccagctctttattttggctcaggttgtgatcttagggtgatgagatcgagccctcattgggctctgggctccaggctctgggctttgggctcagggtggagtctacttaagactctctccctcttgactcctggacggctcagcggttgagcgtctgccttcagcttagggcatgatcccagtgtcccgggatcaagtcccaaatggggcttcctgaatgaagcctgcttctccctctgcctatgtttctgcctctctctctctctctctctctctctctctctcatgaataaatggataaaatcttaaaaaaaaaaaagactctctctctctccatttacccctgcccccagcttgcactcatgctctctctctcaaataaatcttctaaaaaataaataaaatgcatactgataaaattatttttattctaatattcctttccatttcagaaaaataagaatatttataataacatagaacataaaaaaagaacatagaacatataccatttttaatggacaaaataacttaccagcacaaaaatttttaaactaatgttgagggatccctgggtggctcagcggtttagcgcctgcctttggcccagggcgcggtcctgaagtcccaggatcgagtcccgagtcaggctcccggcatggagcctgcttctccctcctcccgtgtctctgcctctctctctctctctctctctctctctctatcataaataaataaataaatctttaaatctttaaataaataaataaataaactaatgttgatgtttactccctgtaatgacaggttggtattatctgtataaaagaccactcaaagacaaggtgggaataaaagttaagcttttaggtttatatctctggtcagggatatgctcaatattatatctaggtaagagtgtaaaaggaatcattgtctgatacttaatatcagatcagcttatctcccagcccagccagccatttgcaaataatggattctctctctctctctcctgaattcctaagttttaattactatgtaaacctttctgtccaatgttcactcaaccctttatgcatattaatttaatatattggaatagaaaacagcatcaacatcttgcagagacacagtgactttcgatttcactgatatttctgatctttcatacagacgaactgatcctctaagaccaaagcagtgttttgtggtaatttaagccataaagaaatagtctaaaatactatgagtgtctttcttccaccatcctgaaatatgatttaacccaaatttggggagcacgatggcagagaaatagaggctgcaccatcctttgtaatagatatgattaccaccttcccaatattttgctctaatttctctcctgaattataaggatttactctatcatcttaagatgaggcacttctttactttactcccttcatttttccagttcttttataccccaagtcttacttcctattatgttacttccaccacatacttgtcccatttttaaaaatccataggagccagagatctaatttcatggtctttgcaacatgaaactatttttgaaactcttcagagtttataatcatcaaaattcacttgacccttgaacaacaaagggattgggggcactacccactgcacggtttaaaatccatgtgcaaatgggtgcctgggtggctcagttggttaagtggctgactcttgattttggttcaggtcatgatctcagggtcctgggattgaaccccatgtaggggatccatgctcagcgaggaatctgcttgagattctctctccctctccctctgcctcttcctccactcattgtatctttcaaataaataaataaatcttttttaaaaattaaaatccacatataattttggctcccccaaaacatcttctaatatcattgtattttttaagtatagtggacacactgactcccccaaaatttaactattaataacctactattgagtagaagccttaccaataatataaacagttaaacacatactttgtatatgtattatatactgctataataaagtaaactagagggggaaatgttattaagaaaatcataaggaaggggtgcccacgtggctcagttgtttaactgtctttggctcaggtcattatcctggggtcctgggattaagcaccaaatcgggcctccttgctcagcaggaagtctgcttctcttgctccctctgaccctcccccttgcttgtgctctcacttgtgtgcacgctctctctctctctctctaataaataaataatctttttaaaaaatcacaaggaagagaaaatatatttacaatactatataatattaaaacaaaaaaatctgtgtttaagtagacccatacagttcaaacctgttgttcaaggatcaactgtatatttttttcaactgtatattttttaatttactaattgctattcctttgttttcttattgttgatgcttagtttggtattttaatttcaaaatggaaatagcatttgtgagatgatttcaaaaaaatatatgtaggattttgcttctggtaatgacttagaagcttctattggacaaaccttccacagatagcagtgataaattctggacaaaatataaaaagcactgaaggcactggagaacaaccacttagaagaaggaaatgacactgagtaagtttcctgttttttacagcttctagcctgagggaagttctcatccatggggcagccaaaacttgaagagaaaacctctgttttacttgcctgaagaatcagaagacaaaattcaagtaattaccacatatggaaagtgagtggggaatttcaggaagaagacagccagagagaggaagacacaaattttgatgataaattcagcctaattataatctaatacctaaactacacattagcaggacagaattcaagagccacagttaaggatatttcagctctccatgcttaggggtagtttggtatttgagtctagcaaagttaatttttgcttaaaaaaaaaaaaaagaaaaataagtactttcagaagagtataacagaatccagactctttaaaatacatcattcacaaggtccagaatacaattcaaggttattgggtatatgaggaaacaggaaaaatacaactcatgctcaaaaagcaatcattggaggcaatctcccttccagatgacttagatgttcaccatatcagacagagattttatagtatgcttaaatatgctcaaggaaaatatgctttgataaataagtcaatagaaatcttaggagaaataaaaactattaaaagaaattgaagaattaagaagcacaatatttaaaattaaaaagtcatcagttgggcttaacagcagataggagatgaaagaagaaaaagtcaatgaacttaaaacaacaaagtatccaatttgaaaaacagaggagggtgaggggaagatgataataaaatgaacagaatctcaggacctaagtatgtgttaggggaatccccaaaggaaaagagaaaatgacattggaaaaaatatttgaagaaataatgattgaaattttccgcttttgatgaaagacataaatttacaattttatgaagttcagcaaccccaatcaggataaatataaagaaaatattaaaaaagaaagaaaaaaaaagaaagaaagaaaaagaaaagaaagaaaaaaaagaaagaaaaagaaaagaaagaaaagaaaagaaagaaaagatcattgcctaggttcattattaatcaaagtgcttaaaaccaaaaataaaaagtaaatcttgagaacagagaaaactgacacatagataaaagaacattgattcaaatgatcaactacttctcatcagaaataaaggaggccagaagatgtggaaacatcttttacatgctgaaggaaaaatgtggttaactctgaaatctatatccaatcaaaatataaagaatataaatcaatcaaatccaatcaaaatatagagaatataaagaatgatgaaaaataaaagcatcttccaatagaactaagagggttagttaccaacagacctgaattacaagaaatgttaagaaaattctacagactgaagggaaataaagtcagcttgaatttcatctgtccaggaaggaatgaagaacacaggaaatagtaaatatgtgggtaaatataatttcttaatttctaaaaaagaaatatgactgggcaaagcaaaacttataatgtgaggcttacatatgtacatatataattctctatatagtatatataacaaccatagcaactacagaataaaggacaggcaataaatgcatccatatggttgcaaatttcttacattttctgtcaggtggtatgatattaacagactgtgaaaagttaaggatatatcttatcatctctagagtagtagttctcaaactttgtgatctcaagaccccattacaaccctgaaaattattgagaaccccaaagagctattgtttacataaattatatctacttatatatacattgttagaaataaaaattgagaaattcaaaaaatatttgtttattcacttaaaataacaataataaatccagtatagcatgtttttatgaaaaataattgtattttccaaatcaaaataaattagaagatcaacattgttttacattttgcagatatctttaatttctgacttaatggaagacagttggattttcatgtttgcttctgcattcaatctgttgtggtatgtcctttaagttgaagtatatgaagaaaatcctcacacatatatgtagttgaaaaatggaggagaattttaataaccttttcagataattgtgatattcttctttaatactataccaaaaatctgaagtggaggtttcttgaaggttagttgccatgtgaaatctaaaaccatattagtgaactttctgtactaccatttgtctctcttgctgtttgaaagatggtgtagcatcgtgcattgatcattggaagatactggtcacagattttcaaaatgatgatacatttcattgaatattctaattcatgtttgttaatatcacctccaacctcatcagaaaggtgtttaagttttcagaagctgccatcccagtcttatcatgaacataagtgcttacaagttttcaaaaattctaattttaatttgaaatatatatttcaccattgtcaatagtgtcatatattttccttgaagtgacagactcatttcatttattttcaaaagaatatatatccagtaaccaagtgtgaataaccattgtttgtctttcatagttgtctgttaagtaaaaaatggtgttctgaggaaaaaaatggctacttcggctcacaagtcaaacaaccacataagtgcttttactcaagacagccacaatacctcagcatgcagtagaattgctttaagtgtatgtctcatctcatcacacagaatgttaaatagacacaaactctggggttggtaattaaaattttcagtgcttcatcaaggatattcttaagtgaaactttttttttttttaactgggaatgtgacgcagtaaagaatactacacaatttggtatcactgctttgatttgtgctaaggcccagaagttttagttaccattgcttttgcaccattagtgaacatatcaacacaaatgacccacaataaacaatcagaagagttttcaacacttaggatatttcaatcacttatctttcttctccagattgccctaaaagaatatcttcctgaatgattagctggtcctgacaccaaatgaatatgaacaaaattagtcctgctacatcaggttcatttatttgtaagacaaaaatataaatctgtagacaaaatattagactctttgttttcagttaaatctttaaatcagtgaatttctgtattattggaaaatggcaatgtcataatttcctgaatggacttcccatccagtaggcattcagcaatgtcagctgtgtaagaatttactggtttctcagctactgtgtgtgcttcattagccaatgtagtataataatgtagcctgtgaaatgtttgaatgactttttcatttctggtttggaaagttataaaaacaatttttggtattttaaaaccacacctgcatttaaattttccattccttttgcttttaaactctgaatgattggtctcaagatgatgctgtagcctcattgggccatatactattcaaaacgtttccgtcatagaagacacaataaggtaaattattaacatttgcaaagcctattgaaagataattttcattacattttatttgatgaaacaaaacagaaatcaatttcatccagttcctttgaggtagattcctttctttattgagtcatagaattctaatcactttcatctttttcagcatcttagaggtaaacagagatgtgtgttgagaaagatattttttattgtgatagaatataaatattattttttaagtgtacagttcagtggcattaagtatattcatactgttgtgcaaccatcaacactatgtatctccagaacatttcattatcccatactgaagctctatatccattaaaaattaattccccattcttaagccaataattcattaatatgaaaaaatattttttcattttagagtaatatatgattaatttataaaacgagtttaacatcaaatttaaagttttttaagttttttgaagaaagttcttaaatattgtaaaacaaatctatcaggagtaccaattcttgtacttccatggagatacaaggatttcaaaataactacttattgggtgataatgaggtttcagcagatacagcaggtataaccaaagaaacctagtaagaacccagtaaaagtaaaagaacaagctaaattaatctctgaaaatgcacctatttatacgctaatactattataataggaattcgagaaaacacaagaatacacatgcacacaaagtgttgacatcacttagtctggaaaactctgttgtacattcaaaagagaattacagtacaataggtaaataacatctcagtgtctttgttaaatcatttttttaagtcattttgattttggtctttaaggtcccttgaccacactttaagaactactgccctagagcaaccatttaaggcaaaaacaaaaactagtgaagaatagttaaaaatccaaaagataaatgaaattctaaaaaatattaaattaacccaaaagaacacaggacataagagatagaggaaaaacaaacaagaccaacaacaaaacacaaaagggacaagcagaaaaacagtaaaatataaggtctaaatccaaacatatcaccaattatattcaacgttaatggaccaaacattcccattaaaaagtagagactgtcaaaatggcactttaaatataaaaaaagatacagctatcaaaaatagacagaaactacgctgcattcagtatgcataaaaggccctctaacatcagataaaatagacttaaagacagaatattaccagatataaagatacctttcatcaggaagcaaagaatataaccaaatataaagaggtacatttaatcagaaagagataaaaattataaatatgggcattaaggaaggcaggttttgtgatgagcactgggtgttatatgcaactgatgaatcattgaactctacatctgaaattaatgatgtactactatatgttggctaattgaatttaaattttaaaaattataaatatgcacatgaagccaaaacggtagggaataaagtagaaaaaagatttaccaaataggaagaaatagtggaggtggggaatctatacaattatagttggagattttaatgccccaccctcaacaattgaaaacaaagtatcagtacaaaaactctgaacgacattatcaacccctgagttaattgactctcagtaactggagaatacacattcttttcaactgagcatggaaatggtcatcaaaataaaccatacagtggaccataagacaagtatcaatacattcaaaagagttggattcagagtgttctcttgccataatgcagttaaatatcaataacattatgatatctaaaattccaaattatataattccaaattatacaacatagttctaaataactcgtgggaaaaggaagaaatcacaagggaaattagaaaatatttcatatagaagaataatgaaatacaatataccaagaattgtaggatgttgctcaaaatagtgcttgaagagaaaaaatatatccttaaatgctatatattagaatagaagaaagatacaaaattgtaacctaagacttcaccttagaaactacaaggggaaactaggacaaagttaatttagaaaagtaggcaaaataagtggaaggatgcaataataaagataagaatagaaatcagtgaaacagaaaataacaataaagaaattaaagccaaaagttaattttgtgaatagatcgacaaattttgtgtacaggaaaaagcagagtgaaaaaacaaactgccaataccatgaataaaagagagaatatcactatagatattactaggcattaaaagaaaaatgaaggaatattatgaacaactctgcgtgagcaaatttgacaacttaaaggaaatggacaagttgctttaaaaatacaacttaaaaaaaatacaacttaacaaattgttagaagacaaaatataaaatctgaataaccctgtgcttattaaggaaatttaatttgttatcagaaatttccctcaaagaaaactgtttggttcagatggtttcactagttaattttatcaaatacttaaagaaaaaataatactaatattaaacagattcttttgaaaaaaaaaagaaggaacactttctgatatatttaatgaggacagcattactgtgataccaaacttgacaaagatattacaaaacaaaaatcacaaactagtgtcctttatacttaaagatgcagaatctaagcaacatataaaaaggataataaatcatgaccaagaagagtttatcccaggaatgcaaaataggtttaatgtttgaaaatcaatcaatttaattcactacattccgagaagagaataaaacaaatagcaatttgaatagctgtagaaaatacatttgacaaaattcagaccctccttgatttaaaacaacaaacagaatatagaatattaggaatattcctcgatctgataaaaggcatctataaaaaatatacaatgaaatcatacttaaagtattgttttgtccctagggttgggaacaaagcaaggatgctccttctcactatttctactcaatattccaagaaaaaaaattttttaagtataaaattggaaataaaaaagtaaaactctttaattgcagacaacagaattgctttggtagaacatcttaaataactatatatttaaataaataactacttgataactactagaacttatgagtgaatgcagcaggttctcaggatacaagttcaaaatacaaaaattatattgtatttttatataaaaataaatatatgaaaaataaaaattaaaaaatataataaaatattgtatttttatatatagccaaggccagataattagaagatgaaatttttaaaaatacacatttatattagcataaaaaaacaaaatacttcagaacaaattttccaaaatacgatacctctatactgaaaaaactacaaaatattgctgagagaaattaagatttaaatcaatggagacaattgctcatggattggaagatgcagtattgttaagatggcaattcttcccaaaataatctacagattcaaagaaatcctaatcataactctaccatgagtttctttaaaacagaaattggcaactttattctaaaatttatgtggaaatgaaaaggacttaaaaatacttctaaagtagtactctaacagaactttgtgcaatgatgagagtattttatatctgcattattcagtgtggtaactagccatgtgtaacatttgagcacttgaaaggtagctattgtgacagaactgatcatttaatttttaaaaaattttaatgcaattaattaacatatagtatattattagttttagaggtagagttcagtgattcatcagttgcatataacacccagtgctcattacatcatgtgctctccttacgcccatcacccagaaccccatcctcctacccacctcctctccagcaaccctcagtatgtttcctgtagttaagagtcctttatagggagtgcctgggtggcacaattgatagtgtcagcctttggctcgggtcctgatctcagggtcctgacctcagggtccaatctcagagtcctggaatcacactgggcttcctgcttagtgaagtgtctgctactccctctcctctctttctctctttctctctccctctccctcagccccagcctccccttcgtgctctctctttcgttctttctctctctctctcaagtaagtaatttattttaatttaatatgaatgtaaatactcacatgtagctaatggctattatactgaataatggagaaggaaacccttaaaaagcaggggacttacactacatagctttgaaatttagtataaagctacaataattaaaacactgtatgactggcataaaagaggcaaacagatcaatggaacagaatagaaagcctagaaatcaatccacatttgtaagatcttttgatttttgacaaaagtactaaagcaatccaaagggaaaatgaaagctttttaactaataaggctggaaaaactggatatccatatgaaagaaaatgaacccctaactccatctcaaactatacccatacaaaaaaatttttaaatggatcatagacctaaaaataaatgaaaatactctaaagcttctaaaagtaaatacagaagaatatttttacaacttgggtataagcaaagatgtcttgggtcatagaaagtaatcagaaggaaaaaattgataaattagacttaattaaaagttcaactttctcatccaaaaaaaagtctaagaaaatgcaaaggcaaaccacagacttcaagaaaatacttgcaatacgtatttctgacaagggacttatttccagcatatatagagatctcctacaactcaattaaaaaaaaaaacccaatttagaagtggtaaaagatatgaatagatttttcacaaagaagatatacaaacggctaataagccaaatgcagtcttcagagaaatgcagtttaaaaccaaaatgagatgctactacacatctaccagcatggctataattagaaagattgaaaacccctaatgttcactaggatgtggagcaactggaactctcatactttattggaagtgtaaaattgtacatccattttggaaaaagatctggtagtttcctctacagctgaacttatacctaccacatgacccagtaattccattcttaggcatttaccacaaagaagtgaaagcacatgctcacaaaaagattttataagaatatttatagaaaatgtgcatcaagagaaggaactgtcatagaaacaatctcatgtaattatacagtgaaattagtatgattaactgtcctggtttctttggggctgagaagttttctgggatgtgggactttcagtgctaaaactaggaaactcttgagcaaaccagaaggagttggtcattctaattatctacctcggcaatagaaagaccaaactactgaaatatccgacaacatggatgaagcagaaaacatgctgagtgaaaccacaagagttcatattctctggtcccatttatatgaagttcagaactaagttgtggtaaaaacagaagcagaagagtatacatttctgaggttttgggtgatgggaaggggtgtgagggactttctagagtgatgattatattctctgctttggtagagatttggctatactggtatacacatttatcaaaactcagtgaatggtaagttgaagtttctgcatatctgtatttaaaaatacctgtaaacaaatactgaactatagtcaatgacatgcataccaatgtgttaataatatgcatcctggagtgaggtgtaactcatcctttgtctggaatggaattactgaaaaagtggtgtaggtgtcagagatagaggaagggagaaagataccttgaggattgctcctgagtagaattgcctattatgactctattcattttaggaagattttctttaactttttgacaacagcttccatttgttttgttttgttttgttttgtaatcctgtactttgcttgaacaatcttaatttgttttctaaattagtgggcttctttcattgttatatgtatgtaatctagctgtaattttgttttattttattaatagcctcagtattattgattctttgctcttttctcacgacttttttagtttttatagtatttacaggtataagcagagtctttccctattatgtctttttagcagtcattttatttctctgtaaagttacttatgattattttaaaggaatggtaatgcttatagcattctaacttcttgatacctaatgtttctttaataatatagtacttttaaaattggatctggattggttttagattagcttttttattaacaacttttttggggattcacaaaaataaaaatgcacactgtagaaaattatagccttgactttagaaaattttagtcttgctagggtttatttattgtcacatatactttttgttatggtagtgagtaagctcaaaaaaggtactctttcaacatctttcaaggtatcttttatcttttagttcttcttatgtacctctaaaattgtggtgttcttataaagaaatcagttataataatcctcttaatcctaccaaacccatcatactcttctaagtatttttaataaactctttctatcctgcaattaaaattattattaattattaattattaatctgcctacaaacataacttcaaaaattcaacataattacccataatataaagaggaaataaaaggaaagtaattaacaaatatttcaatatgtaaattttgggacatgatgtactagtcagatgcttgttatctatacatagaaactgaatggggaacaaaaaaaaaaaaagaaactgaatgggaaactgaatgggacaactataaatacagattgttacaggggtattgtgttggtgccttacataccacacacagtattgttgtcagtttcatgattttctgaaatatttgaccattcttgataaagttctgaacaaaacaaaggaaaagttccctcagtttacatgatatatatgtgtctggaaatattggcatctgtttaaactatgcaaacataaatattatttatatataaaacaattaggttttggctcagatcattacaaacgggttttttaggtcttcatgaatatctaagatgatactggaaagttatgatggtcagaaaggaattctctcatgtggagaactctcctgaggattactgatcatctagcatcccccacccttgtgcgctaaatgccatcattgtgacaaccagaacataaactttcaaaacaccacattggtgttttttgcaatggggctctttggcaattgtgtcacctctccgaataatgtttgtaatgtttaagataaataggattaccaaggaaaccaattgttgaaatacaaaccccaggttacaaatccctgtaaaaaagatgatactacacttttctccagtacatatacttcaatagaatgtgagtactaaattgtgagtgaactaaattgtatggttttctatctggggaaacaattgaatccttggtattaaaatattatggatttgaacatgcatttgagtgcctatatcattttgttctcaacataatgacgtcattaagggactaacatcaactctttaatagaaagaagcaaataacataggagcttatttctattctaattttgtacctcattagaaattaagtgtatgaaatgaaataacgcttctatttcccattcttttcttattatgactaaactacttccctcattagtatcaattttgccaacttatttgctcatatattacttaagggagtaagataaccttggcaggacaaaatctccctccagctgccattaggaaagttgacaaattacttatttgtattaatagggtagtttaaacacaaattattccaagaataggcattgtaaagcaagataatcaagagtttatttcaataggtgctcactcagtattttctaagagtgcattgcaagaggtgactgtgttgtatctggataacagtttgtcatgacaaatgtgcagtttcatgatgatgagtttttatctcttctagggtatgtctctgtgccagactgttgtcgtaggctctgtagtcattcttctctactcttcaagagcatgttataatttagtggtgatcaccatatctcaggatacattagaaagtccatttaattatggctgggataatctttcagataaggtaagtagctaacttgtattgctaatcaaataatataataataaaattagccttaactaaggaaacattttaagtgtttgacttacaaacacttatctccagctactaacagtaatcataaagttctgtgctcaaaaatcctcatttacatgtgtcacttaaaatcattcttcagagagaacttctcccaaaggagtattttctttcttttctttctttctttctttctttctttctttctttctttctttctttctttctttctttctttctttctttctttccttctttctttctttctttctttctttctttctttctttctttctttctttcttctttctttctttctttctttctttctttctttctttctttctttctttctttctttctttcttttttgtagatgatactaatatttccataaacctattggtcatgaacctattttactaatttttcaaggatagtgtttaaatatctctagcttaggtagctcagtggttgagtgcctttggctcagggcctggtcccaaggtcctgggactgactcccgcatcaggctgcctgcggggaacctgcttctccctctgcctatgcctctgcctctctctctatgtctcttatgaataaataaataaaataaaaatatctctagataaatagattgcctgtcattagctagtgaatatgggtatgtttttaatttgtgaggatggagtttattctctcaaacccgagacctacatataacctaaatatttggtttggttttagatatttaagggatttttatgaaaattgtatattatcagtcatgataatgggagagcattcatagctccttgggtatccagctgtttgctgtagtaattcccagtattctatcatatttaacttcccagcattctccatccccttcctaagaagtgcagtttgacatagctacgtgtcatgtctttgtattaaactttgtactgactttaaggcattctggaatatcgttttatcagaatttcagttacctttctaaagaaaacagatttttcccccttctccaaggaaaggagttttctgtttttttttattttttatttatttatgatagtcacagagagagagagagagagagagagagagagagagagagaagcagagacacaggcagagggagaagcaggctccatgcaccgggagccggatgtgggattcgatcctggatctccaggatcacgccctaggccaaaggcaggcgccaaaccgctgcgccacctagggatcccggaaaggaattttcttatgtagttccaggtagcagattctcttcactccttttgccatttctctctcccaacatctagtagaataaaagcaaattcaatatgaagttgaggcccaaaagcatatgtttaaataacagcagagctgagcaacttaacatgtgtcatttctctacagatgtaactcagtaaatgctatgtagtatgttacctaagtagtagctagaaccagtagtttcttttttttaaatattttttttaaatttttatttatttatgatagagagagagagagaggcagagacacaggcagagggagaagcaggctccatgcaccgggagcccgatgtgggatttgatcccaggtctccaggatcgcgccctgggccaaagacaggcactaaaccgctgcgccacccagggatcccccagtagtttctttttaactgtctttagactatgcagcctaaaaatgagatcactccaacttattgatatattaaaatattttcataaattgatgattgaaaaagttaatagctttttattctatttaacatcaaagcatttttatgtcctttaaaggatatgaaaccactaaatatggaaaatgaatttagagatttatgtgcctatggttaatgtgttttaacttaccctacctgaggcaaattaattgtggcaggtgactgcttatacataaaacagatttaaaaattgctctatcatactctgtttacaggctcatatagaagacataagtggagaagagtatatagtatttggaatggtcctctttctatgggaacatgtgccagcatggtcagtggtactctttttccgggcgcagagattaaaccagaatttggtatgatatcataatattccccagtgcctgtttcccttatttttaaaaataatggaacattaaaaataataataatgaaacatttatgttgattttctcttttggggaaagtttaagactaaaaagcattatagatctcagcctcctttcttaaaaagtaaatcttcatatgttatctaatactttgttcacaggcacctgctggcatgataaatagtcacaattatagttccagagcttactttttcgacaatccaagacgatacgatagtgatgatgacttgccaagactgggaagttcaagagaaggaaggtagatatactagattagtactgaatagattggaaagaacaaatgtaagctttaacccaaatatgaaaaaaggggatttggtgacaaatgtcaataaataagatcacttaaactggattttagaaaagtagatgttacatccgtagtggggacctgtactataaagaattatcatctaactctaagcctatgcattacctttatttgagaaatacatttggacataaaatggtaccatctcatttcagaattccatgtttgttcaaagctggcagagcttggtgagcagggaaggaatacaattagcatgattatgtttccttatctatagtgctattcaaaacccactgagaaaccctacatgaaactctggggaagctgaggtgccacaggaaaacgtgtgtccttcttactctaaaaccattctcagttcatttggacagttacttagccgccttttttagcctgtttttcacttgtaaaatagtggtaatagaatttatctaataggattgttgtgaagtttaaataggtttgtgaagattatacacacacacacacacacacacacaaacatgtcttagaatacaacccagtccttagtaagcactatattattatctgataatcaagttctaagtcccgatgtatttattcttctgtactatgtcatataaaatcaaggatattaaagtcattacattttgtagaaagctattgtgttatttggcaaagaatgtatttcaatatatttgatataactgtattataaaagtcactgaacactaaacatgtcaatgtgacctatatcctgttcacaatcctgtggcttttttgccttttttgttgcagtttaccaaattcgcaaggtttgggctggtatggcaccatgactgggtgtggcaacaacagttacacagtctctccccacctgaatggacctgtgacagacactgctcctttgctctttacttgtagcaatttagatatgagcaatcaccatagcttgtatgtaacaccacaaaactgaaagcattaccaagccatgattcttccattgtttttcatgaacgtgtatattcaatgtgtttaaattccatctacattaacattccattatctgttgcaactgaaaacaaagcctagaaatgtggctgtgttcagcagaggacacacttgttatttttgacctcttcatagcaaaatgaagtaaaatgggaagtttggagtggaagaaaaggattgatggctgcaaacatcctgactttgaaacatcaaatgtgtatttgcatatttgcacttttatctttgttctgaaagagtacactgcagtccccaaagtcacactccagtgttcacactgggatactatattgtacacctaattaggaggcaattttcctatgaaaaatcaaagcctgtatattcagtggtatattctatgtagaattcctacccaataaaaattttagtgtgaacagtgcacaggattaaggttaacaatgtatcattcttttttaaaatctaaaaaacgtgtaatcattgaagacagttcttttaagcatgattttaagataccaactgaaattattcagtcatttttaaaagaccacagtaatcctttacagtgatgaccagcagtgttctttggaaagccacagccatttctacaagaagaaagtataccagtgaaaattatgtggctactttgagtagaattggtcaagtggttatttcatctgattaagatatctgtagtagtttaagcatgattcttcaagaaagcaatagtgatttttgcatagggagattttggtagaaacttcttgggactaaacaagtttacagatgtatttaagaattattcataaaatgtacaattctaagttaaaacataaatacatttcaaaagcattggatttagctgaacaagatatagctgattgtacctattgaatcaggattgtcctcaggtaaattaaatcatgatacattatggcagtaaactcaagtgcaatactttgtaagacatataattcctcctttagttttcccatttttatatcttatatatgggcaaagccagattaaatttaattcaaattaattccagcactaaataagcaaattgttgtaaaggtactaaataggtaagtataaatccactgtttaacaatattggaatacttctagaattatattaaaactgtcttgaatgtcctatcccaaatctaaaaatatatatatatatatatatggtaggctaaggtaataaaggatcttaaaatgcactttctaccagtgtctatatggaaagaagtagatgctgaatacctcaagatgccaaggaaacaggcaacattgggaagttgtcacatccttaaagatgagtagctacttaaaattgtctgctgacctatttcttcagaactgaactaatacaactgtccttttctgtcttctactttgattagaatgttttatttctactcttaaaatacctttcaatgaaaaaaataccattcaatgttttaataattgcttatttagtaacctcacacaagcgtaacaggaacaaatgaaattttaaatatttttggtcttttgagaggctggttcacagccaaagaaattccatctttttatcatacaaaatgactttgaactccatcagaagcataaacctatggttatatggttataaatgttactttgggtttgtttctaagttctctcattataaccaaattacagaagttaaccttgatatttacgtgacaaggtaacatgcacttaactgagtatattttgaggacaacttcagttattagatctttttagaatgccaactatttattttcctaataatgttgggtatctacctagaactatctgaaaagatgtattatctctgtgaatccttggggttcaaagtaaataaggtaaatttttctaaggccttcctaggtagcgttcctatttgaccagataagcaaagattacttttttaaaaaaaagattccaagtaaagtatcttggttctttcagctgcattagttgattcttccaaatttcagatttgtatatttattcttatcactgactagggtacctgaattcttgcatttgtctccttatacacatctcccacaatacatcaccaaagagaaagataagcttctggcccaatatttgcttaaaaattccaaagcactagaagcactttaagtttggtctcgaaaggagttgatgaaatcaaagggctaccgattccctgctcatcctgcactgaagcacatgatgacaatttcaaaccttttttcggttcattaattagaacagtgaatttcattgcttaagtgtgtaattctacagtgactagcagttcttgttttatcgtttcatttgggtggtcattaattttgaaactcttaccactcattatagctggttgtagttttatgaaaggtgtaatttatagctaaagtggcttttttatgcatagctgccttttttattgtttaacagtgtttctcagctatataatcagtttcaaactggttgtaaaagtatagctgtggccaatgaatgtatttatttgttgtttcactaaattgtaacaaaacactactgttaaaaataaaagtgtttgtgcttttatttggtggtctggttttcttaaatgtgtcaattgacaacactgagtttctagcacacaaggataagaaccctagtactaccaaagaaaggagaaaaatatcaggaattacaaatgagttagtgatcttgtatctggacatcacgtcccttaatactatacactgatttgacatgaactgccatacactttaaaatgcaataggatcttgatagtacatttattcaaacattaagctaagaaaaatctttgtatgaaataacttataacacctctctccttctccttgaattttaaacaggaataaatttagctagcccataatcttgggcagctattctttgattattcaagaaattcttcagtgatgttgctctttcccctgaaagaaggcttaccaatttttccataatagactcccacataacttgccaaaactacaccaaaaatttttttaaagattttatttattcatgagagacacagagagaggcagagacataggtagagggagaagcaggctccatgcagggagcccaatgtgggacttcaggatcatgccctgggcggaagggagacgctcaaccactgagtcacccaggcgttccaaaccacaccaaattttgaatgcaatttcagaaggagctttactgacctctcctggaagtccacaaatccttgggagtctattaattctttttgtaaggaatatttggagtgaaggtctgatctctaatgcaataaatttgtcatttgaaaagcagtttattcaacaaacatttattaagtgttcatctgccaaaaattatgctatggagatgcaaaaatggatcaagttccttttcctgcccttaaggagctcacattctaataaaggaggtttaaaagaaaatacagtacaatatgtgacacaatagaggtaggctgtaattacagtggtgacattaaagaggagattagagggtactccttgggtggaacaagggagatttcacagaggccaccttgatgctggcctgcaaggagaaatggaaacattccaggtaaggaaggatggctgggagcacatgatgcagagagagcagcatgcacccatgtgtggcaacctgaccccggcatatctgaagaattcagtgttttatcaaagcatgagggctgggcacagggctgggagacacacatcagtggaccttgttgaagtgcttctacaaagtctgctgtggcagcatcgtggggtgcaggagaggagacaggctggaatcagggaggcaggttagtgtagttttctagattaagagcaaagaaaaggaaggacagtaaagcattcaagatagggagatcaactccacagcgcttacacactgactggttagggaaggacaaagaggagtgagcctagagaatttagatgatggctctgaaattaaccagagtaagcaacacaggcataaaaacagatctagggggaaaagggttaagacacacaggtatctgtgggacaacagtaaagacgtggtaaacagattgagaaatacagactaatgataaggacttctaaaaaaaaaaaaaaaaaaaaaagaagataaggacttctatatcattgaattggaattacccaagagtgagaagtggtggtgatctagaacaagaatcaaaagtctaaggaatagcatttaaggcataaacgaaaagaggctaaaaaaggatgcatcaggagcccaggaatgacatataacgaacccaggggggaaaaaagatttttaaagaaggggctgccaaacaatatcaaatgcaggaaaaaaaaaaaaaagtcaagaaatggcttgtgaactgaactatgaatttagaattggaattttttacttcaaaagaagaaattgttaggaactacagagccaagagcaagatttctggttaaggagcaagtgggaggtgacaaaatgatgataggaatattctttcaaaaagattgacttaaaaaaagggtgagggcattacctgagagttagagaagcatacagacaaaattgccacgaaaacccttccaccacacgttcagagtactacaaatgtcctctaaacgtttacacatggtgcttacatcatagtcccttgagtctccaagaatattgacttaattagtaggtaatggtctttcttttcctgccttatccaaatgaggggaggagagagaaaatatgacacattctgttaaaaatagctctggagttattcatttaagagatactgaatatatattaatacattcattcaacaaatatttattggatacccaccatgtgcttactctgtacttggcactataccggattttagggacatagaaaagaaaaagcatacagcagtataaggtgatatttctaacctattatataaataaaccctgctttattaataatgcaacatctcaacatggtacacccactcaaatggatagagggcacatcattttgaagtatagtttttttatcatttctttcacaattaccatttgatcaaaattcttaaaccctttcaaatatttttatcattgaacttccactaatgaaaacctccaaaaattagtttatttttaaggagaaaaaaggaaatgaacctcatgtatgaaacacaaaaattctatgccctatgactatacagatcaagcattataaaggacaacaaactcaaaaaggactttatttacaccagaactcaaaatgattccttattctaaggctgacagtattatatagttcctttttttttttccagaggaaatcatttttaaaaaataatccagtatcacacactaaagtatctaaggttcaaagggcacgatacctggaactgactttcaaatgatttaggaaaaaataataaacacgtgtgtgtgtgtgtgtgtgtgtgtgtgtgtagagagagagaatgaaacgtaaagcaaatgtgaacaataagtgaatctgaatgaagagttctttctactatcctggaaacttttctgtaaatttaaaattatataaaaataaatttttccccaaattttattcagcattaggtaaagtatgagaataaatatataaatctatttaacctttcacgacgtttagaaatcccgtctttgagttgttattgtatctttctacacactgaaacaagccaatctaaatagcaatataaatttctcaaagtcatttatttcataccagtgtacttttaggttgccagataaaacacaggactcccagttaaatttgaattttaagtaagagacaatttctggtataagtatgtcccaaatattgcatgcaacatacttatagtaaaaaaattattcaatttgatatgatgagtactgggtgttatactatatgttgacaaattgaattcaaataaaaaaatgtaaaaaaaaacaaaaaaaaatattcattcaaatttaaatttaactgggcattatgtatttttatttactaaatctggcaaccataaatgtattgaaaactttcagattgataattatggattattcatgagcctccttagcattttcctattaaacgctcaatacactaaccatagatttatttatattacatcttctcacaagaaattcttgagagaattacatttacttagttttaacatatatgaatttgataatcctgattttattcaatattaaattttaaaatttatatcacatcatcaaaacattacttttactcacaataatattatacatagacttaacacaattaaaaaaaattgtttacttaaaacaatataattcttttataaaagaagctttatataaaatgtttggcttaagaatgtcattgctcttatgcctttgaatgaaattccactctttggccttcatagtccagaaacaggcatatttcaacttgttttccgttttcttcaatgaatattttgtaacaaattcctgaagttttctaattctttcacacttgtggaaattctgtaaccaaaaaaaaaatttctctcagaagatattttagataccttttgttattcaacactacgtttttagagcacagaaaattttcatgtaatttatttcaataaatttaaagatgcataaaccatttagtcaattttgatgtacttgagttcttaatttgacattgtaaaaccaagataatactgccctgaaattagttatttttaagtattcaaaacttagtattaaagctttaaaatacaggggtgcctggatggctcaatcagtttggcatctgcctttggctctggtcatgatcccagagtaccagggtcaagctccaagtagagtcaggctccctgctcagaggggagtcagcttttttctcaacctctgctcctcccccctgctcatgctctccccctcactctttcaaataaataaatctctttttaaaaaaattctaaaatgcagaattagaaattacataaatatatataaatctattcaatacttagtatatatactttagtatatataaatactcaatttatatatactaaatatatataaatctacttcaatacttaattaaaatacttaggtcatttttttttctttctttaagtaggctccacacccactgtggagtccaacacagggcttaaaatcatgaacctaggatcaagatctgagctgaaatcaagagtcaaacacttaaatgactgagctacccaggtgcctcaaaataataggtatttaaaggtttcacaattatagtcacatgcttaaagtacacaaatataaactacataggcattaaaatatgtactttaaatatgcataagttgaagcaccttggtggctcaggcagataagcatatgattcttgattttggttcaggtcatgagctgtgagtagggctcccacttagcaagagtctgcctgagactctttctccctctccttttgcccctccccctgctcatgcaggctctcactctaaaatacataaataaccaaaatctttaagtatgtataagtatacaaatattgaaaactaatcaatattccacatttagtaaatacacaaaaaataaaagcttttggactataaagagtaaaaatagtaaatgtgtgaccaaattatttttattactttttataaaaagtttgtcattattttaagtgtattttagttctactctccaccatgaaaaagtagcagaattctcaatcaactttatctgtcaagtttctgtgtgccagagaataattttaaaggtcaattattttacacccaaaatattatatcataatttttttaaagcaaagaaatgtagtccttagaaaatgttactttgtataaatctctgcattatttacatggtaggcaagaaagaaatatatctacacttaaattctgtaatgtaagttccttatttcaagtttatcttccaatcatttttatgaaaaaaaattagattttttaaagattttatttacttatttgagagagggggagggagggagagagagagcaagcatgcgtgcacacaagcaggggaaagggcagagggagaagtgggccctcccagccccggtggcgcggtggtttagcgccgcctgcagcccagggtgtgatcctggagacccgggatcgagtcccacatcaggctccctgcgtggtgcctgcttctccctctgcctgtgtctctgcctctctctctagctgtgtctctatgaataaataaataaaatctttaaaaaaaaaaaaaagaaattcagaagaagtgggccctccctccctcgctgagcaggaagccccatgaggggctagatcccaagaacctgggatcatgacctgagccaaaggcagacatctaaacaactgagccacccaggcacctcaaaaattcattatttttaaagtattattaactttttttatataacggtgaatttgcaaaggaattttatatgtatgcttatattaaacaacatgatttttccaggaccttcaaaaaatatgtgggcagcacaaaaaactacttttaaataattagaaaaaaatatacaaattcagcaagatgaatattgaagtccaatcagtaattagtcataattataaaaatcaatagatgaaagaataatacctaatgattgtgggtgtatacatacttaaagtatttcataaaatcacagaattctgtagtgagataatttcactaaataggatattccttacccagttttatctgagaatatatgacttgcattagacttacttggctaacaaaaacaatttcagtacattcaaactaaccttccaaatgcattaaataatgatactatttcttgtcgggttagatggaattcatagctgggcccactctctggcatatttgctatcagtttctcagaaaacaaaatcttcagagcagtacccaaaccctgaatctgtaacagaaataagaaaaaaaagaaaagtaagaaaattctttgcgcagagaataaatgaaaaattagaccaaactagatttgcttacctgaagctttccccatagtcgacatttaaaacaaccaacacaatccatgattctagaaatatttctaaaatgcagtcgaaagtcctcctaaaaacaatttaatgagatttttattaagatgtaccatatagtcaaacactaaatatttactgagcgtcttctatgtgcctagcactgtgcaagggatcttagagcgtatggaaaaaaaggaagagaattaaagtccacattcattgagcacttcctgcataccagaatctacatatacaatttcatttcatcttcaccacaaatccaaaagtagatgttattataatgaattaaaaacacaaggttcagagaggttaggttgcctaaattcccatatgtagtaaacagcaaacttagaccctggacctgcctgactcaaaaactgaactatctgcaaatatacacaaaagtaactgagctgaggtgttctgttttatgtgatcattaactacatgtgaatatcagaggaagggggtctggggtaggagagcatcatttaccaaaaaagaagaaaaaagaaaagagagaaagagggagagaagaggggagaaatttcaaaataggccttcataagagtaaagtcttgctttctggtattaattaggtaaaacaattagatatcttatggttattaatattctattataatattttcatttttaaatatatgcataattaatgttaccacatacatatatgcagaatatactgaacatccatgtacacttcaccaatctttagaaagaaagcattacaagtaccatggaagccctctatgtctctctccaaagtcctatatcctaccctctataattattctgaagttggtatttattgttctttttatacttttaatacatacgtatatatctatgaacactaaggtactgtgttgtttataattggacaaaatgaatccagctcatccaaaagtagtatatgtcctaaaggacaagtaaaagagaaagaagtcaagaacacatccttcttttactccaatggaaattattaattgatcctttaagttattccctctgtcctggacttatattggaatcccaagcttacagtatagtattctaagcaggaaatttgacattcaatcaggcattcatttgagagagagcatgcaagcaggggcaggaagagagcagaagggggaggagcagaagggaaggggagagaatatcaaacagactctgcactgacagtgaagccccatgcaggctccatcccatgaccctgaagtcatgacctgagccaaaaccgtaacagtcaaaagtcggacatctgactgaaccacccaggtggcccctgacatacacttctgaatgaaaatccattatactaatcagcctacaatttgagcaacatgtagcatttctctctctctttctctctctctctctctctctctctttctctttctctaatgtgataaaccacatactgggctcaatcataagagaacaggaccaaagatctaaaaaaaaaaaaaatgggaataaaccagcaaagattggtacccactattcaaagtagacctcaattccttttgggtattgttcttcccagatgctttattcagcttaagactctgaaacaggtgtattatataaaagattttaaataggatccccccaaaaataaattaattaaataataggatcccagattttgtatctttaatataaattttgtattaatttaatataaagcccaaattattaatattaattattatatgttaacaatacatcttgtgtttctgtatcttttggactgagttcagtaagaggtaatttgaattttaaaccaagttttaaaaaatatttatccagtaatattactctaagcaaattttggtgatttaaggattcttttaaacttgtatttcaagggatgcctgggtggctcagcggttgagcatctgcctttggctcagggcatggtccaagtctggggatcgagtcctgcatcaggctccctgcaaggagcctgcttctccctctgtctatatctctgtctgcctttctgtgtctcttatgaataaataaatatttttaaaaattaaaaattaaaaaaataaacttgtgtttcgacctggaattaaattttaaaaaaaggaaaaccacacttttaacaataacagcctagtaaaatcactctaaagtagatgttcccatcctatgaggtgctgacctttggaatatttaatagttattattaagtgcctaaaaaatccatatgtagacaagcattacatacagacagaataaataagtcacatgtatgcactataaatttccaaatgaatataaatgttatgatcaataaaacacatcttttacttaaaaagaattactaaatgcatagtggccttttggcaattatattttcacaatcaatagatactaaaaatactgtatcataggaagaggccttgaaagtttttgacttttagactctcattcatgtaaaagttggagacctctgttttaaaagattgtgcttgcttttgcagacattgtctaaattcagtatctggatctgtttgttaattcaaatccttgaatgtggcaagtcttgagtaaatctttgtctggcaatcacagagagtaagcatggttgcttatgatagccaaaataacactgcaaaatttaaaccaagtacttgtgtgtaggttaatttaatatttgagaccccaaaaataagctagtaatctactagatcagaacaggagaaaatatttatgacctccatagataatcaatgtccaataaccaaaatatatccctaaattatcctagattagaaaaatatatgaaccctaaagtaacctgaacctaagtcactttataaattctccttgttttatgtatgcagctttttttttaattttatttatttatttatttatgatagtcatacagagagagagagagagagagagagagagagaggcagaggcacaggcagagggaaaagcaggctccatgcaccgggagcgcgatgtgggattcgataccgggtctccaggatcgcgccctgggccaaaggcaggcaccaaaccgctgtgccacccagggatcccctgtatgcagccattaagtcaacacttaaagttacagtcagtgggtagaatgatcaaacatgctgtggttatatactgtaagttacattcagtgacaccaattgacaattctcacccattacttgtatgttttagaagccttcaagtgaggtcctactctatcttgaacactaaatagttctttcatactgtctatttctaaccgtacattgatactatataaagcaggcaaaacaagatcttttcagatacatctgaaactagtttaacaatctatgttaattataaaaaaataaaactcggagagcctggctggctcagtctgaaaagcgtgtgactcttgatctcagggttatgagtttgagccccacattgagtatagtgattacttaaataaaaataaaatttgtaaaagtttaaaaataaataaaactaaaagccataatgttcaccataaactacctttttttaaagaaagtaaatctctgatattaacaagttttcttgtttttttttttactttattataaaagaattcagaaaaattatctgttaaactccataggacatcaaagctgagtgtttcagagttttgataaaattaaaacattacgggaaatatttctaatctgcacgatataaaaagttttaatgccaaaacactttccaataatccagcaagtgtactaaaaataatgaaaagagtgaaaatagtagaaaaaaacaagtcttattacagtatcttccccctcacttccaagttcctggaagctgcctggaaggttatataagcactgaagtatgtatttctagcaaaaatgcttacagtaggagggaaatgggagattaaaaataactattatttaacagcaaaaaaaaaaaaatgaaaatgagtccaagaaacattgtttacaaactgcataaaatcaggttctttccttatagaaagaaactaagaatataaaacaggaatattgtgataaatattctgaagaaatcagatcaaacccagtgctcctgagagctccctgcctttacttacctatagctttgtaacagaatagtaataaaattttgagtccccaaataaactagaaatctactgagggtagtctcatcctttaatgacaagaattctgttttgctcatattgagtatttaaagagtctttctattattatatttgtaggattttgatgcaaatatacacaaagatggtcttgtatgagcttatacctctactaagagacaagataaataccaatccccattttgtagggcatcgtgtgttttcttttgctggcttcccatcccactgaataagatgaatgacaaacactgtaccctctccctctaaagaggatcctttaatttatccaaaaccattttcagaattctcctcaacaaaagacaaatactgccattcatgctctagatccatttcctttcatttataacacctattttttatgagaccatcaatgtgaaagccatctgttaggtgtgcagtgacagagttcagtcattactttgagcacaacataaactagatcttaagttggcctgcttttgggcttccttttttggaggaaaagaaagattatgactctggcttttaatttcctaatatataataagatttattgttaaccataaaaacatgggtttatattcatacctgcaaaagagtttgaatctaaaacttaagtaaaagtatgaaatatttaccttcagtttgtttgcttcctttttatccccagcaaaaaaggaattctcatcaaaatgcaaaggaaatgacctacatgttaaaacagagaagattcattttcaggtattataaaatattagaagtcccgctaagataacattttgctggttggtgatgaataatataatagaaagagtggaaaatatagtaaaatcaacactctgttgccccaaaacaaagtcttatccttaaatctaaaacaactgcataaaatagtagaagcttggccccaaatccaatgtattcaaccatgtatgaaaataatgcaggtaccaagtactactagaatgactcttaagactaaaaacttgtgccatttagtactgaagtctaaacaaaaacaaaactcaattctaaaagacctacaagcaaaattagcttttaactatttattttttaataattttcttttctcggggcacctgggtgattcagtcagttcagtgcttgtcttcagttcaggtcatgatctctgggtcccaggattgagccctgcattggctccctgctcagtggggaatctgcttctccctctccctctgtcttttcccccactcgtgctctctctctcgctctataaataaataaaatctaaaaaaaaaaaaatgttttttcctttctctaaattgaacatttaagaattgaactttggataccacttgtcactcttctattaatgtctaagttgtataagttgtaatatgtaatttacttgatttcatgaagtatttccagaagtagcattttgttttctgcgtcgtgaactttatttccagtgaagagttgaaaatctgggcgttcgaagaatggtaccactttagataaagcccttaattctattaagtagagaaagtacaagttcttgagccgtcttggaccttctccctcagtcaaaatgccatcaaatcgctgctgaaattctgtaatgttgtgtccccatttcttttccaaccaagtttctaagaagtaagaagaattatatattaaaatctgaattttaaagtttcagtttacttacattgggttatttatgcctacagaagttagttttatcttctagaacccacccttagaaggaaaataaattcactattttactgagatttatgatttcacaaaaatcaaatttctgaatataaacatctttataaaaccaagatacacaatttaaaaatgactgtctgaattactgataagtttgaagttagtgtgttttgttcctgaggcatagagatattttaaattccagaagaaataggttactgatgaaaattaaccatggtcttgttttgcaacagcatttttaaagcattaagagcagcagaaagtgcttttacccattaaactccaggcctgaagctggcacacaaataaaagggttttaatacagtagtacctgatgaataacaaactgtactattaggagctattttaactccaacaaaacaagaggatatttccaaaatgatgtgcacaattttgagcagcttaaaagaaggtaaacagagttaagatcatgctgaatgtgtccttataaaatctatagttcccacattcctgattactactatttaagaatgaatttttactacctaatattcaagagagtcaaccttatcccactaaggtaaatgccaaaaaattttaagaatttctgaaaataagtatggtgaaataaataaaagtaaatgtcacataccttgtagaagataccgcgcactcaaatgcacattaatgcttgcatgcaggccagatataagtctgtagaatgctcttttttctacacacaggcctaaaaaaaagcaatttggtaatagaaattttatatgtgaaacttgtaccattacacaattaatttcataggttttatagatgagaaaaatttttaacatttaaatttgtttaaaagcttccaaaaaaaaagcttccaattaccttctagccaactgtaaaaggtgttctctgaaattaaaagaaacataagtcacaaagttgtaaaaatgccaaaatgtaagtttttcaatatataatacccaatttgtgccaaacagcgatttaacaattaatgaaaggtccaaattttatctgcaatttatccaaaggaaagagattttcttggtgtagattcaattaagtaccattctcttgctcagtctctagaaagtttcagcactgcctttggtagcttcagtctcataactttctagataaaatgtttcatatgaggtcagaacacagaatttaaataataaatcaatgcaaggaaaactacttagccttgaaaattaaggacttagctatgaaaattaaggactcattattatgcttttctaacttgtgaaagtaaataaaaattataaaatagagttgatggtatattatttgcacatagctcatactatttcatgccattcaatatttcaaaggagcaataccaaggaaatgttacaaaactaaataccacttatattctatgacccaaaaagatcacttttcatatgtttagacctgataactctgcttttagaattatgttctaaagaaataattcaaatggtgaaggagtcaataatgtgtacaatgatgattatattatatataattattaagacctgaaataataaaaatgtacaataaatgtctaagttaacacaataggatactatataactaggtaacatggtagaataatataaaactatttaaaataaaaaatgtggaacatgacaatacatgaaaatgtttatttgagataacgtataaaaaggcatagaaatagttttcatacctaggtaaaaattctatgtatgcatttacaagagacgaaaaattatacagttcttttgactaaagttgcttataataatattaacaattaattaaacaagcataaaagtaataaaaggaatggcaaagagaatacacagtaaatcagactatctaaaaacttaaaacacctgtcagaaaacctcacgagtgaaagtaaaaggtaaacaaccaagtaggttgaatgtacgtcacaaaaacaacaaagggataacattctttttctttaaaagattttgtttatttgagggagagggaggggcaggaggagaaacagagtccccactgagcacagagcctaagggctcaatcccaggaccctgagatcctgacctaagccaaagacagctgcttaaccaatggagccagccaggagccccaaagggataatattctaaatatataaaaagctcataaactgaaaaagtgctaaagtacccatttaaaatggacaaataatatagaaatagagaattcaaaggaaaaactacaaatggtaagaacataaaaatcactgtttcactagtaataaaaaatccaaattacaacaatagagataccacttttaaaagtaaagataaaaatatgacaatacttaatgctgacaagggtcaggtaaaactattggtcaggcacactgactggaagggatgtaaattagcacatgctttcaatgacaaaatgcaatctggtatatgtatcaggaacctaaaatgtctgtaaccttggatccagcaaatccatttctagaaatcgaggctattatggataaaattcatatgttgaagctctatctccccaagaaatagtatttggaggtgagacccttgagatatgattaggtttagatgaggtcatgagggtaggggtgtcatgatgggattagtgtcctttataggcagaagaagaaaccacagctcgttctcagccgctgaggacacagtgaaaaagctggctacctgcaagccaggaagagagcccttatgaagaatcaaatctgctggcaaccctgatctcagacttcccagcctctagaactgtgagaaaataaacatcttattcaagtcacccagtctatggtattttgttagagcagcctgagctaagacataggctaaggaagcaagcagacatgggaataataatacacaaagatataaatatatccagtataaaaatatacgtaaataaataattatcaaaatgtcaacagagaagcagtctgagtaaccaagagcacggattttttttttttttaagagttttagattttgtttattcaagacagagagaaagagagaacatgagtggaaggagaggggcaaagggagagggaaagcaaaaagcaggctccttgttcagtggggagcctgatgtgaggctcaattccagacctcgggctcatgacctgaacagaaaatagacgtttaaccgactgagccacccaggtatcccaagagcatggaccttggagccaaactgactaatttcaattgcagctgtgctacttacaagtcatacatgatttagctgagttgctaaaccctctggcactcactttcttgtctataaaatggagataaatgtaatacctcctaagaatgtcggaagaattaaatgaaaccctatttgtaaactgcttaaaaaagtactggcatgtagtcttagccattgccattatcaattattttggggttgtgggattacaaatgatttctttccttataaaaaccttcagagttgggtggtgcagtcaactaagtgttcaacacttggtttcagctcaggtctgatctcagggtcatgagattgagcacagattcaggctacacattcagtgcagagtctgctcttttaagaatctttctccctctctctctgcccctgcctgctacacatacaaactctctctctctcgcttcctctctctctcaaataaataaatcttcaaaggtgtttggtttttttttttttttcaagtttaggaccatgaattacagggaatgggagtataatactacttgggacctagctttccaatgaaattttcagttctgtctgtttctgaagtagctatgctcaacttgacatggctatgatccaattagataatcacctaatatgacagctgtcagggataactcttaaattttactcaaatgaaaacctataaatatactcataaacaagatagtttctctaaggatagcctctagaagttaacaatctcttctctgagacaggatgtttttaaatagtattaaaaaactgaaataacagcctctaacataactaggaatacccaaggtagaataaaatctctcaaaaactgaaaattatagggaggagggggaaaaaataaaacccctgaaaattataggatcactactaacagtaatatgaggtatctttggaagaacaatgttttttttattaagattttatttatttattcatgagagacacacagacagaggcagacacataggcagagggagaagcaggctccccacagggaacctactgcaggactcgatcccaggaccccaggattatgacctgagccaaaggcagatgctcaaggtaagccatccaggtgccactggaagaacaatcttatgctaaagaatttctcttccaaatagtacagttcttttttttttaatttttatttatttatgatagtcacagagagagaaagagagagaggcagagaataggcagagggagaagcaggctccatgcaccgggagcccgacgtgggactcgatcccgggtctccaggatcgcgccctgggccaaaggcaggcgccaaaccgctgcgccacccagggatcccccaaatagtatagttctgattcagatacagttctgatttatttagctgttattgttattataatataaagtacaataaaaaagagagcaatattataagacattggtattctattacttaggcagaatacaaaagcaatttgtaaaactaatgttcagaaaaccgaattctgaaggagaggaaattgatacttcacattttagcaatttcatctagctggactaaagctaagtactgctttgtcttttcatatgcttaaacacgtggccttaagaataagaaaaatcaggcagccccagtggcccagggttttgcgccaccttcagcccagggcatgatcctggagacccgggattgcgtcccacatcaggctccctgcatggagcctgcttctccctctgcctgtatctctgcccctctctctctctctctctctctctctgtcaatgaataaataaataaatcttaaaaaaaaataagaaaaatcatttcaatctcattcacaaggcaaaaagattctcacaaagacagagtaaacctaaaatatgttaaacattttagcatcacaactaaaagagttggcaataactacccctaagagctagcataagccttggaagccagtagagcaacactgaccatgcctagaaacttcctatagggacccaacagatcccagaggtctgtctggcagtaaaggagagtgagttttccctgacagaagctggagggaaatgcctagctttggcgagcagtgggtaaaatgcaagagtaaattatcggaggctgaggcaggttgtcactactgcctgagcccaggcagagtcattttcccttaacctatgctttcaactcctgaattttcaataaatatgagctctcagaagcagaagaaaagtctgccaaatacaattctgaatgtatcagcaaattcatatatataatataaagaaattatatttaccttcacttttccctgaaaaacaaaacaaaatatttattattataatgtccttccagatgtcactttaaaatgctataattgcataaaaataagattttgactaactggttagttttaatcactcagttcactcacataagcaaaatctgagagagttactcatgacacaactctatctagtggcagtaggaattatgcctgattcgcttcaagggcatcatctccaagagcgtggataaggagtggtttcagcttgtacaagatttaatatgggctgacaggggagaaaaatctaatctatcatctgagaatactctcaagtatcttaaggacttacagttatttggctggcagagcctttttccacatttatttaccctaaatttataacaccgtttctgctaaagatttgtgttcttgctttgaaaactccagacggacactgtaaaattttacttgattcaggaattttacctgattcaggaatatttttagagactatttgttaagattcaaattatgcacagttcagcaattagtaagcagctgctcatttactattaaaaaactgtcttcattttgcccacacttatttaatgccatcattgtttattaaaataacatatgctcattgcaaatacacattttgaaaaaaaagaggacacagacaaaattaaaaatgtcatccataactccctctgcccaaataataaataccatttacattttgataaatgtcctttttctttgcatatagatatttagatattatattatgtatgtttttacaaaaatatattgtacatactgtttgagacctgtttcccttcttcaatgtgctattggtcattcctgacctaaatgaataagttttcagcagtatttctgatggctgtattctattacatgaatacaccaaaaatcatttcaccagttccttaatgataaacatttaaattattcccatttatctttatgataagtgagagtggttaattaatcagatcaaaatgtgcatccatacagaggatcacccctctgtttggaactgacattcatctgatattaaatcaatagcttccaatgagttaccatatgtgactcatataaacccaagtccttgtttaaagttgttcttttatttctaatctaagaaagacttgtctgccaacattaagggaatgatgcaatctcaatgctttccaggaggaaatttatgtttattgactatatgagatcagcagcttttcaaataaattttaaaagtgaaaaacttacacatttcctaaaagcacatcaaagatttcatcattaagcacatattatgggaacagggatgtatatttcctaagcaaaaagtttgaaatcatatactgaaatgctgagttccaatttcacatctcctctgcaactacacagtgcctagcacatagtaaatggaaggtaatcatctattgaaggaacaagtgatctttacaattgtaggcaagaccattaaatgaggagagcagttttcatcaatctttcatttaacaaactactccatctgttatgtgtcaggctctctattaagaaatgaaacaaacactctccatatgcccaaactaatagggtagatcaatatatcatagtaaaataacaccagacaatggaaaggtagtaagagaaataaaatatgacataagatcattttataagaagagaggggttacttccagttaggagagtcagggaaggtgaaaaaggcagcatttggggcaatacctcaagtgtgaggagaaaatgaaaaatgttaataaaacataaagacgggaatttgaagtcagactctcaatatgtataatcatcttaggatctgatttgaggcaaaagtttttttggatattcatttagctacaaaatgattaaaaatagtaaaaaaataaacacagatattatgtaaaaatgctcagaagaataaatatttaccaaatctccacttatgacaacctaataccatgaacttcattacacaaatactccttactgacgtataaatattttaaacaccaagttctctgtaagggtgaggcataacttctatggaaacaggaatatgtgatctcaactgctcttgccaacccttatatggccttcctccttcttctaaccaaagttcactgactgataaataatataacagtgcaaataaataactcaccttgaccagaagccaaaggatttaaaggtcttttaattgtctgtggcctagaaacaaaagaattgtaaaatataattacattacctatcatgttacaattatctaagtaaaagcgaaattatctcagagagttgcttaatgactacatccaaaatcaaactgttttattgagctataaaatatttagttttctctaattgctttaagggatggtggtcattagttattttagcaattgtttctgcttttttcccatttagcaccagaaagtcatttcctaaacacttcttcaaacaaaggaagaaaataccaggtaagctcttctagagtcactaatgtttttacatatattacatacatatatgtgtgcctacacaagtgtatacatatatgtttgtgtgtggcacaaagtacattcctgactgaaagacaaacaaaaaatataaatactgaactcaagcattaaaatataaaggggaaaaaacactgtgggtagattattttccacttagttaatcttaggtacatcaaatagccctgcagccaccaagtttgttatgatttcaataaaaggtatttttatcatacaaaaaaaaagttaaaatgtcattaaagtgcttttaaatctcagaatgaatattcattagtatcattagtaaagtggagggattgctttatctgcaatttaaattttacaaactcgcacaaattgagacattttgagaagagaatatgtaagctatattttaacattctcaatttagtgcgtgtattgtttatattttagaaatatttatactgggaatcatgttataaattagttaagaaataaccacaatacaaatataaaatctaacaaatgcttcctaactctattttagttaaaaaaaaaaaaaaaaaaaaaaaaaaaaaaaaaaaaaaccctttgggggcatctggctggctcagtcagtaaagcatgcaactctagatctcagggctgcaagttagagccccaagttgggtgtagagattaattaaaaataaaatctaaaacaaaacaaaacctttaaagtgagccaattaaatcaaacattcctaataataaacaagggaatttaaatgaaacacatggcaaaattagtaaatactggaaattctccacttcaaaactgaagaaattctttaagttataaaaagaaacagactgacattttattggtattctgctaatctcttatatttgacttatacaaagtgaaatgtattattaccatatctaggaattccaaagattttcccagaattcccccatctctgagatagtataaagcaaacacacacacaaattctttccaaaaatcaataagcgcattgtttagaggtcactggcttacaagtgggtaaacttgaagcatgtcccagaggcatagtgattaaaatgactatttcctttgtagtggttaagagtacaaagtgggttcttccacttactagattttgagacttgaaaaatcatttaccttttccaagtctcagtttccccatccgtaaacagtgtgactacaacacagggctattgcagggattaaaagagaaaatgtacatatatgcttagcactagtctggcacactgtgaatgttcaagtgttacctattataattattctctgaaattaatttaacttgagtttgaaagcagataaaataattatagccacaaaaagatgaatacaaagcaccaaaaagaattaggatgaccttgggaaatgaagtaaacctggctggctcttggttacttcatctataaaatgagattctataatccactgaaggaacatttgtgaaatgtccaacaatactcctgtaatagtcttatactattctgtcttttaaagaagaaaaaaaatatttgttgaaacacacgtccacatgtttctccagaggagaactggattaatgaataagtatgtttccatgtccaaatacatcttttaacaatgtgaatgtgatttgcagtttaaagtcattataatttgtttatttgtttataaagaaaaatcactatatccatcaggattttctaaatgaaaatgacacatacttaaaacagttttcttcatagatgacattccaaatcttccaagcatctggtcccttgtaacctgtgtagcgctcaggattaaggagtaaatctacatattcagcatcaggagactgtatgtctataaaataaaatgtttcattaaatattttctgcaattaccttgaaaaactagtataataaactaaattccacgatcctaaggcaccataaatgtcacagtgtatccaaattttaaaaataaccttttggggtgtcaggggtagctcagttggttggatagctgcctttagctcaggtcatgatcctgcagtcctgggatagagccccacatggggctccttgctcagtggggagcctgcttctccctttcctccctcctatctgctgtgcagtctccctctctttctctttctcttgctctcaaataaaatcttaaaaaaaaaaaaaaaaaccttttacaagaaagaaaagaggaaaacacaaacagtcacattaatgtactcactggttacaaagcatcctgcctttaaaaatggtaaaaaaaaaataggaatacatgaattttagaattgaaaaaacatggtaattaaattttcataagctatccagatgaaaaatatactctatatctccctccacattaaccacaagcggctcatcaataactaaggtaaatgaagatgtgttactaccaaatactattatcaaaaacttccttcttacatgaccaccatgaagatccactacaaagctgtcccaaaagtataatcctagacatgcaaaaagttataagcaggatgatccttacatcagcattatttattaaagagaaaatcagaagcaacccaaccatccaatagagcagaacacaggctctggagccaaagtgcctggttacaatccaagccctactactcattcagtgtcgaacccaaggcaaattatatatgttctttatgcattggtgctgtcatttataaaatggagataatactcggtgttactgtgagacttaagtttatacgtgcaaagtacttagaacaatgctaagagtatgatacatattagctagtgatattgtgatatatcttaacacaccatgttacaatcaacaaaactgctaagtacaaaggctatctaataaaatgaaaaataagcattacagaagtcaattacagatagaaatgaaaaacaacaaaaattggtgagatattagtttctcatatgttctataaatttgtgtaatgtattgtaactttgaaacaaaaaaaatggcccctcattccccaggggctttgggaaattattcaatatacagtaatactataaattatttaatgagtaattactcatgtataaagcctaacaacatgaacaaaaaaatgaaaaagtgggcaaaaatggcctcaaagcaaccaaagtagatgacaaaaatctgagcacacaggtgcttataagaaggcccatcaagctctcaacagtacctacttcttattaaaaacacaataaaaaaatataaacaagcttggttatttttatcccaattgacagtacattagagactttttaggaatttttgcttctaaaagtagcacagtgacagcatctagaaataactgagagtccatgcagaagcggcaattaaaataattagaaaaagtagaaataaaaacttagaaaagggacacatagcgggttcagtcagtagaacatgtgactcccaatcttggggttgttagtttaagccccacgttgggtgtagagattatttaaagaaaaaaaaaaaaattaaaacaaatttacctggaatcctctggttcaagaacagagatacttctgttcatctcaactaatactaaaagtattgccaaagtacagcaaattatgatacattcataaaaataatcctcattttaaaaacatgagtaatgctcagcatctagtacttttaagacagaaaactaccaagaaatgactaaagtttttatattatgtctaattagacataaatattagttgactcataattttacttataacaaatacttcatctcacctcaaatttttaataaaaaataattaatataaccatattttgccagatgacaaaagctcaaatttctaaattaaaatttataaaatatcttctgtcttctacctaccatttatacacattatatcttttttataaagctatcctttttttttcatcctcctgtagcagaagaaacaaatatgaatggataagtgattcatccaagataacagaattccatcagataacaattattgatgttcactccttgctacacaaacataagcagatagtttcaaaagcatactttgctaaatgaagttaaagcattactgttcttaacactacagaaaaacgcatgttttaaatttaatttcctttttttaattagaaaaattatttatttctgctcctttcatacatcttattgtgcagaaacagtctcacacatatctgaataatgtactgtcacactgtttaaaggcaaagcaccataggtaaagctgatcagagttctcagcttatgggatcttgcttcctgattttacattaatttttgaaagttagaaatgtcatctccacaaaatgttaagggggctgtaagaaataatcactttattcaatattatagttgtggaaatgggagtatactttctttaagaaatgaaaaactaagaagaaaattccactaaatatcattggtgtgtcagtacaggtcagcaggagaaatactgtgagaagtttgtctctgataccaagaagacattctagctcaagctttaatatgattcctatttctcacgagatgcttcttttctgctgcttcactctttttccatacttcacatcagaggattggttacagcctttaaaacttcattaacaggagcaaatccaatatccacggatttcttgtcaaaaggcattttttaacccatcaggtagcccagcagtttcattctcatgaatactctagccatgaaaaaactcaataggacacagacgaatccaattaatacaagaagaaatctattgagttttggaatgtttggtgcattcgattggtccaggattatgaaacctaaacctcccattgtaaacaggaagctggatgcaagtccttccataatatattgtccatttactctgtaggccaagaaagctactggtctctgatgtccatgttcatcagtcatagaacaaacacttggaggttcaacaataacatcataaattattcctccagtgatgaggaagtaagacaccactaccaaagtaagacaccaccaccgtcatggccgacggcatgtgtaccagggcagctccttcagcttcaggttggggcattcgagcactaagaacgggacgcggtacaaggtctccatgttgttggcagcaggggtttctctctccttaattttatttcaatagtaatgtttaggccaaagaatctttgtggacaagacagtaaggtttagaggttgggagatcattttatcctccctcctttcctagtctaaaccttagtgtaagtccacaactccttatccaacatccctggggtcaaatgtgttttggaattcagaacttttcagatttcagaaaagtactataatatatgcaacatgtactgaatattactccaagagagactggggcagcaactcttaattataataccaaaaatacttctgtagtgaaacatgtgcatactcatactaaatgagtctgtgctagacttgggaaaatattcattttcagattttagaattagaaataaaggattataaatattatttgccaaggcataatcatgttttacactaaggaaagcatgtttctttttttttttttttttttttttttcaaaatgaaaccacagagttaaaaataagtactttcccttagccttcctcttttcagggggaattgcaggatttgtctcttgcttgcaattaaaatgatctgtatcattctttttgctaatttttttttaaagatcattaatctgcttcaaaagagccactgaaggataccaaaactcaatttgatttgggtttgtttagccaattaaaaggctaacaattcaacttagaaaaaggaagaatgggagaatctataaatctgattaaagggttctaataggtcctttaatttggatatgtaacaatccaaggccagtacaacaaaagcaagcttttgcaatctaaatatctacatttgaactctttatgcaaaatgcctgtgtatattacaaaattttatatatgtatatatgtttatatatatatgtatgtttataaatatgtatatatgtatctatgtttacgtgtttatatatgtatatatgtgtgtgtatatatatgtatatgtatgtatatatatatatacacacactactaagatacacagggggtcaattttttccagaaactgagggtttggttttctttctttttttttttttttttaactgcggaaaaacgtatataacgtaaaacttactattttaaccaggtttaagaatacaattcagtgacattaattatattcaggacattgtgcaaccatcaccactaactgtttccaaacttttctatgttctcaaactgaaactctgtaaccattaaaaattaacaccccattctccccttctgctaacctctagttactctgtctctatcaccttgcctattccagatattttatataaatggaatcatacaatggttgtccttttgtgtctgatttctttttttaaagattgtatttatttattagagagagagagagagagagagaacctgcacaagctgaaaaagaggaagagggagaagcagatgcctgctaagcagggagcccaatgtggggcttgatccggggagacgctgggatcatgacctgagcagaaggcaaacatttaactaactgagctacccaggcaccccctggcttatttcatttagcatagtatttccaagatttatccatgttgcaggatatatcaaaactctgtttctttttatggctaaataatgttcccgtatatgtatttattatactctgtttatccattcatttgttgatggatatttgggtcatttctacctttcagctattgtgaatgatgccaccatgaatatggctatacaagtaagtatctgttcccccaccttcaatcttttttggcacatatttaggagttgaattgttaggtaacatggtaattttgtctttaacttttgaggatctttagaaatggagttccagaaactgttttaaaatattttttttcttagacccaattttaaaatgcccacaataaaaaatgttattaccatcagcttcacagaagttgtctgaggaatcatcatgcttggtccactgaagaacagccttctgtgtttcctcacttcaaataacgaaaaaaggtacccttttttaagtaaacatttcacaagaaaaaaaacaaatactactgcaaaaaaaaattaattaaccttagagattcatccacagctccaagtcgttcagcttgttcacattcttcaatgaggttattggctacctcagaatactaaaaggaaaggagaataagcagattacaatttagtgcatttttaagactttttaaaagaatttcagggtgttattctgtatgttggtaaattgaacaccaataaaaaattaatttattaaaaaaaaagaatttcaaaattattcaaagttcttttaaggggcacctgggtggctcagttggttaagcatctgcctttggctcaggtcgtgaccccagaattcctggataaagccccatactgggctccctgctcagcagggagtctgcttctcccactgcccctcaccctgctattgctctctctcactcactctctctgtctctcaaaaaaatgaataaaatcttcaaaaataaaaaagttcttttatatctatactatttccttagcttcaaaacttaaaaaaaaaaaaaaaatcaacatcactaaacatctcccctgaagctaaaacaaaacaaaacaaaacaaacataaaaggctttgcttttgttgttgaacacatttgccacatggtcacaaaataaagaatgtacttctgataactcattaccaagctgttcaccaagaaaatcaaaggtctaaggaatactaggcatcatgaggtaatgtcccacttttttttatttttccatgccagtgtggagcacaacatagggcttaaattcacaaccctgagatcatgacctgagctgagatcaagagtcagacgcttaactaactgagccaccaaggcaccccaatgttccacttttctaatggcctaattgtaagcatcagtcagtcttcccttccataagtaagtggttggaccagatgatgtgtgcccaggtctatctcaactctatatgccatgattctatatatgctctggaactcatcaagtcttataaaaaagtattccaatatctttaggtgtttaaaatatgttctttagcaatcacctttcttctcaatgtctaagacacacacacacacacacacacacacacacacactattctgctaggcatgtgtctggcacaggggaagtaaatgcagatcctaagatttcacaacacattagtcatcaccaccaaagggctaaaagataacatcagaagcagaaggcacagattcaatcactcaacaaatatttattgagtgctcttattgttctgatgaccacactaatgactgcccagcctatgacacttctgaggataaaagagaacactaaaactgagacaattttttgaaatgtttattgaataacaactttgtttcgttacattggttgacctataaggcagctcaatttgaacactattttcaaaaataaaattctttctacataattattaaggggtaaaggggatatgatatattcaatctactctcaaatggttctgaaaataatatatacatagatataggatgataacacaaatgaggcataatattaaaaactagtgaattgtacagtacacaagaggtgtttatactaatcttgcaacttttctataagctgttaattagctcaaaataaaaagttaaaatacacatcaaaaaatgaacaaaatttgggatccctgggtggcgcagaggtttagcgcctgcctttggcccagggcacgatcctgaagacccaggatcgaatcccaggtcaggctcccggtgcatggagcctgattctctctctgcctatgtctctgcctctctctctctctctctctgtgtgtgtgtgtgtgtgactatcataaaaaaaaaaaaaaaacaaaacaaaatttgctcaaaaagcaacatatctatattaaaaaaaattaaaatccttatcagaattatctaaatattaaaacagaagttgggacatctgagtggctcagtggttgagcatctgcctttgcctcagggtgtgatcccggggtcttgggattgagtcccacatcaggctccctgcatggagcctgcttctcctgctgcctatgtctctgcctctctctctctgtgtctctcatgaataaataaaatcttaaaaataaattaattaaataaaacaagttaaccatattttttttactattcttagtttttaacaatttaatcagttttgttaagtcacaaatgtcttgatttaaagatttttttttaatttattcattcatcagcgacacagaggcagagacgtaggcagaggaagaagcaggctccacccagggagcctgatgcaggactggatcccacggccccagaatcacaacctgacctgaaggctcaaccatttagccacccaggtgccccagaggtcttgattttaaatcattggcattttcctgagaaaaaaaaattttttctaatttatcatttttaattttttcataaaactgctcataatcttcaaagttaatttttatggctagtcaacttgaaatcattaccctagattaactcttctctgtagatacaatttttaattgagaaaaatattctctctacaggtataaatacgtgaaaatattttaaatcaagtattttcacaaggtctattcttttgccttcaaagtatgtttcttcactaaacattttaagacaaaactcatcaaataatgtttctcttttttgttattttaaatgttttgccaaatatagatgctacaaaattataagccttatttcattccatttcagatgagaatttaaatttatccaattaaaaacaagagtttcatcaagaagagactgggacgcctgggtggctcagtggttaagtgtctgcctttggctcagcgtgtgatgctggggtcctgggatggagccccacatcgggctccctgcatggagcctgcttttccctctgcctgtgtctctgtctcaaataaataaataaataaataaataaataaataaataaataaatatcttttaaaaaaaaaaaaaaaaagaagaagaaactcttcctacaagaggagatactccaaaaacaattataaaatcccacaattaaagcttaaatattatttgaactttccccacttaatgtattcaatccctccctagcttttgtaggaataaatttcgacatctttattttttttttaatttttatttatttatgatagttacagagagagagagaggcagacacacaggcagagagagggagaagcaggctccatacaccaggagcccgacgtgggactcgatcccaggtctccgggatcacgccctgggccaaaggcaggcgccaaaccgctgcgccacccagggatcccgacatctttgtttaaaagctttgttataataactgcaatttgctaacccttcaaaagctaagaacttttttctttaagcattccattcatcgatactttgaataatgactttccactgattttaaacatattgcaattgacatttcgagatctcacatattaaaaattggttaataccactgaaggactcttgggttgtttccaaaggctcaaatatttataaaatctgattgatgatgcacagctaagaaagtctatgcttcctgtctataccaaagtaatatttattccaggattagtttcacctcaaaaattttatggtcattaagtgtctatctaaatataaaaacctgtatattttgacaattatcactttttttaaagattttatttattcatgacagagagagagaaagagagagaaagagagaggcagagacacaggcagagggagaagcagactccatgcagggagcctgacgtgggactagatcccaggtctccgatcacacctcagactgaaggcggcactaaaccgctaggccatcggggctgccccaacaattaccacttctttttaagatgtatgtatttatttatttatttgagagagagcacaagcaggggagcagcagagggagaaggagaagcagctcccattgattagggagcctgatgtgggactcgatcccagaatcgaatgggatgacacaagccaaaggcagacacccaaccaactgagccacccaggagccccaccacttctatcttatttggtaaaatatcacagcatgtttggacacaattatgaattatatcttttttttttaagattttatttttagatgatctctacaccaatgtggggcttgaacacacaatcccgagattaagagtcacatgctctactatctgaaccagccaggtgcccttgaattatgtatatattagccaactacaaattcatttctgctccacagatttcttggtttaatcagaattgtttttaccaaaatttgtatattatcaccacaaaacaaatattttgtcttcaattttgagctttaaatgaatttataattgcatcgacaatggggacaaatgttttccctcaatagaatgaaattccaaaagttttgagtccatcaaattaattttaaaaatctaacaaattttggaattaaatgactttctacttaaaacagccaataatggcatcactgaactatgtgcaaagttctgccactgaagccaatacattaatagctatgacttcattctttgtatgcaaacaagaaaacatggaatcaaaatgagcaaattattttagacctatagtggaaaaagtgaatagtggttgccccaaggggaaaaagaaattgattgggatagggtatcaagtgactttccagggtaatggtaatgttctctctattgtaacagaagtatagattacacagggatatacatttagcaaatgcacacttaagatttgtgcatcttgggacgcctgggtggctcagcggttgagcatctgcctgtggctcagggcatgatagcggggtcctgggatcaagccctgcatcgggctccctgcatggagcctgcttctccttctgcctttatctctgcctctctctctctctctgtctctcatgaataaataactacaatcttaaaaaaaaaaaaaaaaaaaaaaagattttgtgcatctcattgtatgttaattttataaaaatacattataagtaatactggactctacttaatgatatacttctagttgtgtgtgtatgtttgtgtgtgtgtgtatatatatatatatatatatatatacacacacacacagttgatgacacatttagggcaatgtgtactgatgcttgcaatttactttgaagtacatccagaaaataatctttttaccgtataactagaaagatggacagatacatatatgataatgtaagtttacaaaaatgttaacagtagaatccacctgatggttatgcatgttcacaggaaaagtccttcaactttgctgtatatatgaaaatcttcatagtaacaccagaaaattttaattcagaagagtttagtctaaatgaaaaaatcacatatgccagaatgatatgtaagtacaccactgcagctatacatgtttagttttttcaaaaaaaagattttatttatttatttatttgagaggaagagagaaagagagagagtccaccaaagggagtagggagtgagggagagagagagcctcagattccctgctgagcgtagagcccgaggtgctggatcttaccaccttgggatcatgacaaagccaaaaccaagagctagatgcttaaccaattgtgccacccaagtgccccaagttatcattctttgacagttttcttaaccactaatttatgaaatagatgcttagactttatcagtagatttgcgtgttctggtgttcatacagtcagagatagttctatggcccttgtggatggtaaatgatgaccttttgtgaaggttacatatcaccaataactgtttgtcatcagatttctaaatgtaatactttttcattaagcatatatttcgcttttttcttagttatcttggccaataggattcactgtaaaaatatttttaattactggcttgcctgggtggctcagtgggttaaacatctaccttcagctcaggtcatgatcccagggtcctgggattgagcccatcgggttccccactcagcgggaagcctgcttctccttctccctccgcctgccgctgcccctgcttatgctctctctttctttctctgtgtcaaatatataaataaaatatttttaaaaaacgttttaagttactaaatagtaaaatagtttgttgatttatgctatacaaaaaagtataaaaccaaaataggttttatatgcaggatcgctaaccatttatttcccatatatatttttttcataaacctgacccataatttgccaagtttaacattgaccagtcaaatggcagcctggaagcttaggacattcacaggtatgacataggccacagcacagttggctgctaactctaaaagaccagcagggaagaatgtccaatgatgttccccctacttcccaagactgtaaggagtcagcaatccccagatattgtgtctgccggcaattattttatcagcaagtattttattgcccattatattttctttgagaaatcatttatttagaaaaggtcagaaaaagaagtgtaagttattattggtcatcttagtgttaagaactcgttagtgtacatatgtcttaaatagaggagacaataagaggaagctagaaatacaaagtatttggtcaatcaaatccatcttaacttactttaatgcaactattaatattttatttaaaaaatttaaaactcaggacaaatgataaatcattcaggatgccagaaaaacaggcataaaccagttctgcctcaggtaagccttggcatatggtctctttatgtactcttgttactctctaaatgttttggattttactccaagagagatggaactcataagaagattttcaacaaaagaaagatacaatctgatttcttaaaaaaaaaaaaaaaaaaaaaaaaaaaaaatcactctggctgctgtctttagaagagacaatagggatgcctggatggctcagtggttgagcctttggctcaggtcatgatccaggggtcctgggattgagttccacatcaggctccctgcatggagcctgcttctccctctgcctgcctctctctctgtgtgtctctcatgaatagataaatcttaaaaaaaaaaaaaaaaagaatgagagagagaaaatagagaggcaagggcagaagtaggcagcccatttaagaggctaccacaataatccaggcaaaactgattatggctttaaagattaagattctgggtatattttaaaactctgtaatcacaaatcgaatttggcctaccaaaaaaggccttgaaacaattaacaatcccctaacaattagcatcccctaaagcccagattataatctcgaaacaacatttcatgctaaaagaagtaggacttcttagaaaaaaaggttattttcaagaaattagaaagaaaggtacaaaattagcctagaagatctttttataagaaaccaaaaagtctactaagactactgggatctgggcagccctggaggctcagtggtttagtgccaccttcagcccagggcgtgatactggagacccagaatcaagtcccacgtccggctccctgcatggagcctgcttctccctctgcctgtgcctgtgcccctctctttgtctctctctctctctctctctctctcatgattaaataaataaattcttaaaaagaaaaaaagattactgggatcatctcaaaaggccacagtcactaacttaaaggagctcctaatgtatacaatggaatattactcagccattagaacaacaaatacccaccatttgcttcgacatggatggaactggagggttattacgctgagtgaaataagtcaattggaaaaggacaaacattatatggtctcattcatttggggaatataaaaattagtgaaagggaataaagggaaaggagagaaaatgagtgaaaatatcagtgagggtgacaaaacatgagagacacctaactttgggaaacgaacaaggggtagtggaaagggaggtgggcaggggtttggggtgactgggttatgggcactgaggggggcatttggcaggatgagcactgggtgttatgctaaatgttggcaaactgaactccaataattaaataattaattaattaattaattttaaaactttaaaaatttaaaaacatttttaaaaaagaaggagctcctagtggccaaaggcagaacaactcaagcatcaaaaggaattaaaaaatgactacaatagagtctcacattaaaaaagtcaaaactcataaattcataataacatttaaaaatgaaaactcttggggatccctgggtggctgagcgggttggcacctgcctttggcccagggcgcgatcctggagtcccgggatcgagtcccatgtcgggctccctgcatggagcctgcttctccctctgcctgtgtctctgcctctctctctaggtctatcatgaataaataaataaaatctttaaaaaataaaataaaataaaaataaataaaaactcttgactaaagaggacacttgatgggataagcactgggtgttacactatatgttggcaaactgaatttaaattaaaaaattaaaaaagaaaaagattttaaaaataaaaaaaaataaaaactttgaggcatctgccttcaactcaggtcatgattccagggtcatgggatccaggcccatatcaggctccctgcttagtgaggagtctgcttctccctctacctctctctctgctcatgctggctctctttcattcaatcaatcaataaatataaccgaaaccttattgggcatctttggaggtgccaggactccaaactcataattaatctgaaaactagtaaacaaaggaaaagaatgaagcatttatcttgtccatcctgtataaactgtatttcagggcatccagatagttgacaagaaaaggtctttagagaaatacaacagataataagtatagaaagaatgatataattagaatataagcattttcaaaactgaaagaatgcaataggtaatgatcatcaaagctgctaaaactttcagggaaaaaacgagtagggaactgtataatgaacctaatgaccaatcttaatttcatgaaaaaaaaagaaagccagacattatgtgtcttttgatatgatgtaagagtaagtatacagcaacactaatcaatatatatcagaaaatgaatctgaaaagctataatatataaccaccagtttacagaatacaatgtgttgaatgatgatgtgacagggatacaatcagtggaaagttctctaggataaggactcatttccttcaacagataagtttgcaaagaaagaaaaaagaagagggaatggacataggttaaagacttaagtggagcctaggtggctcagccggttaaggttaagcatctgccttcagctcaggtaatgatcctagggtcctaggattgatccccgcatcatgctccctgctccaggcgggagtctccttctcctctctcctgcttatactctatctctgtctctctctcaaatgaataaataaatataaattaattaattaactaattaattaattcttttttaaaagggacacctgggtggcttagcggttgagcacctgcctttggtccagggaatgatcctggattcccaggattgagtcccgcatcaggctccctgcaaggagcctgcttctccctctgcttgtgtctcttcctctctctctgtctctcatgaataaataaattaaatcttaaaaaaaaaagagacagacagacagaaatacacaagcagtgccagaaaataaggaaaggaggggagtggagtcatacctggcaagggaaatgaaatttatgaatttttttgttaagataatagacacattagtaagtatgtgtatataccttgtagcttgcagatttaattccatcaggaacttcatcctaaaaaagaaaaaaatgtttttatcagacatttattctatgttctgaaaaaaacttttaagtgtctatgatttatgagattatttttatttttttaagtttattttatttatttaagtaatctctatacccagtgtggtgctctaactcatgaccccaagattaagagtcacatgctcttccaaactgagccagcccggcgcccctatgagattacttttaaactgaaatagtcagtttttatactatttcttaaaagtaaacaaaaacccaacaaattattctctaggttgctgttcatatattttaatacctcataatagcacagaaatgtaaaaatagttactccctttgatgttcaaattgtcccacactggccactaggggacccataaagtgctgacttgttatctgcacctgtctcctattgatatgacctcagtaatctttagcagcattttccattttcttttatgacaagatactccaggctcaccgtgtatatttcttgttccagtcctggaattgactgttttttaaggagccctagttcttttcagaggaaaatggtactggttttagtcatgtgttggccactaaccaactataggacctatctgtatatcctcaaagtgatgctgtgaatagacacaatgatgtatgtactctataaattgcaggaccctattccagtgctaagtctatttctgaaatagataatacctgcccaaagggaatgatccacacagagataaacactttattgtgtaactttccagaattctttttctaagaccagatatttagagggtttctaattttttcatatcatgccaaatttataaactaatttcagcagaatcgacacctttacaatatttattaccgctttacagtcatctttgaacatctgtccaattattttagtaagtgaaaatcctggtggactagtggatgggatttaggaggacacatgacaagatgagcatagggtattatatgctgacaaactgaatttaaataaaaattttgtttaaatcctggtggaattactagaccaaaaaatgtggaccttttaaattttgttgatacagggcagccccggtggcgcagcggtttagtgctgcctgcagcccaggacgtgatcctggagaccctggatcgagtcccacgtcaggctctttgtatgatgcctgcttctccctctgcctgtgtctctgcctctctctctctgtgtctatcatggataaataaatacaatcttaagaaaaaaaaaaaaaaaggaactgcttaaattttgttgatacatatgctgaactgatctccaaaaggatttaaccaccagagtattcatttcttattcacaaacagtggatattgttatttgttttcacattggtcaattaataatagaggggaaagaacattgtttcgacccatcataaaggtaataaataattggcctttcagtttatagagagtccaggctgcgagttaaagccccacgttgggcgtgtagagactacttaaaaattaaatgtttagggatgcctgagtttattagttaagcatctgactcttcatctcagctgaggtcttaaatttcagggtcatgagctcaagcccccaaaaatagaaatattttttaaaaatttcttaaaataatgatgaaattcaaatttttaataattgtaaaaacacttgcttagttctgaccaatattaataatggcccatttaatgtataagtgcaattaaatgcctttattatctaccatatttttagcatgcttaataagtcataaataagttattggtaaacttgaatttccctaactactatatactactaaatataaatgctagaacttaggaaataaaatgaaacatttaaaatgatgatatcattttaatgatattatcataacaggttgtttcacaagttaattcttgaattttcaaaaagctttgtctatgaggatacgtttaactaaaggcttgattttcatttaactaatgataaaatatccacaaatactattttacgttagcattaattccatatgctagataggtctatatagcaatatttacacatatcaaaagaaaccactcaaaattatagcaccacttcatacccattgggatggctaattatccagaaaacagaaaagagtgaatgttaatgaggatatagagaaattggaaacctcgtgcattgctggtgggaatataaaatggtgcaggtgctgtgaagacagtatgatttcctcaaaaaattaaacacagaacaaccatataatccagtaattctaattctgggtgtatacccaaaagaactgaaattaggaacactaaaagatacttgtgcacccgtatccagagcagcattatacacaatggccaaaagatgggaataacccaaaagccaatccataggagaaggaataaatgaaatgcagatacacataaaatgcagcattattcagccttaaaaaggaatataattcaaacacatgctactatggataaaccatgaaaatgctgttaaggtaaacaagccagacacaaaaggacaaatgttgtaataatcctccttatatgagctacctagaataatcaaattcatagagaaagaaaatagaatagtggttgccaagggcaagagggatgggtgaatggggagttactgtttaacgaacatgcagtttcagtttgtgatcaggaaaaaaattctgcaacaggatggtgctgatggttgcacaacaatgtgactatacttaatgccaacaaactgtacacttaaaaatggttaaaatggtaaatcttattatatgtattttatcacaataagaaagtaaaatacaaatatatgcttttaaacggaaaaaaaaggcttcattaaaagtgtaaaattcagttttcagagtaaaatgcttcaaattttaatgtctgaggattcttaagtaaaaccaggtgtttaggagcacctaggtggcttagatgattaagcgtctaccttcaactcaggtcacgatcctgggatcctagtatagagccccacatcaggcttcctgctcagcggggagtatgcttctccctttttctctgcctctcattcatgctctctctcttgctctctatctcaaataaataaataaaataaaataaaacaacaacaacaacaaaaaaaaaaaaaaaaaaaacagggcagcccggtgtctcagcggtttagcaccgccttcggcccagggtatgatcctggagacccgagatcgagtcccacatcaggctccctgcatggagccagcttctccctctgcctgtgtctctgcctgtctctctctgtgtgtgtctctctcatgaataaataaataaaatcttaaaaaaaaaaaaaaaaaaaaaaaaaacaggtgtttagtccaaccccttcccacccaaggaaaacaatatacctgtggataaaggagagattttgcttacacttccattaatttcatttcgttctactataaacacaactttgagtaagaaataggaagaaaaacatcaagccaaaagaactgttaatctcacaagtaaatcaaggattgtatttatcacaaaatttaaattcttttattatgaaggcagaataattcaaaacaggttttacgttagtaagtttaggttttgtttttgttttgtttgtttgtttgttttttaaagatttgagagagagtaggggaagggaaaaggagagaaagaatctctagcagactccctaatgagtgtggagcccgactcagggctcaatccaaggaccacaagattgtgacctgagccaaatcaagagctggatgcttaaccaactgaaccacccaggcaccccaagtttaggcttttaatctgtaaatattaaacaacattatatttaacctaaggactgaaatgttattttagttgtgttgcccctttttaaaaagtgcaattatttgaaaaaagatgtaacagatcttaaatgtatacgtggttcttaccgattgacaaggcttgacagcacagtctcttcgcccacactggctaatatcattccagaaaggacatggtctcttcaggtttacctataggataatagaaaaggttataaaagtaagaatcttgagattattattgacatgtgttcaattacaatgttataacctggtcatgctattagttgcagtttttctttttcttccatttcccagctgccaagttccagtgattgtatctatgtgtaccttatataagtaaattggtagacttggttagaaagacacagactgggatgccagagtggctcagcggttgagcgtctgccttcgacccagggagtgatcctggggtcctgggatcaagtcccacatccggctccctgcatgaagcctgcttctctctctgcctgtgtctctgtctctctttctttctgtgtctctcatgaataaataaaatcttaaaaaaaaaaaagacacagactgctactaaacagactccaaacagagggcaactaggagacaaagtagctgatatcaccactgctgaaatgatattcatttttagcaagtagcagacaattgtgaacttagatgataattacatattccagtaattagatttttctaaactccttctgtagttatctcaagataaaatatcacaagtgaccagttaaaataatacaggtcagaataaagtcatgcttttcaaaaaacttaattatttaacaggagtcaatctaatattttagagaagtatgaactagcaattttgataacaatataataacttctgttctgacttcaatttaaacaagtttccaacgccacagtgcaaaactgacttgttgaaactgaaagtatccaatggatggtttcagacttatattcttcactcttgtaaactgaattttaaataatggccacaattttgaagctcaacaattcctaagaaaatgtaattatccatttaaactttaagtattcttgtgcaaaaaaatttaaaataaaaataccttgtaatatctgaagtagtcactttcaagaagtttttgtagtcttgggaaaagcctgtagttattaaatctatcgatggtttcaacatcacaggtacaatcatccaagtaaccactaacctgttacaaagaaaatgaaataacacatcaaaatatcttaggtacaacagggttctttttccttacaaggttatgactcaaccaactcttatcctctctcctctcctaatttttggaaatggggggatccctgggtggctcagtggtttagcacctcccttcagcccagggcatgatcctggggtcctgggatcgagtcccacgtcaggctccctgcatggagcctgcttctctctctctctctctctctccccctgtctcatgaataaataaataaaatcttttaaaaattaaaaattaaaaaaataattttcggagatggggtattacagtaatctaataatgctattgctcttactatatacctggaggaatgcagtggctgctttttgtagggtgtactaagctcatcatcacacatgtgcccacacatatatgtagtgagttgataccctgcagccactctgtaactccccccaggcctgactaggtgtaggcatctaatacaaaccaggtcatggtccctgctccaggaatctggaattgagaagaagaagagatggctcttcctaaacaactaaacacagaccatatgctagcatgtgaactgaggaacacatgagccagtcagcaagattttaagatacacagtgaagcagagacaggagatggattcggttttcccgctcctacttctccccatcttccttgaagccccagttgcattcccattcttggctctcctaagactccatattcctacaattcaattgtcagtcttcccttttagtatcctacaagatgtatagtctggagacaagtttagtgaaggtacaaaaaaaaatacggtatttataagagaaacaataataactataacaatctaactactcccaaatattagaccatgataatttgtctaggttagaattggtgcttagaaatcacttatcagggatccctggatggcgcagcggtttggcgcctgcctttggcccagggcgcgatcctggagaccgggatcgaatcccacatcgggctctcggtgcatggagcctgcttctccctctgcctatgtctctgcctctctctctctgtgactatcataaataaataaaaattaaaaaaaaaaagaaagaaatcacttatcattagcagcacagatagcaaattgaccacaaaaccaattctgatcttcaaatgcttaaaaataattacaatcagacaatgttatcagaagtgaaactaaaagtctcagatgtttatttggggctaggcaaatacctacaaaattaattatatattgctaacatggtaatgctgcaagtaacaaatatgtcaagatttaagaatggtaactagatttttaaaaaaaatatgtatatagggcatgctatagaaaagaggtccttatactttggtctgaatatttgcaatataaactactttggattacattttagggagacttgtcaaaaaattttttttcaaatctactggtaagtaagcaagtaatacttcattaaaataccatatgtaggtgatttccctctggaataccttcagtaccttttaattttgaaatattacaaaacagtaatgtaaatttttcacctaagagtgaatacttttggatgatgagagataatactttggatgatgacagcaatatctaacagctaagattctgtaccgatttgcctagtcttacttgttttggactaattcaggttccagaaatctgatctacatattttgttactgtaataactactttcattccatatgcaaatttttccttatttcctgctaaaaattctctgagtatacaataatctttagttcctaatttgaggtactaacaaaacaaaagtgcttctaaagaacctagatgatttgattttttttcacacccctttttttcaagcattaaaaacagaacttctaaggatgtaaactagctactgttttttcccttggatacaaatcattatacaaagaaataagagacacaaagaatgccaaggccaaagggatacatgccaaatagagacattaggtcataaggagaaacaagcacacaaaaaaaacaagagaaaggatttgaagcaattattttttcccccttacgtatttcattttaaggtaaaaaaaattctatctttaaaattcgagttcgggagcagcctgggtggctcagcggtttagtgtcgccttcagcccagggcgtgatcctggagacccaggatggagtcccacgtcgggctccctgcatggagcctgcttctccctctgcctgtgtctctgtctctgtctctgtctctctctctctctcactctttctctatctctcatgaataaatacaaaaaatctttttaaaaaattcaaaattaaaataaaataaaattcaagttcaggcatcacctcttttggaaagctatcccctggagtaccactcaactcctgctggcttaactgtcgctcctatgtgctcccatgacactccacataactcttagatacaaattacctcactatattggatttatctatttcaattcctccctctagagtttaaaatccttgagagcaaaatcatgttcattcattttgtattcttagtccttagcactgtacttctagacagtacatagtagatgctcagtatttatttgtagaacggatatatgaacaaatgtttcgatgaatgctgtccacggtcacgctcattcactggagaccagcatcacagtctaattatgactatgaactaccatgtcacctatggtgcttggtgctcagtgctccagaccacacgagcccaagtggcagaaatgcactcagaacaaggaaagcaaacagcagaggtaaataacccattgtgtccaattttttaccaatctatacaccttaactacaaaggaagctagaggaggctccagaccataaaggaatgcaagatgcattcaaagcagaaatagctgatagcccagagacctcaaagagagaacacaggacaaccataggcttaaaaatcctcagacctttaccttagaaattgagtaggaggtacttccaccaacaacaaaatgtagcagggcagttaagtaggtagagcagggatagaggagtttcaatagatgcagagggcccagcaaaggagagacatgaatacacttagaaacccaagacatgtgactgttcagataagcttgccaacctaatccctgaagagaagtctagcaggtacagatgccagacctagttctagaaattagagaaccagcatgttaccagaacagagtctctggagaaggcaaaaagaagaaatccagttaacaggcccagagcaaaatcttggaaacaaagcaaagcctagtctctaagaccaaacaatgggtactgatctggaacaagaatgactggatactactgcagctttgggatgtgctaaggctgcttaaatcattgccacattatctcctaaactgaaacagaattctgaccctcccataggaataccaattctatttaatgcgccccccccccccccccagccccaccacacacatacacaaagtgcttgatgcatgctaaaacttgaagctcgctgctccaggcaacaatcagccaaactaatttggtaggaggccaaactaataggtggcaaacagaaggcccttgctgagggatggtagatagaaggaccagggaaggcctgacagacatctcccagtttaaagtccaagtctctaaagagctgaaaagcctctgaaggccttctactgcagcctcccaagcacacagcaatgccctcctatgcactctcaagaaggatgcagtgtgtaacggtggttagcatgcaggccctggggtaaggccttcttggggttgaatcccatcgcttctacttattagttattggtcttacccaagtattttttagcccctctaagcctcagtttcctatctgaacacaaaatggtaatactaatagttcccatctttaagagttgatatcaaaatgaattggcacagaataaatggccagtaaatgttaatcagtatcattaacgtaccactacttaaatgtttctagtgaaaggaatcttactagtcccaaagcaacccacaacattttatttgagagagagagcgcgcgcgagagagagagtaaatcactctctcaagtaggggggtggagaggcagagggagagagaatcttaagcaggctctacacctgactcaaggctcaatctcacaaccctgagatcatgatatgagctgaaatccagtcagatgcttaacgaactgagccacccaggtgcccctatgttttgttttgtttacaaagggaaaaaaaaggcccagtttgcaactaaaatttttcaaaaattttacatctgtagcctcagtggaacatagaactggagagccaacagtcagatgcagaagtagtctcaaacactttctccacggactctgactggtttggactaattaccaaaatataaaaggcaagaaaagaaaataacataggcctgcttgtttactattttctggttacaggtactctttaatttacaatgaaagacaaaaaaaacaaaacaaaacaaaacaaaaaaccaaaaaaaaaaacccactttctagttttcttacatgccaaaaacttccagtcctaccagactatcattttttctcaaagcactgtgagaatatattcctcctacctgaaatatcttttaaaagtgctcaaactgttcctttttttgcaaagacctttagttatgtttaattttatagtggtttgtgactgtgaaaaagaacatgaaaagtactcattgaaagagctgactgagacctctgttaatgagagcatggaaacactgaagattctatactgggtagttggcaccactctaagtgacatggagagctacaagctatttctgctttaaacctttagtctttagaactttaaattattgttgtgacccaaagtgtagtaaccaatgtaaaatatgctttgttctacactctttgttcaaaagggcctggaatgtattaagtgctcagagtcaatggacatctctccagtataacctgtttcaaagattcctctgactaaattttaatccaggcttagttccacctaccacgcaacatattatcaagtgtttcttcttccatggtctggctactctgactaacaaataaaaactattttttaaattgacttacacaagacattagacaagtaaatctgctaaaaatcatgtatgcagagtgtatctacaatgcactacaaaagaaaattgattttgaaatagccattttggattatctgagttacttccctttcattagcctgatagaaatttacaccactcagatcttgatttgagttgatctgagtgttattagcactagccatattaagattaataaaacattttgatgacatgggagtttatagacatttctaattaatttaagtgaaaaacatgtccattctgcctccatatctgggcttcaatatttcttctgaggttatttctttaaaatgcatcttgggattccatgaacagggattaaagttctgttacattcatcctaatggtacataatgggtaaaaggaaatacaaaactctgtcaaaagcaaaacaaaacaaaaaaaaccaaataaaaaagggaaaccaagaaagtctgaagagtctccatttatttcaagcccatacctattacaacaaatattacaattattattttggtttaaagacagggtgggtcatgatcatggggttctttataaaaattacatagacttgcacaccccaaaaggtaaaaaagaccaattttctgtgcaaaaaaaaaaaattttagggacgctgggtggctcagtggttgagcctctgcctttggctcagggcatgatcccagggtccagggatcaagtcccgcatcaggctccccgtgggagcctgtttctgcctctgtgtgtcactcatgaataaataaaatctaaaaaaaaaaattattttaaaaagaatgatgattttaaaaaagtggggagggcagcccaggtggctcagcggtttagcaccgccttcagcccagggcgtgatcctggagacccagaatcaagtcccacgtcaggctccctgcatggagcttgcttctaactctgcctgcttctccctctatgtctctgcgcccccccccccactctgtctcatgaataaataaataaaatcttaaaaaaaaaaaaaaagtggggaactatatataaggaagagttataagtccccggcaatttatcacttatttgcagcaactaacactgaagcattgttatcaaaataacttacaacatacagtgaaaatggttttggtaggatttgatgtcaagaggcatatgcagtaatggactaaccttaaagattcatttggagccatcaacccatctgaaagatcaattccagaaaaacatgcaaatggctaagcagaatgattgaaagaatatactccaggtagcacacatcctgaattgtaatttctgggatgcctcggtggctcagtggttgggcgtctgcctttggcctagggcgtgatcctggagccccgggattgtgtcctacattgggctacctgcaaggagcctgcttctccctctgcctgtgtctctgcctctctctgtttctcttatgaataaatttaaaaatcttaaaaaaaaaaaaaaagaaatcctgtattataatttccctaacacttcttgagtaccaattatgtaccaggctcagtactctgtagtatcaagaaatgggactaaatttttagtttattttttgatctctcaaaacttattcacaataggccacaataaatgattattgaatttaatctattcaaagtaaagctttgtatcttttacttcaataattttctaaggccaaataggtgcacatgctgctttggctcaatttagagttgatagtctgttaacagaaaccctactaccgggcacccatgaaagagtgtgatgaggggtgttgatgtggtaattcaaggcaggagtggtaagagagattggcaacaggaagggagaaagacaattaacaaaacggtctccacagaactttcctgctacttgggtactgcaaagagaatgagagattttaatttgtatttctaaactctaggtcaaaagttagtcttttgactaactattgtctagcaatatttatgaactttttttttaagattctattttttaagtaatctctatacccaacttggggctcaaacttactaccctgagatcaaaagtggcatgctcaaccacctgaaccagccaggtgcccctactagttttttaaaatgcttaggatctcaagctccaaagaacattattcactaaattgttaagttcttaaggacagggatcataccataattatttctgtatcacaaatattcaggtcaatgtacacagtgcttataaatgtttactgagggcagtcctggtggctcagcggtttaacgccgccttcagcctagggcctgatcctggagacccaggatcgagtcccacatggggctccccgcatggagcctgcttctccttctgcctgtgtctctcatgaataaataaataaaatcttttttaaaataaataaataaatatttactgaatgagtaatttccaccattcatctcccctagtcttttcttccatctttttttatttctgtgtctctcatttctgtatacatctatgtctatatgcttgtccaattttctcttcatatctattcatcacttgtcctttctcctccttacccccatctcttccattattgaccgtaagagaactaaaacgtatttttatttcaatctattgaattgagattgatggtctctgttcttaagttgatttaaatagaccatttaaaattttttcttgggacacctgggtggctcagcggttgagcatctgcctttgtctcaggatgttatactgcggtcctgggatcgagtcccacctcaggctccctgcatggagcctgcttctccctctgcctatgtctctgcctctctatgtctctcacaaataaataaataaaatcttttaaaaaaattttttcttacaacttttaacatgcaaccctcagtaattttttaacgttgattccaaaaagaaaaacagccagtcctgttctaaaagcaaaagaaagggacctaacagatttttgtgttggggaaatattcgaatcttgaaaacattttaaggggtgggaagtgggaggcttaaatactaatcagaagaaaaaatttaaaaaaatttaaaactccccaattttaatcaaatatctaaaaaagttatagggggaataaaagttgaaaagctcaacaggtactattatttcattatttaaaaatccaaaatacagttgaaaatgttatattggacatcttcttccaacactaacttattttagtcttttacttcaacttttcttatgtgcaaatgtttgtactttgtgttatgttgtattcttccttataagtacttgatggcgtgcagttgcaatccctgaaggtaaaggagcttttcaatcttagtcgtaaagcagcaatttcctttcaactctcctactcgtagctagataacatctcaactctcaaatcactcagcaaagcaacaaaacgcaagaataccaagcagtgaaagagatagttcttcccctcataatattggtttatttcttcctcccataatatttaaagctgtttcttgactctgaaatagtagcattgcccctacacataaaatgttatttctgatcattaattgtaaaatccacttaacaggaaaaaacttggatgcctaccctcaaatttgtataaaatgtaatttttttatcaacagaggccaaccaaaacgtgactttaatgatattaaaatacaggacactgcatatccgaaaacctctaaatttctttgaattttttttttctcaaggaacctacctctctaactaaaaagggaaaaaaaatagatcataataagcttgtacttaaacttgtgcactgaataaggctcatcctcccaattcagaccagccaaacgggtgtcacgttaagggaatctcatcacattttgggaaaaaaaaggacacagggcgaggagccagggggcaagcggcggccctcaagacacagggcagctgggcttgcacacagaagagccacacgaagcccttctcctgcctgacaacgagatccgagatccgagatcctgcgccctgcacaccacaccgagcaccgttccgggtcaaactggaagtcgggaagatccaggttctgctaaaacggccagtattaagtgcgcgtgcacagtgtgcgcgcccttcccgggcagggaagacccacgaagatgcataacccaagtcggcaaagacctagcggcgcgcagccaccccggcccacaccaagccccgcgagctacggggcacggcgccggggggcgcccgggagggcggagtcgcgggggctctcccggtgtcacctgccggggcgcggcccccagcgcagggcggaggcgggcagccccgggagccgccgcgccgcgcggccgcgcacagccctcacctggcagaagcaccgctgcgccgccgtctcggggggccgctgctcgccgtgactcgggccgagcagccacacggcgcccacgaggccgaccaggaagccccagcgccggcccatagccgctccggccctccgcacctccgggcccggcactcgggcgcaggccgcgcgtccgcagaagaagcccgcgcgggccggcccccggcggcgccccacccccggctcctcccgggcccgccctcggctcgcccgcccgcccgcggccgccgcctcccggcagagcctgcggacgtgcctcggcgcccgcgccgccagcccgccagccccgggcctcggggcggcttcctttccccgcgtgaggctgacgcacgagcccgcttcccggcgcggctccgccccgccccgcccggcccggcccggcccggcccggcccgggagcctcgcccggctgcggccgccccggccccgcgcgcgcaccggggtccttcccgctgcgagggcgagggcgagggcgagggcgagggcgagggcgagggcgagggcgagggcgaagcgggaggggtccgagcgtccccgcaggccccgggccccgccccccccgcccacccccacgaggcgaaccgcacgaattgcgcgtccacagcgcccctggatgccttaaagctgaaagggacacaaggctgcatgggtaaatcagagtttccaggagttacgtcgaaagggcaaagagaagcaggtgaagttacttactttcaatatatataatatatatattaaagattattatatatgacatattatgtattttatatattatacatttaatatatattatatataatgtattgtatatttaaagattattatatttaatatatattttttaaatattttatttattcatgagagacacagagagaggcagagacacaggcagagggagaagcaggctccacgcagggagcccgacgtgggactccatcccaggtctccaggatcacgacctgggccgaaggcagcgctaaaccgctgagccaccagggctgccattaatatattttatttaacccactatgtgcaaaacatttcgaaatatactcaatatcagattattcataaaatattttacatattttttaaatctttgaaatctggtgtgcatcttatgcaaactagccgtattccatagtcaaatgtagcgagtggcagctgtgtccgtcagcgcaggtggaggccaccttctcatctcataggaggaaacaggcccagggtggaaagatgacttgagcaagggatgagctggtcctcttcttcccagccatgggtctagcctaaaagcttttattttttatttatttttttttttttaaggagaaattttcatagtgaaactggaaagattcccaacatcttatcttacacattaaaatatttcaaattatctttttgtttggtatgtcatattaaaaaaaaatcatttaacgaagtagctttaagatatggtaggccccaaataggtattacctctgttttccagctgggaaaaataagcatagcaagcttatatatgttactcataggaatatgttattcaaagttacatggtacactagaggtgaaacccaaactcagatatttctttttctaagattttatttttatttgacacagagcaagaacacaagcagggggtgtggcagggagagggagaagcaagttttccaagaagcagggagcctcataccaggtttgattccagaacccttggatcatgacctgagctgaagcagatacttaactgactgagccacccaggcagccccacaaactcagacatttcttaacttcaatgcccataacctatgctctgcccatcatttgccaagtggactgacacatagtaaaaagtcatcaaccatctgagattctggtgggcctgagaagcccaccagagtctaatatccacaatattcgacattttcttattaatccaatctcccctctttgcctaggaagttctttttcattatacctgtactgatcctatctgtctctccagggccagacccagctcattcattccctcttccacatggtcttctttgtttcttcttcacgcatttccagtctctaaatgaattttaattcaacaaacttaccctatgccagactgagcttgacattagagagatggaaggcccagtccctgcatgtggagggataaaagttttatgataacataatatgttatcataaaacatagtaattatgttctatttcctttccctctgcttctgttcaaacacagaatttagcatgtgatcctttatgatgtttctaccactgaattgtaatctctttaaactctttaagcagggattatgtctcaaacatactgtgactctcagtatcttaacaaagcttctctttgcatgtgtttgtacaatgaaggaatattttttcatatacaatattaatatctgaagattatactatcaaaaataaaagacaatatgaaaatggagaaactaaatgaataaagcctaaaattgcagaaggaagcaatgtgatcatgaatcggctctggatttcaccctgatgcaataagcctgtaatttgggagagtttaaaagtaagaatgttctcaggatgaaagctccattctgaagatttgaattcatgccagcaaacttgtaatcagaaacaatcaccatattaagacaatttaatttatactttattgctttttcagctttaagaaagtttaattgactaataaaattttaagatatttaaagtatatgtcatgatgatttaactagatcattgtcaaatgatcctcctgatgggttcattaacacatctatcatctcacctatttactctttcttcttccttggtgagaacatttaactctcttagtaaatttcaattatacaaacaatgttaccaactatagtcaccatattatacattagatcttcagagcttattcactttatgtttgaaactttgtacccttttgcctatgtgtccccatttgtccccccactaacccctgccaaccacttttctactctcttgtttctatgactttcactttgacttttttttttttaatttcacatgtaagtaataccatgcaatgtatttgtctttctctatctggcttatttcacttagcataatgccctccaggcctatccatgtggtagcaaacacatgtggcaggatttccttctttctcacagctgaataatagtccattgtatatatgtataccacatcccctttatccatttaaccagtgctgcacacttaggttgtttccatacttaggcaattgggaatatgatgtaatgaacatgggagtgcagataatctctttgagagaatagtttcatatacacttagaagtgggattgctacatcttactttattttcttgataattatgatttctcctttgggctttgtaagggactttagaatgtgtaaaatacagttttatacacgtggcataactaccagtgatatttatttccctgagaatccttcaagttggtcctttgtgtgagtttacttttcctcctctgcctgctttggcaattatctcacctgtgttagagcctatgaaataactggttagtcattcagtaactattaaggagcacccacagggcacatagttcaacctttgctttccagaagcacagcctcccacctattacaccttagctaaacagcattacattttttagagatgaacaaggtcacaaccttgttattctaatactagtgattataacaataacataaatttagtgtacacagcatttcctgatggaattctgattacctatgcaaacaacagctattattatttttttttaatgaccaaagcaggaaatagcttgagcccaatttctgaaaatgagacatggcgatttctataggaagcttctcagtacctaaacattttctggcagagaataggctggaaggaaataatttaaaaggaaaaaatttgctcaaggaaaaggaatatcatgacaagaggaagaaaggctaagtaaaaatctaaaggtttggtgttgatagttgattaaatactagtatccattgactataaatgtgcagataaaacattgctagacgtttctctcaagatgcttgagattatttgaattgggggagaaatgccacctcagctctatctttacctcttttccctcatattcctggaagaacaagctacatatagtagtaacagacttattaacttcccatttacacctaaccccactgtgcggtctggtttctaactctaccctcctattcctctaaacctgaccttcttatggtcaaatctaattaccattttcatgagataatgaaatctctgctgcattttgacaatgctgattccatcctccttcaatttcctatgcaccaaacacttcagattctccttccacttctcaaatattatataactgtcttctgtttcccctagcctacctctatgatgtgagtgttcccgcaggatactatctgctgtccagtgttcttttctatacttgcccctaaagaaacttgcccagtctcatgattttaaatacccctccctgctgatgattcccaaatctatttttccaattcagatctctccctcgaccttcaaattccaactgcctattggatacaaccagctgcttccctcagaactgtttggtcataccaccatccatatctagacacgtagaaagcaggaagccaccctcagtttctccttctttttcaccaaagattggttgatctattagtcagtcaagtcctgccacttctttcttcagtttagtccctcctctcctttatgattaaggacttagtttcagctcttattgtcactcacctgatttattgtcacattttcttaaatgatcacccactctcacctatcaaaacacagcctcaatgctagcctgatttctcaaaaatataagtctgacctacatcacaactctgtttataatctcccatgctcccaactctctgaggtatcaaattcaagattctcagcatggcatttaaggtccccatgatccggcctcacctatttttccagttatatctccaatatctctctgtctcgtagtaactgaactattaacaattccccatacagggggtaccttggtagctcagtcaattaagcctctgcccttggctcagatcatgatcccaaggtcctgagatagagccccacatggggctccctgcttctccctctccctctggctgctgctcttcctgcttgtgctctctctcttactctgtcaaataaataaataaaatatttaaaaacaaacaaaaaaacaattcctcatatagaccttgtttccaccctccgtgtctttactcattctgttttcactcctgaaatgttttctaccctgccccacatcaatcatcctcactttacctcgctaactactttaagattaagcttaggtgactgctacctgtatgaagtcttctctaactcctctgtggttggattaggtttctcctttttggttccgtaagctcatacaattgtgctcagtacatggaatcaagtatgcatttatgcagacattctccccattcaacagaagggtagagaactcaccttggtagtctcagcttccccagcacttagcatgtatgtgagtttcagaagacgacttctgaatgaattaatgaatgtatacataaattagtgaacttgaaaagataacagtataagatgtcacagggcaacatgtgattatgtttcaaacaaaaattttccaaaaaaaaaaaagaaaaaaatgaattaatgaatgtatacataaattagtgaacttgaaagataacagtataagatgtcacagggcaacatgtgattatgtttcaaacaaactttataaacttagaggcaaagcaatcattttggacataagtaaatttggattggacagaggacacagagaattagaactggcaagagaaaatttacaaaaggtagggatgtgggaaaatttttttttcttttttttttttggaaaattgatgacaaagtaggagctcaactaccaattgatggattaggaaaaaaataaaagaaacttatctaaaattaatttagggggcacctgggtggctcagtcagttaagcctctaccttcagctcaggtcattattccagggtgctaaaatggagcctgtgacaggctccctgctcagcagggagtctgcttctccctctgcccttccttcttgctcgtgatctctttgtctctcactctctcaagtaaataaaatcttaaataaaataaactaaaataaaatttatttagaacacatttcaagatcaagattgtccagtcaagaaacaagagtggctacaaactcagggactctagactctacatttacagagagaggggatagagttccaaaatgaaaaagggtggattttttttttttaagattttatttttatttatttgtgagagacacagaaacagagaggcagagggagaagcaggttctatgcagggagcctgacatgagactcgatccgggtctccaggatcacgccctgggctgaaggcggtgctaaaccactgagccacctaggctgcccccaaaaagggtggattaagtgaagcccctccctgctgaatgttaaaacatctcccttacctccagcagaccacctatagcactcagtccaaaaaatgcagacctaatacagacctggtttccattcactgcctcatgcctgatccccttctttcccattctaaaaggagagtgagaattcttccaagaataaacaacagcatcaaaaacaacagaacagggacatatgagtggctcagttggttgagtatctgcctttggcccaggtcatgattccagagtcctgtgatcaagcccagcatcagagtccctgctcagcagggagtctgcttctccctctccctctgctgctcatactgcttgtgctctgtgtcaaataaataaataaaatctttaaacacacacacacacacacacacacacacacacaaacccaaaacaacagaaccgttagtggcctccccccactcacacactcagaattctactgcctttttatttaatgtctcagtctatgatcagaataccaaggctcacaagattgttaaggaaagcttccaacacaaagtagatcaaaacaaataagaaaataggaactttgaggaaacaaagagggaagaaaggaagaaaaacaaaaagctataatcaatatcatcaaatacataaggagtctatcaaaagaacaagaaagagatctttgaaactaaatatatgattgccaaaataaaaaattttgactgaaacattagaggaaacattgaggaaatctcttagatagcaataaataaaaaaaaaaaacaaagaggtagaataaatgagaagagatggaaaaaatagagggctaattcaaggagaacggaatctgactaataagagtaccagtaagagagaacattggaaacagatgattattagaggtcattcaagaaaatagctaaaattgaaggatggctatccagattgatagggcacacagagttcccagtccactggatggagaatgcccctaacagagataaaatgtgcagaaagagaaacaaaactcctggtcccctacaaagaattaagaatcagaagagcactggaagctccaggacaatggagcaaggccctcaaaattctgagaattctttagccagccaatctattaagtccgagaatagaattaagatattgttatatatgaagaataatgtacagctttaaatcctttctcagaaactttatgggaggatatgatctaaccaaagaagtaaccgggaataaggagataagggtatcttgaaagaaaagatagcacccaagagaggagttagagaagttctaagaagatagccatgcaacaacagcccagagcccagattagagacagcagggcagcttcacaagaagtgtcactaggtgaactggagggatatctgatatgactgactttatggaaaacactattaggagcaagttaataactatattgtaaagttggggagaagccatcaaaacaaaacagcttttaaaaaatgaggcagcttttaattctaggaagttcaaacagtttttttttaataaatttttatttatttatgatagtcagagagagagagagagaggcagagacataggcagagggagaagcaggctccatgcactgggagcccgacgtgggatttgatcccaggtctccaggattgcgccctgggccaaaggcaggcgccaaaccgctgcgccacccagggatccctcaaacagttttatttttttatttttttttaatttttttttttatttatttatgataggcacacagtgagagagagagaggcagagacacaggcagagggagaagtaggctccatgcacctggagcccgatgtgggattcgatcccgggtctccaggatcgcgccctgggccaaaggcaggcgccaaaccgctgcgccacccagggatccctcaaacagttttataataaaacataatcattgtatattgcttgatttacatagctccacaataagacaaatattggatgttgaattaaccaaacttgtataaattatacgtatggaggacagaggtagggaaaggggggatctggagtgatataagggtgctaaatctttatcttccttattagcaagtccaaagacaaaacctaaaattaatctgtcaagaaatagcagcataagcatattatttagaaagaaaatacagaaaaacatgttgaagagttggggaatgccaccaaggggtagaataggatggggcagtggactcctctttttcaatctaagtgctgtagtactttaaagaaaaaaaatctttatgtattactttattaaagaagactatttcccagaagcataggaattctaacttctactcctacctcaacatcttaccacttagccagggatacattcaattacatgcactctggtaggcatttggggtagatatttgggatgaaaaacttccaaaatctcaaatgttccagctgatgtgcaagcaaaaatagttgctacttgcttatctagtaccatttcccaatttctctctggaaaaaaattggttcctattagttatctatcactgtgtaacagattgccacaaaacttaatagcttaatacagtgaataccgatcacttcacaattttcctcggaccagcaattcaggagcaggtaagctgggtgtatgactcaatctctcactgtgtcacaatcaagactagggattcagtcatctgaaggcttctttagcgctgaaggctctgcttccaagacacctcactcaagccgctgctggcagtaagcctcagtttctgaatacagtctcatgggtgcatattaaaaggaaatagggagtgcctgggtggttgagtaggttaagagtccaactcttggttttgggctcaggtcaggatctcatgggtcataatatcaagcccagtctcgggctgtgcattcagtgcgagtctgcttggaagttctttccctctgcaccttcccccacttgcccgcatgctctctctctcaaataaataaataaataaataaataaataaataaataaataaataaataaataaataaatcttaagagggggaaaaaaaagaaacagagctgttctggagaagccatgtgcaaaatagataggaggttcatctgaatttggatttttgccagatgggtgaaagaaaaagaacaagggtcaacagagttcaaaatattggtgtgttatgttgaaataacacaatagtaggtgctcataaatatttattgaattgaaccaaattgagctgtcttttttctctgtctcatcctctcttctctacttcttaatgtcagaggtgatatattttggtattgacagactagtttgaccagaatagttgcagctgagcagaagggactgtccctgctcaatccatcttccttgtttatcagctactgcaattttcaactatattaagaaaaacagaatgtaatagtcatgcaatacccatgttttcctaagaaatttaaaaacctttatgcaacttttggtaatttaattcacataaatttgcactttatatgtatatgtagaacatacctatttaaactcaaatgttgggcagccccagtggcgcagcggtttagcgccgcctgcagcccagggtgtgatcctgaagaccctggatcgagtcccacttcaagctccctgcatggagcctgcttctccctctgcctgggtctctgcccctctctctctgtcgctcatgaataaataaaataaaatattaaaaaaaattaaaataaactcaaatgtctagggccactgtgtaaggtaagatcaaatggaatctatctggagacttagtgactgagtctattggaacaacaataagttatctccaggaacaattctggtaagaggtacagcaaagggggcctgttctgcaaaaatcgaggttattactacccttaaaataaataaaatcgctatttaaaacactattgagtgcttactttgtgtcagacattgtgctaatagatataggcacatagcttatttaatactcatgatagctctatgagataagtacaattattatgctcattttacagagattttgtgagattaaatattttgtccaaaggatagaaatctgaaagttgttagacttcaagttcctgactcaacctacctcatcgtctttatcttctgccccatatttctataacccaccctcttccggtctcattggcctcctttctattcctagaaatgagccaacctctctgtcacctcaagatctttgcactgctgtttcctctgtcaggtaggttcttctccactgtgttgcatggcttggtccttatgtcagatgttcttctaaattagttctccttgccttactctagaactataacattgtagtactagttacactcaaactattttttaatctccccaccaggtcgcatccttagtacctcattcactgaatgaataagtaaaaaaaatagcctaccccttctgttcctgaaggtccttgttaatattctgttagactaataggctatctacgttatccccgatagtccactggaactatttagcaagactgcacattgcctacttcactgtcatctcagtttctcagaaagtgttccgtggttccacggcaacagtggtttgacactgtctagatgtctcaggggacaaccaggacaacagctccttgctctacctacttcgacctgcagggggcggtgtgggtggaggcctccttctgtgcgcggctgcgccgtcggtgaaccgagacgcagaagtgggaggagtggagtagagaggcggagccaaccggaaggggcggggttgtccacgaatccgcgccccccgggaggctttcctccctcgccccgccccttcccccgcccgggcggccatggccattcccggcatcccctatgagcgacggcttctcatcatggcggacccaagagataaggcgcttcaggactaccgcaagaagctgctggagcacaaggagatcgacggccgtctcaaggagtgtgagtgcgcctttccttccacataatcctatgcctggacctgcgtccgtctctgacaaagcagaggcccttagccgagcccggcatccgagctccagggataggaaggcctcggtccagggacaaggcgctttgtcatccggccctgagcttggaaagcacagcctcttcgggcgtagaaacggcccagtctggtccaggtgacagggagaacatccccagttctgagatggaggtggaagaggactagaggagtggaaagaagtgggccacggatgtttgccaggttgagtgcaaggagggcgcggcgctgtaggtgagtccgggacccagagaggagaggagactggagtcaaggaagctcaagcaagagagagactcgaggtgctggcttgttattggggtggaaagccagagcggagcttaagagaggggtccatcgatgggtgataataacctcccttgtctttcctgttatttggatttgactctatcaggcacacaggtttctcttaacctcctgcactaaaagggcgcttacattttttcgtagtgcgccttcactgcaaagcccgagtggtttgattaaatggagaaagactataaccatataattctgtagatcactgcacctgttgaccttatttagggccgaaaagtatagagtagtaagtaatccgtgcgggtagccgaagagatgagggaaagtctcttatcattcgttatttgtagtctcaaacccagaagtgtggttgtcagtatctgttaagaatgtaacaatgttatgaatgtgcttgaacaagtatggccaatcaggaaaataaaaatatggtgctttttctgtaacatttcagttttaaacctgtcctctacaaacggctttatttctttcatggtttcataaagtggctataaaatatactaaagtgaagtagactgagataagcttaagtaaagtgatacttagtgacttaaattcactgagattattgtttaattaaaaatgttcaaattgtattatttcagtaagggaacaattaaaagaacttaccaagcagtatgaaaagtctgaaaatgatctgaaggccctacaaagtgttgggcaggtaggtaatcaagttcggggtgtagggagtgatgacaatttgttttttgattattggccaaaagtaatgcttcttttttttttttttttttttttaattttccagattgtgggtgaagtacttaagcaactaactgaagaaaaatgtaagtggattggactgttaattaaaaaagaaaaagagtggactctcctttccatcatgaactttggaaatgttcattgttttactgataataatgaaagtagatgatattcttgcatagatttaagttttctttcaactattgtttccttggagaacggaaataaaactcaacctgccatccatgtggagatatatatatataaaaaatatttatttttcaatttctatttttcagtttatcctttcattttctttctctagtcattgttaaagctacaaatggaccaagatatgttgtgggttgtcgtcgacaggtaacactttacatttgtacagtgctttataattgataaaagtgctttcatatacgttatttgatttttgaggtgagtaggtcagacatgcccataactcctaaaggtgatttgttcagaataactagcaaaacttgaactcaaaccatagacaatgacctggtattctctattttctattcatatcacattgcctcagttgctctacatatttagaaatctaagaattttagaactggtaaatacctcagatcattttattttaaggtctttttttttttttaattttatttatttattcatagagacagagagagagagagaggcagagacacaggcagagggagaagcaggcatcatacagagagcctgatgtgggactcgatccagggtctccaggatcacgcacgccctgggctgcaggcggcgctaaaccgctgtgccaccggggctgcccttttaaggtcttttttgaggagacttacaccttatcaattactgatgttttatatttaaacatttaaaaatgatactcaaagacttttctgtagcttaagttgattttgtatgagttcatttagattagaataggcaaattaaaataactgcagatttcattttaccgtcataaaaaatggcaacaaatggctttaaataatttagtagcctctgaagccagtttatgtacaatcctattctttaggagcatcattagaacttttttaataataaaaaaacaaaaaccaaacaaacaaaacaacttttttagtaaattgattgaaagagctttttctgagtgtcacatcaggttcatgtttgaaaactgatacagcaagactgtagagtagaattttttttttttttttaatttttatttatttatgatagtcacagagagagagaggcgcagagacacaggcagagggagaagcaggctccatgcaccgggagcccgacgtgggattcgatcccgggtctccaggatcgcgccctgggccaaaggcaggcgccaaaccgctgcgccacccagggatccctgtagagtagaatttaacccagggactaaatcatatcccagcatttcacctagcatataagtgggaaaacatttcctaaatcaaaatattaaatggctagcctgacaaaggagttttatctaccttacaggccctctggattccaagagttggtatttccaagatatttcatggttgtatggggggcaagagagtatttgaagctggaaaataagaaaagccagaatagggatccttgggtggtgcagtggtttagcgcctgcctttggcccagggcgcgatcctggagacccgggatcgaatcccacgtcgggctcctggtgcatggagcctgcttctccctctgcctatgtctctgcctctctctctctctctgtatgactatcataaataaataaaaattaaaaaaaaaaaaagaaaagaaaagccagggtatatattctttatagatgtaaatgttgaaatagctttgtactgatttttgttgaactcttttcaagtacctcacttaccagcaattttatttaaagtttaatccattatattaaacctagaatttttgcctatctccccttcattttaattggcattaaattgtaaacttacagtactttgcagaatcctgtgaaaagtagtaatttgtatgattctgaaattgtattggcaagtagttttttaaactatcaaaaagtaacttaattttggaaaagtaatatcctgaatatgaggtgaatctcttggatagattctatctatagtctaataagttaccctgcccaatatgccagtaaattgttagtatgattcaacctaatctatgatgtatttatcataatatccgacatgtagcaaaagcatgaatgattcgattgctgggatttttttggttttggttttagcattttaataaaaacctctaagaggataaagaatgagtgcatttctcgcttaattcctgtagtcaagtaatatgttcttcctcaaagctatctgctttaaaataaatctaaaggacatattaccagagtaacactgtacaccttaaactgacacaatgttatatgtcaaattcatttaataaaaaataaataacaatcgactttaaaagaaaaaaatatatagggcatacctgtaaagtgctttcctttcctttccccaaaatgttcacttagagatttctgtataaatatttagtatcaaaaaaaaaaaaaaaaatttagtatcaattgccatagtgcctgaatcaaaataatgagcaaaactgtataaaatagtaagcctttggaagtaaaactaatacccatttctttctttaaaaataagatcttttccaccacaaactttgtatattagtgatttcacatttcacaattagattgcataacaggtacttgtttaagggaaagaactttgaattattacttttataagcccttctgttggcattgtattttaatctgatattagtgttctctctgaagggtaaaagtgattatttggtttctaaatattgtgctcttgttagagtattattttctcttttatgtgtcatgtaacactttttgttttataaaattagcttgacaaaagtaagctgaagccaggaacaagagttgctttggatatgactacactaactatcatgaggtgggtttcttattctatttattttattttcacagagggaagattttagctaaaatgtatgcttcttgagatcaatgaatatcatgctactttttcccttttactaatttctaattaatgtatatacatttttataagatcatttataggttcttgcataagcaggtcaatttatactctctctgtaggctgagagaaaatatatcttgtaaagaaaaatacgtaccttatcattatagatatttgccaagagaagtggatccattggtctacaacatgtctcatgaggaccctgggaatgtttcttattctgagattggaggactatcagaacagattcgggaattaagagaggttggtaatatatgctttgttctctgatagtactgattttaagacacccaaagagagaaagagaatgtaagattactttgtccaaatagtggttacaaagtattatatatttaatattcttgctgagaagagaaaaatagaactgaatttctagctatgaaagtaagttatctgtacccttaaatttttttttaagattttaaaatttttttgagtaatctccacatccagtggggcttgaattcagaaccccgaggccaagagttgcatgcttcaccgactgagctagccaggcgcctctgtaccttaaatattttattttgataaagctatttgctgccattcaagaaaactattggctttaggggggcttaaaccttttaaacacttaggtgaagagtcaaatcaggatttcttcacctcgtaacacagatggcttcttaacaattctctttgaagcaaattatgtcgccctatttatttcatcctaatttaggatggaaatgtttaggaatgagtgaggatagttggtatggcttacctcatctgatttaagctgtagccagtagttctcatacagttcacatagcatattgagttttctggaactcctattaaaaatagagattcatgggccctctgcatgatttccatgaaggagattggggaatggaacataggaattagcattgaaacaaacattccaggtgattatgaaaccaaattgtttttggtcattcttgaggaagcactcgtgtaattacaagtaaaagtctatttttactttgtagttaaagaaagggcaacagaggaacaacaaatgcttcatggaactgaaatcttgtcttttgcagtgatttgctgcatcaactgtagaagcagaaagtttctctctttcacacacacacacacacacacacactccacaaaacatatgcacatgtaataaccttttccatctggagacactaagaatattgacttcttatactttttgtttatttaatcacacctggtggatacaagtattcaatagaagcttatttctcaagttacttgtctataaagagtttaatgtgggcagtcaaaccctcaatttttctattctcgaatcaatcttagtaggacattaagagtgaatatatggttcttttttttttttttagtttttttttttttttttttttttttttcataatctctacacccatcatggggctcaaactcacaaccccaagattaagagtcatctgctttcccaactgagacagtcaggtaccctgaatgtatagttcttctaagtctactatgacaaaatgccaacataagaaaattttatatgccttttctccctttttttattttttttatgccttttctcctaatggcaattttaactttactaaattttcccattttattattttgtgttacagtcccaaatgcaaaataagaatttttttgttttgtttttcttttttgcttacctgatttttttgtagtgtgattttttttcattgaggcataatttacattcagtaaaatgcatagattttaattgtacagttcactttttaaaaattttatgtatttattcatgagagacacagagagatgcagagacacaggcagagggagaagcaggctccctgcaaatagccggatgtgggacttgatcctgggaccgggatcatgccccaagccaaagacagacgctcaactgcagagccacccaggcattccttaagtgtacaattcagatgtgttttgacaaatcatatgcctgtgtagcgatcacttgtgaagtgtatagtatgttaaaataattacagacttaaattaatttttacataattaaagaaaatttattaaatctacctaaagaatgacctctaatataaatggctttatgtgaattacatctgtgcgtatacctaactatgctgatactttacttaaagtatttttaagtttatcagaatctttactgactttttaagaaaccttcaacttcttttctaggtgatagaattacctcttacaaacccagaattattccagcgtgtaggaataatacctccaaaaggctgtttgttatatggaccaccaggttagtgttgaattatatctgacctactaataaatgaataaattaaggaataaaaaaggtgaaaagtgaataaattaaggaataaaaaaagtgaaaagtgaataaattaaggaataaaaaagtgaaaatttaatgtaggatcttccagcctccactctattcaaagtaaggaaagaataggacatgtgtgtctactattctctcaggtatgcttagtcctcttatgccttatagaatgttcatattaagatgttgtatgattctagtgttggtcctatgtggttcaccaacctctggctgtccctgaaatgttttcagggaatctgcaaggttaaaccttaatttgaaatactaagatgttagttgccattttcactgtgttgacttctatgctgatggtgcaacagcagcatgggtaaaactgctcctgccatagcattagtcaggtcagtggcatgaaatggcacaagtagtcattgtgttattgactgctcatatttgcaatattaaaaaaatatatatgagtttaacttttaggtgtccttgatgaagcattaaaaactgtttttatgaaatcctgatcttggaataatgtcttaaattctatgtattgaaatggaaaatacatgtaagtgcttctgttgcatactgaatagtatagttatcactgggaaaagcactggtatgttatttgagttgccagctgaattagctgcttttcgtggaatatcatttttacttgaaaacataatttatggacattctgtcattgtcagactggtttttgattattcggattggttattgcttatctgacaaatttttcaaaaatgaatgaggggcacctgagtggctttgttagttaggtatctaactcttcattttggcttcggttgtgacctcagagtcctgggtttgaaagtcccacgtcaggctccatgctcagtgccgagtcggcttgagttccctctccctctgtctctcctactcatgcaatcacacacactctttctctaaaataaataaatctttaaaaaaaatgaagttagcctactatgttacaataactgacaccatctgtagccaatggtaaaatttaagctttcaagtgaaaattaggttttcaaaacttatatctgacagggtttttttgttttgttttgttttttcttttttaagaaaaaacacatgtggggaggaggtggaagggcagggagatggagagggagagaattttaaacaggctccatgcttcagcatggaacctgacacctccagctcatgaccctgggatcatgacctgagctgaaatcaagagttggacacttaaccaactgagccacccaggcacccccatctgggattttctgatgttaatacttaaaaaaggagatgagatcggtgatattaacaaatgtgacttttacatattgtataatgaaaaatgccagctcgaagattttcatgactcatgaaccagtagcttccaaataaccaatagttgttacaatatcatgcataggtaaaagacatattcattatgcaggatagaccaatggattattgtgtaacaggcttctcttgtagggtctgtaaataggggttgatatatttttgaagtaagtattcagcattagaagggatttttttttttaagattttattttttcatgagaaaacagagagaggcagagacttgggcagagagagaagcaggttccctgtggggaaccccatgcgggactcgatcccagaactctgggatcacgctctgagctgaaggcagagccctgagccaaaggcagacactcaaccactgagccacctacctacgtgtctctaaaagggatattttgaataaaatttaaggttttaatattgtaagttgaagagttttcaaattataaatggaaattctctttaggatttagctttcatttgcaaaatttactatccagaggagtaaaaggcttttgagagtttgtttagtttccatctacttaggacttcttttgttattttaggtacaggaaaaacactcttggctcgagctgttgctagccagctagactgcaatttcttaaaggtaaagggaaggttctttttgtaactgttgaaattaaattttatttgaattgtcttatgtttacctaaatgtttttcctttaatcaggttgtatctagttctattgtagacaagtacattggtgaaagtgctcgtttgatcagagaaatgtttaattatgccagggatcaccaaccatgcattatttttatggatgaaatagatgctattggtaagaataacaccttttaaaatttatttgaactttttaaaaaagtcttaggaaatttttaaaattctgaaggagttcttctccccttctaatagcaatctgtgtgaagtaacaaaatggatgttactttatttttctttttcttgaacgttactttaaaaaaaattcttaagaaagcttaaccaattttagtttgatagtgacaaaattgagtaatgtcataacaaaatcaattctaagtttgtcagtataagtcttactattcattttttatcttaatgtttttaactgcagacactattattttgtcttcttaaatgatggttgtagaggaaagagtaacacatatgagtttccatgtcattttttccatatcattattttaggtggtcgtcggttttctgagggtacttcagctgatagagagattcagagaactttaatggaggtaatatttggtaaaggaggttaaaaagaagtcagtatgtattaaatgaaaacattggatatttaaaagtcaaaatgtgtacaatggtttgttgggctttttttttttaagcttttatttatttgagagagaacataagcagggagaacatcaggatgatggagagggagaagcagactccttgctgagcagggatcccaatgcagggctagatccctgggattatgacctgagccactcaggtgcccctgtgcaatggtttaaatgaagaacacacttaaggggcactgggttgctcagtcagttgagcatccaactcttgatttccgctctgttcatgatctcaggattatgggatcaatcctctgagttggactccacactcagtggggagttggcttgagattctttccctccgcccctccccgtgcgcacaggctctgtccgaaataaatgaataaatcttaaaaaaaatacacctaaatataaaatttgaaaatgtcaggaataaacacatttcactaccacaatctctagtaagaaaatgtctcctggaaagtaataggaatattacaaaattctatatgatgtacagctctactactccatgtgttttgagcagaccagccattcagatatttaaattgtatatttggggcacctgaacagctcagcggttgggcatctgcctttggctcagggcatgatcctgagtccaagatcaggctccctgtgaggagccttctacagagtgaagctaagtagtatagataacacaatgttaaattgtatcttagtaggggtatttgaaagggatttttcataaattacaatctgttcagaatatatatatagtattttcaaattagctatacctcctggaaaccttaaattgaggtgttttgaaagaacatagatactggtcttattcacataacatactatgttatcataatatgttaactagctatcagatattttggaaaagaaatacacattgttaagctagctatattttaaaagatttgttgaatgctgttagatttttcaatatttattcaagaacacttttggaattgaaggaaatatgtttaatgttttggtatttctttgtatagtggaattatttgaaaagatatttaatagattaattatcaaatatgtggaaatgtcatcaaatttgtggaatgtaaattttatgtctgacataccataatactgtatatattagacttttttaataatgtttttgaaaatacaaaaaaattgaatattggaaatcagatccacatagtttcattttataatacttgactaaaaaaaagtccattgaagtctgcacagtatttgtagacaatgtattttataatattagcatatagaattgtgtactttatattttttaatgattgaaatgttttgtaaatatctgtcaatgatttttatttacaaatatattagttactgaatcaaatggatgggtttgatactctacatagagttaaaatgatcatggctacaaacagaccagatacactggatcctgctttgcttcgtccaggaagattagatagaaaaatacgtgagttaaagttctttatctgctgtgtattctctttgtctatgtccacttttctttccatatctctgctcaccccctactttatttaaaaaacaaaaaacctgactgcatcttatgatttttcattttcagatattgatttgccaaacgaacaagcaagattagatatattgaaaatccatgcaggtcccattacaaagcatggtgaaataggtaaggaaataacttattttatgtatatttgcatttggtaaatgaagcaaaatgctattagatattgctgatagtctaccaaatttggttttaaattcggcaaacatggagatcttaaattcaactaatatttattgaacattttttgttaggaactgttctaagtgctggaaacatagcaatgaacaaaacagacaaattcctgccttatagaacttacattcttgtcaggcaagacagacaaagtcagaaaatttatagtacattaggttgtgatatgtgctatgtagaaaaataaagcaagggagataggtaatgcgaggagccagaatgaatatatacatctttaaatggaggtgaggtgggggaagcagagggaagctttaccaagaaggtgataaggtgatttttaagcaatgacctgtaaaggtgaaggaagtaggtatagatatttgtggaaaatgatgcaaagggaacagcaagagaaagaccttgaagcaggtgtatatatggctggaacacttcaggagtagcaaagatgccaaggtgtctgtggcagagtaagcagaacaatggtagcaagtgaaatcatagaaatgatgggaatcagattgtgtagagccttatttagatcattgtgtaagaactctggcttttattttattttattttattttattttattttattttattttattatttttttgtccttggaggattgtgaacagaggaatgaaatgatcttacctttgttatttttaactttgtagtgtagaaaattagaaatacaagtggagataagagtataatgaacttctaaccttacttaggtttacccatcccccaccaggctttaataattattaatttttggccaatcttgcttcatctgtaatctcttccacttaccttctggatttttaggaaacaaatcccaggcattgtataatttcatccgtaaatattttgaaattgatttatgttaaataagatcattctagttgcatgtagaggaacaaggatagaaacaagaggataagttaggaggatatttcaataatcagataaaaagatggtagtgtgatccaaggtggtaagagaatcttaaaatgatgagattctggacatattttggaaatagagattgcagggcttgctaatgaattagatgtggggtgtgagctaaagagaagaaccagggaacacttaggtttttgactcatgcgactgaaaaatggagttgtcatcatttaaaatgggagaagactggaaagattaggttttaaagggagagtaaggagtttggttctgaatgtattaaagctgagatgccaattagataaactaaatgaagatgttaattgataattctatatgcatctatggcttattgcagtggtctaatgctggtgatataattgtggataatagcataagattatttttaaagtcttgagattatatgagatttctgaagaggtaaatatggatagagaagagtttcaaaaactgagctaattccaatattaagaagttgagaggaagaaccatcaaaggagactaagaagctatagtcacagaggggaattaaaccaggagcttgtgatgtcctggaagataaataaagaaattgggcagcccgggtggctcagcggtttagcttcagcccagggcccgatcctggagacccgggattgagtcccgcgtcgggctccctgcatggagcctgcttctccctctgcctgtgtctctgcccctctttctctctctgtctctctcatgaataaataaaatctttttaaaaaaaagataaatgaagaaattgttacaaggaggcagtaattccctgttaaatgctgtgtcagtctcttcaataaatggtgctgggaaaattggacatccacatgcagaagaatgaaactagaccactctctttcaccatacacaaagataaactcaaaatggatgaaagatctaaatgtgagacaagattccatcaaaatcctagagaagaacacaggcaacaccctttttgaactcggccatagtaacttcttgcaagatacatccacgaaggcaaaagaaacaaaagcaaaaatgaactattgggacttcatcaagataagaagcttttgcacagcaaaggatacagtcaacaaaactcaaagacaacctatagaatgggagaagatatttgcaaatgacatatcagataaagggctagtttccaagatctataaagaacttattaaactcaacaccaaagaaacaaacaatccaatcatgaaatgggcaaaagacatgaagagaaatctcacagaggaagacatagacatggccaacatgcacatgagaaaatgctctgcatcacttgccatcagggaaatacaaattaaaaccacaatgagataccacctcacaccagtgagaatggggaaaattaacaaggcaggaaacaacaaatgttggagaggatgcggagaaaagggaaccctcatacactgttggtgggaatgtgaactggtgcagccactctggaaaactgtggggaggttcctcaaacagttaaaaatatacctgtcctacgacccagcaattgcactgttggggatttaccccaaagatacaaatgcaatgaaacgccgggacacctgcaccacgatgtttctagcagcaatggccacgatagccaaactgtggaaggagcctcggtgtccaacgaaagatgaatggataaagaagatgtggtctatgtatacaatggaatattactcagctattagaaatgacaaatacccaccatttgcttcaacgtggatggaactggagggtattatgctgagtgaagtaagtcagtcggagaaggacaaacattatatgttctcattcatttggggaatataaataatagtgaaagggaaaataagggaagggagaagaaatgtgtgggaaatatcagaaagggagacagaacgtaaagactgctaactctgggaaacgaactaggggtggtagaaggggaggagggcggggggtgggagtgaatgggtgacgggcactgggtgttattctctacgttagtaaattgaacaccaataaaaaaaataaaataaaataaacataaaaaaaataaataaaagtatgcaaaggatatgaataaataatttactgaagaattataaaaatgaccaataaatatatgaaaagacacacacacaaaaaaaaaaaaattaatgctgtgtcagataaatagacatctgagaatggacctttagatttactatgtggaggttattggtgaccttatcaaaacaattttttggagtgctgaaagagagagcctacctcaaatggatttcaggagattgtggcagaggcatggagttcagacatttctttcaaggagttctgcagcaaagggagaagaaaagaaatgtagctgcagtggaggtggagatgaagatttggaagagctttctttaagatgaaagaatttacaacacttttttaatgctaatgatctggatgagagagtgaaatttgataatgcactttccttgaagagagtttggcccattataccaaagtcccaaaattcaagccaaattttatcttacataaccaaaaactcacctttacaactaatttcttttaaaagattttatttatttattcatgagagacagagaggcagagacacaggcagagggagaaggagaagcaggctccatgcaggaagcccgatgtgggactctatcctgggactctaggatcacaccctgagccaaaggcaaatgctcaactgctgagccgcccaggcatccccgaatgtgtttattttctcagtgaaataggaagcaagttcagagtgagagatgggaaagtactgttagacatttgaagatgggagaagttataaaatagttatcttcagaagtgagagagtggactccaagatagttagcaaaccattgctgtgggtcaaattctatctgccttctctttttgtaaataaagctttattttaacatagccactccaatttgtttatatattgcctgtgactggtttcccactacaatagcagaaacgaatagttttgacagagaccacatggcctacaaagtctaagatatttactgtccggcccattacagaaaatttgctgactcctggactaggggtcgttatactattgtagtataattgccaggcagctttacaaacccttaaaagttaatggtcaaaaaaaaattacaaatagttgattattgcctgctactaactttctcattgtttacgtgaaaatagttttgagctggaaagactgagctaaactagggatgccaatttataggtttctttaatactgtgctcttgctaggtgccaaatgccgtgctaactgtgggaatccctgctctagggaagcttacatgaacttgaacctgaatcagaattaatgagtatctgtctgatttcaaatagagattgacatactctatgcggcctgacaaagggtatatatctcatcagaattaccctgtagggatatgtagatggctcagcggttgagcgcctgccttcagcccagggcatgatcctgaagtcccaggattgagtcccacatcaggctccctgcatggagcctgcttctctctctctgcctatgtctctgcctctgtgtgtgtgtgtctttaatgtataaataaatttttaaaaacaattacactgtagtagcccatgctgtgtcttatttttatccttactctatcaagtcaataactgctattccaagccaacagctcctcctttcaagtctgtcatgtggataaaaaggtcacttaaccattactgttatcatagatcaccacttggagcttgcatcggaaccagaaaaggtagccatttaaaaatggttgtttaaaaatatatgataaaaaaaatgatgaaaatgatttctgatgaccatttaaatatttggttacagtttttttttttttttaatttttttaatttttatttatttatgatagtcacagagagagagagagagagaggcagagacacaggcagagggagaagcaggctccatgcaccgggagcctgacgtgggattcgatcccgggtctccaggatcgcgccctgggctaaaggcaggcgctaaaccactgcgccacccagggatcccttggttacagtttttataagagacatggtttcacagatatctcaagttcacatgtacgtaactgttttgcttcatagaaacaggttaagatgctttcagatcttgatatttcttttttttttttaaagattttatttattcatgagagacaccagatcttgatatttcttgattttagagtttaagtagtatatgtatttctacttagtgctggcttacttaacagaagtataagttttggtcgttaatattgtggaggacttgctaaataatgtggaggaatgttaatagagatgatgcctaatattcaaagcaagctctgcagttaaattttccatataggcataagttagaaaaagtctaaatttttttaaaactaatttccaaaaaaaccaaaaacctaatttccagtattttttcctaaacagattatgaggcaattgtgaagctttcagatggctttaatggagcagacctgagaaatgtttgtactgaagcaggtatgagtttaaagtgcagtttttactattgattttaatttgctaaaaacatgtttgggtttatccaaaagcagagcctggcctttgcaaagatttgggtgcttggttttttggggaattgattctaagaagcaggagagaacaggcaagtgagttggaaagaagcaaagctattataagggtgtaccattaaggcagatgctatagacgtgggatttgatttgatgagacctcagagaaacatacagaatgcctcctaggattacctggctgatatggagactggagcatttatttcccagctctcatcccccatgagaatttgcccttggagatgttaactcctttttacttctggatgccttagggcaaaatgtggaaagacattcatgtgatagcatactcgccccctgaagtaaatctgccacatttgtggctgaaatcatactgggccagtaacagaagtaatctgctgcaaaatggaaaacatcttttctgattctagtctgttaacaatcagtgttgcaagatggatttaaatgttttttaattaatttttaaattttttaaaaaatattttatttatttattcatgagagacatagagaggcagagacataggaagagggaggagaagcaggctccatgcagaaagcccgatgtggttcttgatcccaggactctgggatcacaccctgagccaaaggcagacactcagctgctaagccacgaagacgtccctcccaatttttttttttttaattttatttatttgagagagagagagtctgtgagagagaacaagcaggaggaggggcagagggagaggaagaattagactccctactgagcagagatcctaatgtgggactcgattccaggagtaggagctgagctgaaggcagatacttacctgagccatccaggtaccctgcaagattgatttatgaattttgtgatcatgcaacttgtgtaaaatgtaatcatttttaatataattttctttgtgcattgtgtaatcctattttttattttatttctggtaccaagtagctttaaaaccatagctagagtcatttagtctttgtcctccacacaatctttttttttttttttttaatttatttatttattcagagagagagagagaggtgaggcagagacacaggcagagggagaagcaggctccatacaggaagcctgacatgggacttgatcccaggtctccaggatcacaccccggaccacaggcggcgctaaaccactgcgccaccggggaagccccacacaatcttaaaattaaaaaaatgaggggtgcctgggtgacttagataaatgtctgattcttgatctcaactcgggtcctgatctcaaggttgagtttactataataataaaaaaaatttttaattattttttgctgtttttatagttactgactttcataggttgcaggtgagtagttttaaagtattgtaatatgtgatttcctcttgttttcgtatcaccggtagctttgttttaacatttcttgtaaattaaacagtattaaaagaggttgctaagacatgacttcttcataggattatcttcatgggttgctcagacatgacttcttcataggattatctttatggatctattgtgactcaatatctggattaaaaatctgcaggtctagaaactcagtacagatcagagtaaatcatgctcacaaagacaaatatacaaaaaatgttaagtggtaaacttgcatgtggcttgaactacttggagtaatttacaacattctctttccaaaatcttcactggaccaaattactattagaatattgttgtgagggcagcctgggtggctcagtggtttcgtgccgcctgcagcccagggcctgatccaggagacccgggattgagtcccgtgtcgggctcccttcatggagcctgcttctccctttgtctatgtctctgcctctctctctctctctctctctctctcatgaataaataaaatcttaaaaaaaaaaaaaagaatattgttgtggtaaaataaaaaagcaatgtcataatcctaaaggttgataacatcaaattatgatacttattgtttttacatttttcagttttattgagaaataattgatacatatcaccatataagtctgtagctactgtatgatggttagatttacatatattgtgtaaatgatcacaatagtttggctagtatttatcttctcatatagatacaattagaaaaaaggaaaaatagtttctccttgtgataataactcttaggatttactctctttcctatatatcatatagcagtattagctatggtcatcatgttgtaaatccctggtacatatttattttataaatagaaatttgtacctcacatattttttgaaaattattttcagttggggtacctggctggctgtgtcagtagagcatgcgactcttgatctctgggtcataagctcaagccccacattggatgtagagcttactttaaaaaaattattgttagccatttccagtaaagagctataacgtctgtgtggattacaattttagctttttttttttttttaaggttttatttatttattcatgagagaaacagagagagagagaaagagagagagagaggggcacagacacaggcagagagagaagcaggctccatgcagggagcccgacatgggactcgatccctggtctccaagatcacacgctaggccaaaggcggcactaaaccactgtgccacctgggctgcccacaaatttagctttttaaatggcctgggacactcatatttggagacactgaaattctctggttttctttttattagacgtcaagcttttttgctaacatcttcctgtaatttaaaataaacttgattcggttataattatctttcccattcaaatcctgagatgattatcctttttggattagaatgtatctcagattcagtcatacactaaacaatgatttggaaatagtcatatgtacaaagtctggaaaaataacctactttagttgtagctttcaaaacaaggttttaaaatttcattattaaaaaactagaaatttccattcatctgatttttcagtacaacatagagtggctatttctaagactatatagaaatcttgaaaggaaagataaaagtaacccttgaaatcttctattccattgattgcatgcatgtacatgaaaagttaatataagcagatcttcaaacgaaaatattagtaggattcatttaattagcagatactgataacttactagttttagcttataatgaaattagggggatccctgggtggcgcagcggtttggcgcctgcctttggcccagggcgcgatcctgaagacccgggatcgaatcccacatcgggctcccggtgcatggagcctgcttctccctctgcctgtgtctctgcctctctctctctctctctgtaactatcataaataaataaaaattaaaaaaaaaaatgaaattaggattgtctcaaaatcttggaccccatatccatgatatatgtaatgttcaaaaacatgcacatgcgaaacttattgttttgtcaagtaacttgttgataacttgaaagttttcaagtttgtgatacttgactatgaaagttgtataaaatcccaatttgtacataaataatgtaaattttaatatgtgaataacggcactggctttttttttttttttttaagattttcttatttatttgtgaaagacacagagcgagcagagacataggcagagggagaagcaggctccatgcaggcagcccgatttgggactcgatcctggggtctccatgatcacgacctgagctgaaggctaatgctcaaccactgagccacctaggcatccctagcactggctttttgataaaaagcctagtgttggctttcttttattcctattatctaagcttttgaatattaacaaggaaaggctatcagaattactggaagtgttttgtgttcctaaaccatatatgtgttccctccttcaggcagttgttgtctatagagttaagaaactactacttaaaatatgttgatagttgagtttttgttttgctttttcagaatgtcattggatacagggactgagcgagctagattttaaatatccagatagttgcctcattgtggtttagcttttggtttggaaaataatgcttattatagttaaggaaattaagtgaacaatgatgcttgtttttaacaaattagaactactggctcaggggtgcctggctggctcagtcagtttagcatttaaatgtctttggctcaggtcctggagtcctgggattgagccccacaggaatcaagccccacaatgggctcgctgctctgcagggagtctgattctccctctgcccctcacctcactcatgctctcattctttcactctttctctctctctctctcaaataaataagtaaataaataaataaataaataaataaataaagtcttttttaaaaaaccagcaactactggctcagaagtaatacatttaggcttcttcacatttactccatagaattacttagttttcctaaaaaacgtttttttgagatctaattgactaataagattatgttgatatcaggtgaacagcataattatttgatacttgtttttgttatgaagtgaccactaatctagttaacatccatcaccacatgtagttaatgatatttttctcttgtgttgaggacttttaagatctactctcaacaattttcaaatatacaatacagtattattaagtctggtcatcatgctgtatatttcatctccaggacttattttataattggaaatttgtgccttttgactaccttcacccattttgcctacccgccccccttagttttcttcaaataaacaaattattcacatactatatacagcagtgatgttgttttattcttcacaggtatgtttgcaattcgtgctgatcatgattttgtagtacaggaagacttcatgaaagcagtcagaaaagtggctgattctaagaagctagagtctaaattggactacaaacctgtgtaatttactgggaggtttttgatggttgcatgacagatactggcttaatgtaaaaataaagttaaggaaaataatgtatgtattggtaatgatctcattaaaaacttatgaataaaaataagtatgaataacattaaaaattagtaattcagtaattctacttttaagattgataaagaaatttgtatgtttgttaatgttgcatttattgcagcaaaagttatgagtatgttgaagcttttcgtatttgctgtgtgagcattttgtaaaacattgaaagtagtttgaaatagtacaagagagcatttcttatgacttattttatatcatttgttttcttcatcctaaaaagttgaataaaatgtttgattcagttctcctacacatatttttgtcttttttaaaagtacatttattatggttctttaggttctttagtacataaactatttaataaccaaaatgagttgcatttagatcacaggcttttgaattttaaaactgcacccacactcagtgttccgaagagcatcttgttatataaagcatagacatgtgtgtctaaatcgataatgaaaggtctttactcttcacctattatgattaggctgtgtcatagttaattgaacaagtacatgcttatccataacttttttttttagattatgattaaaagtaatatttgctaacaaatgtgacttggttttcttgatttatgtgagatggttgttccctttttataatgttaaggtctggagcctcttcccccaaaaagtcacacattcatacacacaattatgcatatactaaagtgaaaggagatttattatatctcaagctcacccattgactctgtaggtatctatggataccaagctaagagtgtctgatgtaggggatgttgatgtcagaaatgttcaaagcaaaagttctgttacctacatacaattctttctatatcatgtggaattaaagctttaacaaattaaaataggaagtcatcatttgacttcaattgagattttgttaaagatgctgtttcaaaaaagccaattgacttcagtttcataaacactaaagaatgtaccatatttgatgtgggtagttacacagtcactctttaaacttacttgtggagtattgtgggtctttttataactttaaaaggtagagaacagtttaaatagtggtagagaaatggagtactcaagctagccatttaatattcaagttattgaccagttctatttctacattttgacagtgtgtttcataaatgtgacaatataaaaataataggatgtttgtcaagggggtccaggtcaaacatccctgtgattcttttaactttattcattgtaatttgcaatttagtttgacttcttatctttctacttaggtggtggtgttttgttttttaaagaatcagtttggtttacaaatcttgaaagtttaaatgtggattcttctgcttaattttcctcatccgtttgaaaataaaaaggataatagtatctccttaagcccagagaaagtatcctataccttatttctatttacaatatgttaacagactcaaactttaaaagatactgaaagccctgtagtttattaacataattatattaatatttcaacataaacttagaatgaaagagagcttccttcactatgatgtgtaatttactgagtgaacccataagttgtttctatttcttaggatttttatttccattgtttcttgagattttctagttgtcatattcccaagtattcttaaaagtccgtttcagtttgcttaaaagtgatgggttcattttctgtgtagcataacctagttttaagatgaactcttcatttattactcttttggttataaccttaccacagattgcgcagaattctgagggtagaaactacagttttcctttcagatgccagtttctggtggctatgatgttttgcccgttcttatactacaaaaaggaattgcgtcctgtctggaaagggcagagctggtctggcttgtcccaccgcctttcccaggaccttcagtcgttccctccctcctgccgcagccccacctcctccacacccggtgagcttcggccgttgcttctccgaggccccgccccccccgcgtctgcgctctggcgaaggggcggggcggcggcgcgctgacacctggcggccgcggggggcgggccaaaggcaagcgtgggctgggattggctggggcagcgcggggagggcggggggaagcaggggagacggttgtagggctcttgcttgtgcccgagcccgtgcggcctgaggggcgcggagactcagggggagggagacggcagcagcatggcggccgggtatgagccgcccaaccctcctcttccccgctgtcgccgccgtcgccgccggagtcgctgggaccttttagtctgcgcgtgttagttgtaagcccgctgcccgcccgtcagccctccggtccacccgccctccttcctttctctgccgctggcagcccgagggtcgggcgggccggataactcccactcccactcccaccccacccacaagccccagggccgggaccatggaggacgtgaagctggagtttccttcactcccgcaatgcaaagaagacgccgaggtgagtttgtcccgtgactgccacgcacaggcctcactgtgtggctccttgaccgcggggcgaccccaggccccaaacgtcgaagtctccagctccaccggagccctgttgcctcttgaggccgtcttgggacctcgggtggagctccgggacggtgtacctggaccctcattcactgagtatcttttcccccctggtggaggggctgccgggtctcatctacttaataaaaaggggaggagaaaagtaggtatccccccgccccaacccccaggcccggcttcgaggacttactctgagtaaggttcccctttttattgctaaggaaatacgaaggtaatgttttaaatctcaatttgagagagatttggtgtcatcgatttgcttgtgggacacatggcccccacacgtgaagtagatctggggcctcaactttcgaagtgtgccttcaaaaagttttccaaggtagttgtttggtttttttttttgttttttttgaggcaaaactgtgacccgcagaataaaatgtcatgaagctagcacatttaaatctaaaaacttaaatcatgaaacttgccctttggaagggagttgatagaatgaaattctttataacctttctcttgatttctaactccagattttgtttactccatcttcttccttgtctaacgtttgtattgagtttttcccccatctattgctagtttaaaacactttatggtgttgcacactactaaaatatttctaaagactaaattcagggatactcggaaaaaacaaaagacaaggatactcaattatcctctagtaggattgagaaaaattaaatttctagttctaaatatcttaaaaataattggaaagctgtatttttaagaaaccattcagtttacaccaaatattcttttgagtatcttcttttggggttctcattttttatttggagggatcctctgctcgtggtagtattttttgagaatttcatattttaagggtagacaaataggaaaaaaattgaatttaggttagtttaaaaaataaatttacacttttctttgtttaatatggaataatgtgaatgaggaatatgctttttgtccttaaagtgatttagtgatttcagtctggaagcaaccttaaggaataatatagaacattctcttttttcaggtgaagaaattgtagcttattgagaataagtgatatgccaaggtaacagtagtgtaagacacagttgaggaccttggtctcttgattcctaattcattgtgggtttgtttttttgtttaaagattttatttattcattcatgagagacacatagagaaggcagagacacaggcagagggagaagcaggctcccactagggagcgggatgtgggactccatcctagaaccccaggatcacgctgccctgagctgaaggcagaggctcagccgctgagccacccagggatccccctaattcattgtttttaatatacctccattctttcctgctctgatctttaaaattctagtttaaaatatttacagacttgcatttaatcttttattgtgtatgtgtcttattcctataaaaattataaaatcttactgggaacatagctttctttcctgtgcaaggacagatgtaatgcttaaagcctagtagataacgacacaagtattgtttactgaaagccaatttattgtttttttcatagcattgtatgtttgttttcttttggttgcaactgacaaaaaaccaactcagactagcttaagcaaaaagagaagaattaaacccagaaaggtagggatgcagctggtctcagggacttgactagacagtctcaatttatgagaactgcctctgcctcatcagtgcttgtctatactttctctcagggtttctgcttttactctggcttctccacagataaggagtttgactgccagctgcttcaaggtcacatccttacagagcttattacattgaggaataatatctctctaagcttcagtatttaaaatctagaagattggcttaacttaggtcatgtgtccatcttttggatcagaccctatgccataaagttgtgaatacaatgaggagcccagtctgggtcatatactcacttctgtggccaaggttgccggggagggtgtgaagtttatcatggatagtcctaccaatacccataggagcattcccacagaagatggaggatgctttagatggagggtgctttctggcagacaaaactataaataatcattaaacagggcatatagttactcctgataaactaataaaacaatgttaattttctaatttcccatgagatatataaagtgtcaaatggtcttacatagttatggtgaccagccaattaatagtgttcttccacccaggaagcatttcatggaaacctaaattacaatccaaatcttgttttagtaaaaatggaattgaagtagagaaatttttaatgcattctcttaatgatgtgatcaatctatgacagtttgatgatccgatcacctgtataagaatatcagttccttgttttctgaaataccagtcaaggcattctttcaggacagtactagccaaaatttagctgtgttcagatcagtttgcaagaagattgtcactcctctgtttaaaactttgctgtgatttcccattgtttgcaggatgaagttcaaacccttaaccttatttgcaaggttgtgtgagatctggcatctgtctgcctttgtaacctcattatgaactactctttcccttgctcccttctgtgtttgccctagccatgttcattttctctcagttcctggaatgttttggttcctgctatacacacccctccccagtacttttgcatttgctattttcccctgctgtggccaccaacactacccttgccctcacctaattaactgtttggtcttgggttagatctcactttaggtatcctttcttgagaaaggtgttccctgattttgccaattccttctgttccccttttgtacccttccactccccagaatagtttaatcctctaggtttataagtctctgtagcacttggtacttttatacctaccttttaacagatattctacttgtagttttggtcgcttatttgccatgatatttccatgaatatttcacaaggtagtttattcaccaatatgttcccgtcttattgcccactctttcttgcacttaacacagtgtccagttatatatcataagcttaacaaatgtttgttgaattaatgaaagaatcttgattggtgttgataatagaatcttgtgacaagattacagtagtttctttataggtatgaagaaaagaacagcttacgttatcaatttttaaataaattagttgcatagttagggttattggttttataattagaaattaatgttttcagatagaaaatgtaatataatttatttcagttgcaatttggcaactgaaatgttactttttttctcttttgatgcccatagtacagaataaaaaataggaattgcttaatatttctgattgagggcctttaaatttagaatgatgctttttaaatctgactgtagagtagaatcacccagggggctttttaaaaaataaccattcctagactccaccatcccctattctgatttaactggtctgataaggagtcagataattctgatggcagccaggtttatgagtaactaacttcaaagcatcttacttgaatgcccttctgccttttggttttagagtgaaaaactccttttgcctttggttgaagcgaaacttgaaataagaatgagaattaaaggaaaaggcttattatgaagagggctaccatttttggaggagagaaactgcaatactattttttctgttttgtgaatgtcccagctctagtatagtattttgatgattttttttctctgaacgctcctcccatcagctaaaattcataatctattttggtatttctaaaggttgttaggtttcatccagcctgatccatctgataataaggattaagtttttattttgtttaatggttacagcctatatcctttgctgtgtttatttacttatttactgatctttggacatttttataacatctttctatcccctaagtgcaattttatagctcacataactgcatttgtttgagaaggaaggagaaaacctgaaagtcctaccttcttcaatcatcaattgaggattgatgattgaagaatttttcattactgaatttattttcatcagaaccatagtgtgtttcacaattaggggtattttgttttagctgctttgctttggtttgaaaaaatatagttggactggttgctaatcatttaagtttggggaactgattctactaattaagtacagtagtaactcacagtagatcattgggaatctgccccattaccactactatctctaaactgatggattttagcagcaacgtgggcaggctgagattaagattgagtgtgatacaggcaagacttggttggtagagatgttcagacagatggacatctagtagagcaagagtgtgagcatgaatgacttaaaatcttgatttagtatgctaaaggtattagcagaattggtagagaagacaggattaagatttgttttgtagggtagttatcagggctagactctggaggtcaaaatcgaattctagcactaggaatagtttaatgaaatcttctgtgacagaaagcttttagatttcaaaggtttcatgcctattatggcaaatttgatgcttacagaaacaggctgtatggtttactgtccggtgaataggaataatttttcattctctcctgctaaacaacttgctttttactcctataatatcttccttgtataaatacagcatatacgttctattgtatacaatcatttggaagttcaaaattcctttgaaacctcttatttcactgaaaacttaggtaaattttgcattctatcccatgtggtcatgtttatttaattttatttatttatttttaaaacaaacttttttttaagattttatttattcatgagacacacagagagaggcagagacacaggcaaagggagaagcaggctccacgcggggagcccaacgtgggatttgatcccgggtccccaggatcaggccctaaactgctgagccacccgggcagccctggtcatgtttattttaatataaaaatgttttaaattagtggtcagtgaaaaccgtttttctcaaaaaaaaaaaaaaatcttttggtaaaattggtaatccagaaggaagcacatttatcctgtgtctttgccttctggcatagatattgccagatattccctggaatatatgtacaccatttcactatatacatcctcttttttttttcatgcacagtttagaaatttcattttaggtaactcaaaagtacacatttcttcaattgctattcttttttactctcgcaactggtaagtttctttgggaagataagacggttagactaagaattaagaataggaagaaagaaggaaggaaaggaaaggaaaaaggaaaggaaaaaatctagcatcatacatctccacaatgtatatctatcatgtgcttattctgtgacaggctctgctcagtgttagggatacagtgatgaaaatgacaagagtctttggcttaagttctttaaaaactttttagtataaaaaggttataacatatcattaaataagagatacataaacattcattttgtacaaattgattacatttattccttggaaattaaatacattatttctttttttatatatgtatatatatactttatttctataagttaattattttatgcagtcagaatttggttaaatacaattatgtctgccatatagttccttcttacattgagtggctatatagtgtcaatgtttctgaagtcagctgcttagactcaaagttacttaggctctcagtggctaaagtagaaatataagagagaaaataccttttctttgggggggtgagcagagagaaagggaagatcctaagccagagctccatatccagcatggatcctgaggtagggcttgatctcaccatcctgacatcatgtcctgagttgaaattaaagatttggggatgtttagccaaccaactgcaccacccaggcactaccttttcaaaaacatcttttggaaattcctttagtaagagtctactggtagtaaactctgtttttgtttgtatgggattaatcttttacttcactctgttctcaaagatgattttctgagcatatattctagattcatgattatttcaccactttctatgtattcttcagtcttctggcttttattctttcagttgagaagtcaaggggagtctatttaatctcttgttcttatttgcatgtttcccccttttttttaaaaaaaaaagattttatttatttattcatgagaatcagagagagagagagaggcagagacataggcagagagagaagcagtctccatgcagggagcctgatgtgggactcgaccctgggactccaggatccgcccagggctgaaggcaggcactcaacccctgagccactcaggtgtccccacatgttcccttttttttaaggaggagtaaaatttacagagtataatgcatagatattaaatgtgcaattcagtgaggttttttttttttaagattttatttatttgagagagagagggagagcaagcatgcacacagcagtggggaggggcagagggggagagggaaacagactccctcctgaatagggagcctgatgtggggcttgatcctgggaccctcatatcacaactgaagccgaaggcacacattcaactgactgagccacccaggtgccccaaattttgataaatatatagaccagtgtattactcttatcaagatacagaacatcaatgtaaaaagttatatcacatacatttccaggcaacccctatcctattccagataggcaatgaataatgatttttataaccatagtttagttttatcttcttgtacttcatataaaaggaatcatgtaaaaggggccctattgtttatgactgtttttaaaagattatttattttagggcagccctggtggcccagcagtttaacgccaccttcagcccaggatgtgatcccaggatcaagtcccaggtcaggctccctgcatggagcctgcttctccctctgcctgtgtctctgcctctctctctgtgtctgtcatgaataaataaataaaatctttagaaaataaaagatcatttattttagagcatgtgtatggatgggggaggggcagagggagagaatcttcaagcagactccccattgagcatagagcccaacttggggctccgtctcaccacatgtgagactacaacctgagccaaaaccaagagttggatgcttaactgagtaagccacccaggtgcccctatttatggctttttttcatttaacataatatctgtgaaactcacctatattgtgcttgtaagtagtagcagattcttttttattgctgagtactatttcattgtatgatcactgtcatgatcttggggtcctggcatagagccctgtgtggggttacttgctcagcaaggagtctgcttgaggattctgtctcattccttctgctcttccccctgctcatgtgttcacgtgctctctcttaaataattttttttaaagatttatttatttatttattcgtgatgggggggggcagagacacaggcagagggagaagaaggctccacgccagaagcccagcacgggtgcggggaactcgatcccggaactccagaaccatgccccgggccaaaggcaggcgccaaaccgctgagccacccagggatcccctctctgaaataaatttaaaaaaaaaaatttttttaagtcttttgtgccctctttaagatatctttgcttttttccaaggttgtaaagatattttgttttcttttagaagttttatcatttttgcagttgtgtttatacatacattcatcaagtatgtattaagtgcctattatgtgccaggcactgtcaccgagtgttggaagtagaatgcagcagtgaagacaggttaagatgtttgtgtgtgaggaggagtcaagatcagaattgattttattttccaaacatttatctattgttccagcaccagtcattgaaagactctccgttgaattgccttgttgtctttttaggaaaattaattagctgcatatgtgaaggtcttttggactctattccattcctgtttgcttttagtctacaaaaagaaattctgttcatgtttggtatactatttacctgtgtatttctttccccttttctagcttgggatttattcactgggctgcttatttcagagatgtgctgtctttaaccagttttggaaaacttttattactatcttgtgtaacattatctctcctttattttctttcttctccttttggaacttagacttcatggatgttagacttttaaattctattttatatgtctattaactgattctattttccaactctgaatttaggtaatttcttcaattctattttccagttcataaaatttctctttatctacatccttttttccctttagcctatccactgatttttaatttcaattgtattttttcatttctacatattcctttcagttctcttaaaaaaaatttcttaaaccttggtcatacttttggtgctctcatttctttttcttttttttttttttttttttgttctcatttctttttatattaaatgtatttttcattgtcctaatacctgcagcctttgtgaatgtgattcagttgtatctggtttttatggtggtccatttcctcctctttctttaaaaattcgcatttatttgtgagctcattgaaactcatctctgtgaattatttctggtctagattaggatatgcttctctgcagaaggtgcatttgcttctcccaagaatccatggacactatctacccaggatcatttgacattgaattttcacttggcctcacaaaaatcattgaattgtaatgccaaagttgagtgaaggccagattgtggttaggaagatcccattccaccactactaccacattctactcagtttcaaagctaagaaaggcaggagtattcatttctatggggatgaggtgagtttccttccctcgcctatctccccagtttatcattcactgagactgttgcctattggaatctcagctttctagtgttgatctttttctttttctttttctgtttctttttctttttctttttcttcttttctctttcatctttgatcaggtcccaggctttgtcttatgtctcacatgtacaggatataaaataaggccatgatgaggatgtggaacagctgcaactcccatacattgctagtggaagtgtaaattggttttggaaaacttttggcagtatctaataaaaccaaatatagtggggcacccgggtggctcagtggttgagcacctgcctttggctgaggttgtaaccccagggtcctgggattgagtcccacattgggctccctacagggagcctacttcttcctctgcctgtgtctctgcctctctctctgtctcatgaataaataaatgaaatctttaaaaaaacaaacaaatataggcctaccctgtgacttagtaattctaattccattgctactttttttaaagattttatttttttaagtaatctctatatccaatgtggagctcaaactcctaaccctgagatcaagagttgcatcctcttccaactgagccagacatgcacccctccattgctgcttttatagccaagagaaataaatgtgtaagtgcatcaaaggacatagaagataattttcacagcatttttattcatatttgcccaaacttggaagctacttaaatctcctgcaacaggacagtgagtaaattgtggaatattcatacagtagtatattgtacagcaataaaaaggaccggacagcatgtatgaatttcatagacattaggttgagtgaaagaaaccagacataaaatagtagtgatgcgattccattaatattaagttcaagaacaggaaaaactatagtgatagaagttagcgctcacttctgtaaagaggatattgcctgagaagagaaggagggaactttctgggatgacgaaaatcttgacgtgggtagtaattacatggatgtattgcctgtgaaaattcattgagctttacattcagatttgggtgtttaaacacttcattgtgtgttctttgataccccgttttaaaagaacagaaaaaatataaggccatgagaaatcagatcctctcaggatatgacttctcagagtttatagtctactaataccatattgccaagatccattttcaacattaaagacaaaaaaatactttctgttcattaaaaaaaattgctgtctcttttctgtagccaaactcaagaggtttgctacttgaggtgcattaaactgaacacagcccaaggaagtattgaaaacagaattttggggcacctgggtggctcagttggttaagtgtttgacttgattttggcttaggttgtaatctcagggttgtggaacctgtttaagatactctctcctaaaaaaaaaaaaacaaaaaaaaagatactctctcctctccctctgcttgcttgctctcttaagaagaaaggaaaagaaagcgaagagatttttattaatttgtcacaaggagacagggaaatggttctcaaagtactgtttcccccttggggtacatggatgaaacttttattcagtgtgctagggaataaggccaggggagcttgatacattaaggaatttacacattttattacctaggcacttggtttcagctgctcatcttagtatgtgaacatgctagtgtatacattgtatgttcaaaaaatggttgtaaaaccttgcccatgggagatcttaattttataatgaactaaaggtaaccttagggcaactcagagggcttctatgcaggtcctcagctccaaactggctcatggaggagggtatttgatggaacacctagccatagcttcttgttctgcaaaacagacaaattctttcctggctttaacatttctaccttatgtgttagaaatattttttgacttggaaaatctaggtgaagagtaaaggaaatttcctagcactatatttaacttttctgtaattctaaaattatttaaaagtgaaagtaggtttttttttttttttgagaggagggggagcaaagtagagggagatatttgtttttttatatatagatttatttatttgagtaagaggatacaaggggagggacgaagggagatagaagcagactccgccaagtgcagagcccgatttggggctctgtctcatgaccctgagatcgtgaccagagcagaaatcaagagtctgacacttaactgactgagcttccctggcaccccttgtttgtttgtttgttttattttttatttaaattaagtttaggagcacctgggtggctcagtggttgagtggctgcctttggcccagggcgtgatccaggagtcccagaattgagttccactttgtgctccctgcatggagcctgcttctccctctgcctgtgtgtctctctctctctctgtgtctctcataataaataaataaaatctttaaaaaaaaatagaatttagactggagagcaaatacacaaatgtacttctaagcaggtcactatgtagagttgtagaaattgcaagaagcattcactggatattagcttagcacggcacatattttctgcaaattgtttcaatcacagagcatttaaaataacattttgggttaaaaaaataaatttagttaacctatagtttcagaagtagaatttagtgattcatcagttgcatatagtacccagtgctgattacatcaagtgccctgcttaatgcccattacctgattacccaattcccccagcaaccctcagtttattccttgtagttaagagtctcttatggtttgcctccctctccattactttatttttccttcccttcccctatgttcatctattttgtttcttaaatttcacatatgagtgaaaaccatttgatatttgtcttctctgacttagtttagcagaatactctctagttccatccacatcattgcaaatgatccaaaaagatttcattctttttgatgcctgaatgatactccattgtgtatacataccacatcattatccattcatctgtcagtggacatctggactatttccatattttgactattgtggacatttccgttataaacattgggatgcatgtgcccatgcatgcatctctgtttttgtatcctttggataaatacctagtagtgtaattgctgggtagggtatttctaattgacatacaatgttacattagtttcagatacattacatactaattggacagttctatacacagctcagcgctctccattaagtgtaggtaagttctgtcatcatacaaagttattccaaattattgtctatattcctgatgatgctgtacttttaatccttgtcacttattttataactgaaagtttgtaccccttaatccctttcatctgaaaataaaagatttttttaaaaagcttttcaagtatttttttttttttttttttatgatagtcacacggggagagagagagagagagagagagagagaggcagagacataggcagagggagaagcaggctccatgcaccgggagcccgacgtgggattcgatcctgggtctccaggatcgtgccctgggccaaaggcaggcgccaaactgctgcgccacccagggatcccgcttttcaagttttaactttagaaaactcatttctctttataattctgagttttaagcaactaagttagaaacttttggaatgtagtccatttataaatgaggactatttgcaccatgtttgattcttcgtatcaattcactgtaactgcttttttcttttcctgatttttctatttttttaaagaattatttattttggggatggaggggcaaaaggagagggagagaatctccagctaactccctccatatgaggggtctgacacagggcttgatccaaatgatcctgagaccatgacctgagctgaaatcaaaagtcaggtgcttaaccgactgaaccacccaggtgcccctcttttcccaacttcttccctttttttttttttttttttttttaacattcattcattttggagagccagaacacaagagggaagggcaaagggagagaaaatcacaagcagactcctgctcaatgtggaggcaggtgcatgcaaggggaggcggggggcagagaatcttacaaccacaagatcatgtgaacggaaaccaagagtcaggtgcttaaccagttgtgccaccctggtgccccctttcccaccttttaaaatgttttctgtcttctgctgttggcattttgcgttatttcccaacttgtttgttttggtctgcattccaaagacagaatgaattctatacttttgtgaaatgtatctttaaagggaatcaaactaaaagacaggatcttaagctcaagtaagatatgaaaagggctgtttgataagcatttagaggtttattagatcagggatggcaaatacctgtcacttaacattctttcatccattaggtatacttctcactaatcgcagtactcttcttgaatccttcacacttagctatctacttggttagagttgacatgaatcacaaaatagctatttgacatttctgttttggaggatcagttttgagaaacttctagagtttgtgttcttttaattaatgaacgggtccatccattatatgaaataacatcattgtaattatggaagtacaattatctaaagaataccttaatctttgtttcttgtcacttaaaatttcaggtgtttgtgaagccagttttaatttatttatagaatattcttaaagtacaatgtattctttaaatatccatatattcatatgtcacatctttaacttttaaatgggtaacattttttatatgtcatttacttttattctcatgttttctttccatcttcaaggaatggacctaccctatgagacgagagatgcaggtaaggtaacctttttgtttttttaagccaacccatattactagtaccattattaaataacattatttcacaaaggatttgagccctgttggctcatgatttcatgtaggttcatcattgagtattttaaataatcagcatgtttaaggttaatcatggatcttaaaaagatgggaaatgaattgtttccttttttccttagattagaatcatggacatagtaataaatgtatgtgtaaaatgagtcactttgttttttcttatctgaaaaatttgatacagtatttttattccttttgaaaagtttgctttctctgtttgactagtttagaaaagtccaaaagaattgactataaggcaaatcactcctgagtaattgttcctctttgtgtctgatttccagtcaacttccataatgaagtttccagaagactgagttgaatactcccaatatggaatgataaagtgatagttaacccttgtagcagattgtttttctttgtatttcttaccatttacactctgctagccccagaatcaagcagtgtctcctgttcctgggaataccttgacttatgaaaatgtttcatttctttagtgaaaactctctttttaaaagtagcttagtatctgtgaggcattttatttggtgctttggggaatacacagatgagtaaagtgtaatttctgccacaggaagctggtaggagaaatcagacctatactcaaataattacagtttttcatagaactgaactacaaaattatactgtattagtatctaggatatgatatagtccaactgaaatctttttatgttgaactcacatagaatcaattttaatctagcatttggaaagtatttaaacaatttaaaattgttgaagctctgtcagtaggcagatatttggtattggtcttttttaaactttgcaatacttttattaactaaagataacaacacttctaaccttgtgtcttgagctacttttgatttggctaaataaggttttgtgtaattccaaaggggtgattttcttaatgcctattttatttctagactgtatgagagagaatataaataaaattagagatgttttattaataagtctaaaagacaatcatataggggcacctctttggctcagataagagttggattcttggttttggctcaggtcatgatctcattatcatgagattgagccttgccttggtctctgtgctgggcatggagcctgcttaaaattctctttctccctttcttcacaccctcggtctttatttatttatttttttatattttatttatttattcatgagagacacagagaaagagagagaggcagagacacaggcagagggagaagcaggctccatgcagggagcctgacacgggactcgatcctgggactccaggatcaggccctgggctaaaggcggcactaaaccgctgagccaccagggctgcccacaccctcggtctttaaaaaaaaaaaaaaaaaaaaaaaggatagtcttacaatatgcttattttacccaaactgctttttaaaaggcactgtggaaaaaataaaaaaataaaaaggcactgtggaagttcacatttcacattatctgacttttcaaaaccagatttaaactttaaatgtttcacctgatatataaagcacatctgcatttcctttcccaatcattggctcagtgtggctaggaaatgttccttaaataacaagctgttttgctaaaaaaaattattataacaactatggaaatactccacaaatccactcatatggtatatagtttgtatagatttaaatttttaatggtcaatatctctattttatttttcctaggaaattttacctggactgtttctaggaccatattcttctgctatgaaaagcaaggtatgaactttaggttaggttcatcaaaagactattaaccagcttttttgaaataaattttttagtagtaggcgttttatttgaggtaagatccacaaatattgcatgtcagcctggagtaccgacctatttaaattttactggaccagtcattgtcaggtatttcacaacaaatcacaaatgagcttttctatgtattatttttcttgtgaaatccatgtatttgaaagatttactaaataattgactttttatcctctaaaatatttgacatctatcattgctaatcgtatcttctgaacgatgaaatagaattaaatcctaaaacaagtatatttgacattttaatctttccttatcaagtgtaaatgtgtgtgtgtggagggggtgtgtacatgtgtatgcacatgtatcttaattgataaaatcttctgtttttgcaaacttcagagacctatgctccaggtcgtaaagtattatatcatatatatctgtctcctgtatagtcaaactgaaatggatttcattcattacacagttaacagggtagatctcattttactatatgcagcaatgttgttacttcctagaagattcagtcttatgaattatgacaatgctactaattcattttgaattataatgtgaaatactgtattgcatgctttccccaatactctatttagaagtcagtattttgtatgatatctatctacagtaggttttttaaaaaaaacaaaaacaaaactagaatttttaactttaatgatttaatttaatgtatttatgaattttagatgaatagggagtttttttttaaagactttatttatttattcatagacacagagagagagaggcagagacacaggcagagggagaagcaggctccaagcagggagcccgatgtgggactcgatcccgggtctccaggaccacaccccaggctgcaggcagcgccaaattgctgcgccaccagggcttcccaatagggagttttttaaatttagagtcatttctttgaaactggaaggctttgtcactgttggcatatgtaagagtaaacctagttttgatgccctacagctaggatggaaagggtagggtgttggtaaaaaaaagtactaaggaaaagatagataactcacagacttaactgtgagttacttaagataaacaaaagccaaataatgtagtattcacaaaatactggccttcaagatagttttagattacttgctttttgtatgcctacagcattttataaatatacttattatagtatttgtcagattaaattataagtgtttacagatcgcctcaaaacctcttccccctcagtttcaccatgctctaattattagactgaggaaaagtttctatggcaaaatttgattatttcccattctgaatcaccatactacagtttatatcccttttttataccatcatccaaaaaatatgtaacaacaaatgataatagagaccaagaaacctaaactccttttctaatactcatttagttaagcctaccttttattgcattcagatacatttgaactgtttcttcgtgtataatttttctgtgatttgtaggtatgagataagattataatttgctttatataaatgaaaacccgttgaaaagtagaaaatattctgtatgctattacatttgagttgcattttgtaaaggtttgtttttactagtaatagtctcatatacatgccttcagtgcttgttaaaccaggtttttatccagagttatgtgcatcttctatggtttcttgcagtaataacgtagatatgaaaacttctttatatattacagatctatataaacaaaagaatagatgttgaggggcaccagggtggctcagtggttgtgattctggggtcctgagatcgaatcctgcatcaggctccccacaggaagcctgtctctccctctacctatgtctctgcctctctctgtgtctctcatgaatgaataaataaaatcttaagaaaaaaaaagttgaatacattttggaggtttaataaatgtgaatatggaacatagattaaatcttaatcctaccgaatgcttacctcctttcttctaactcaggatacactcaggaaatacagacataggaaaatttgctgcaaaaattaacatttaaaacttttgaaaacctcattttcttagctcaggatgctataataaaataccatagaccagtggcttcaacaacaggcatttatttctcacaattgtagaggctaggacatctgagatcagggtgccagcatagttaggttttggtgagggtcctcttgctggtgtggagatggctgcattcttgctttatctttccatggcagaaagattcaagctctcgggtctcttctcttaccagagcactaattccatgatgggacttcaccataatgacctcatctaaatctaattacctcccaaaggccccatctaatactatcatcaccttgggggttaggacttcaatgtacaaattttgacagagacaaaaatactcagtccataacaaatatgaattattctttgatttctaacataggttattggtattattgttctggatttaatgcagaaagtaggaattaaatatataggaatataagctgaaattatagaaaactcaagattctgaattctgattcctcttgccaggatgattttgttcatttattgaacagataattattaaatagttaatatgttcaaggtactcctacacatacttaatatgaatcagtgaacaaaatccttgttcttaggaatttacattctaactactaaaatatgtcattatgatatatagtatatatgacacatatatacattatctaacatgttactgtattcactgaaacctgtgatcacttgcaaataaaaacttgatatatcgaggattgtcatattaaattgttttaaatgtagagccaaaaatgtcccacagaatataatatcatttggagttaccagttttaactttagaagaatttttaaactaaaatgttagtagtctgtgaactgtataaattaattctggcttgtaatagaaaaagtttactgggagaagcaaggtatagtctagagatctgggctctggttgctgatattaactatgttggtgatgttcagtaactgtttatgtgtttgtagtcccttctatagaataaagaatggtagtcaatatacatgacaactatttcctgaatacctgccatacatcccaggcattgtgccaaacatctgatatatataattcatccatccgaccactcaatgaaaaggttaatattttcccccattttcacatgggaagactgagccacagagtgctcaggtcattagcagagctggaatatagagcttgggctctcaagactccaaagcccatggctttaaccactgtgtagtagtagtgtttcccaaataaattgtctttaaggtctcaacaagctctaaaatcatgtaaaatagggacatctgggtggctcagtggttaagtgccttccttcagcccagggcgtgaacctggacttccgggatccatcccacattaggctccctgcatagaacctgcttccctctctgcccatgtctctgcctctctctgtctctctcgaataaataaagtcttttaaataaataaaattaaaaattaaaaaaataaaattgtgtaaaacaatcctattgaggatacgtgatatatattaatcttgaatcattgaaatatcttgctgatcatttcagatctattattataaaagtagctttaatcccctgtacttagttaaggttcatatgtggctgtattaattctaatgttcagttgtgcatattttcaaacatctatggtaaaataagatgatgttttgtattttaaactatttctctccctgtccctcttttttatagctacctatactacagaaatatggaataacccatataatatgcataagacaaaatattgaagcaaactttgttaaaccaaactttcaacaattatttaggtaagaattattgctttgatttattaataaaatgtatgggcagcaaacatgtaatgtagtttttatttcaagttgattttattacggcaaacttctctgtcttataaggatggtcatgtatcatttaaaaaataagtttcctgggcagccctggtggctcagcggtttggcaccaccttcagcccagggtgcatgatcctggagatccggggttgggtctcacgttaggctccctgcatagagcctgcttctccctcggcctgtgtctttgcgtctctccctgtgtctctcatgaataaataaataaaatctttaaaaaaaaaaagttttctttaaaattttaagcaagtaatacatataatgcagaattttaaagattaaaaagcatgtataatatactgaaaaatttccctatttctgtcccttatatactcagttcctctctctagagggatccactcttatttttgagtggcacccagggttatattatatatatataagcatatttctgtagataaacttttattttttttacccttgctttaaaaagtttttaaaatatattttagagatcacttcatatcattacttagctgtattgtttttttaaacttgcatgggggatgcctgaatggcttagcagttgagcatctgcctttggctcaggctatgatcctggggctggggtcaagtcccacatcaggctcccttaggggagcctgcttctccctctgcctgtgtctctcatgaataaataaataataaataaaatatttaaaaaaattaacttgcattataatccattatatagctatactaaaatttattcaacccgtcttctgttgggcatttagattgtttccagtctttgctaatatattgagtattcatctacatgtcatttaattcatgtgtgaatatatcagttggataaatctgtagaagtggaattgctggaacaaagaatatgagcatttaaaattttaatggatgttgtagattgccctccagtgacttctatcagtttacattcccactctaaagtagatgagagagactttccttggttatctctccaagacagaattattaagcatttttaatttttcccaattttctagggtaaaagtgatgtctcatgtagttctgatttgcgtttctcattataatgagtgtggttgagcatttaatggtttttactgctattttaattctattttaaaaataaagcatatgtattacacatgatacaaaaaaaaagaaaaggtggaaaaaaggtatataaataaagtaagtctcttccctcctctaaacccagccatctggcttccctcctgggaggtagctactgttaacccttaaaatatcatcagagatattctgtgtgtatataaaagcatgtatgttaaaaatattttaaagtactgctttattaaaatttgtaaaaatgaaagcaacctgagtgttcatcagtacaacatactctaaaatatattgtgtaaatgtataatagaatactgtaatcctgaaaaagaatgaaatatttctatgtatgttgatttggaataatcactaagatttattcaattaaaaaaacaacaaaaaaacaaaaacaacaacaacaaaaaacaaggtgtacaacccagtgtatactctgtgtttaaaaatatatacaatatgttaagcatatattcttgtgtatgtgtagaaaatttctagtctaaaagaccagaaatctggtgattgcttctgagaaggaaaattcagggtctcggatgctagaggggcatattttttactgcaaatatttttatactgctagaattttttaccatgtgtatacatttttcagttaatagaaacttactttaaaaaaggaatatctagggatccctgggtggcacagcggtttggcgcctgcctttggcccagggcatgatcctggagacccgggatcgaatcccatgtcgggctctctgcatggagcctgcttctccttctgcctgtgtctctgcctctctctctctgactatcatgaataaataaataaaatcttaaagataaataaataaattaattaattaattaattaattttaaaaaaggactatctagggcagtccgggtggctcagcagtttagcgccaccttcagcccagggcctgatccctggatcccaagtcgggctccctgcatggggcctgctgtgcctctttctctctgtgtgtctctcatgaataaataaataaaatcttaaaaaaaaaaaaaaaaaaaggaatatccaggggcacatgggttaagtatctgccttcagctcaggtcataatcctggagtcccaggatagagccccatattgggctctctgctcagcagtctgcttctccctctgcccccctcctccatttgtgtactgtctcttgcttgctcactcttaaataaaatatttaaaacaaacaaggaatgtctgcattctagaattagatttaatttttttctaattataaaagacatccttattctttatagatattttagaaaatatagattgatgccaagaaaaatataaaataatccctaattccacaaccgagaggaaacgctttagttaacattttggcatattccttttaaatcttaaccctattatacatgtgtattatatctacactcatatagacttaacatatattaaaaataatgccatattttaaatgctatactagagatttctaatttatatagtttttgtttttagtatcaaaatgtcctaggtacagctttttttctttttttttgttcctttttaaagatctatttattcatgagagacagagagagaggcagagacataggcagagggagaacaggctcctcacagggagcctgaagcaggactcaatccctgatcccaggatcacaccttaagctgaaggcagatgcttaactgcttagccacccaggcatcccacagcttttttatcccagtggaaaaaaccctttgtccttaggttcagaatattgaattatagactgataattctgctaatagttttgtttttgtttttttaaagatattatctttttataaatacttaatactccctgcaggaagcccgataagggactcaatccctggaccccaggatcacaacctgagccaaaggcagacactcaaccactgagccacccaggcatccctcagctcagatcttgatctcagggttgtgagtttgagctcgacgttgggtgtacagattacttaaaaataaaatcttttcgggctctttgcgtggagcctgcttctccctctgcctatgtctctgccttctgtgtctctcatgaataaataaaaataacattttttaaaaaagggacacctgggtggctcagtggttgggcatctgcctttggcccagggcatgatcccaggatgctggatcgagccccacattgggctccttgtggggagcctgcttctccatctgcctgtgtttctgcctctctctctctgtgtctcataaataaataaataaaatcttaaagaaaatcttaaaaaaaaagatctgagctgagattaagagttagatgcttagggatccctgggtggcgcagcggtttggcgcctgcctttggcccagggcgcaatcctggagacccgggatcgaatcccacgtcaggctcccggtgcatggagcctgcttctccctctgcctgtgtctctgcctctctctctctctctctgtgactatcataaataaataaaattaagaaaaaaaaaaagatttaaaaaagagttggatgcttaaaaaaaagaaagagagaaagagttggatgcttgactggctaagccacccaggctttccaactgctaacagtttttaatattcaacatgacatgtagtagaatattttaagattgactctgaattaactttttttccctgtaatttagcctacatagtcactttaggaaacagtcattgttagaatccttttgggttttacattggattgtccttggatactgagtttcagcttctctgataagctctgaatttattgaagttgtgactaaacaactaaacaaaataaatgattgctttagtacttaaacgatcactaaagaactgtaatttttaaggcaatattgactttaagaattaattttgaatcttagttaaatattatagttgtattactaaactggtggtctggataagttagagagggaagtttttcacaaaataaaataagcctagcatattaatgatgtcttcttattggtgttttccaaaaaactacaaaattgtaggacaagtggttttttagtgggttttgctctactgaaggttagttcaagcaatggatgtttgactcatggctcccttagacttctattttgcttaccttctctttcagagaaaggggttgtgcttcctcggaattgtcctcagtggcattgtgaggaagggtcacagggctactcaaagaagaatcttctagtctatggggaagttagtagaaatagagtaacaataaagaatacaaacagtttttgtctttattccaggtccactctgatctagaggaaagttttcttcctgtcatttttcaattttaaccagatagattttttttttttaatgtaaaaatatcagaaatgttaacttatttaaggctttaaatgctatgcgtttaagcagtatacaaactatgaccaaggtcttgggaatatgatgctttgaaagttgtttcgcattattttcatggttgtcaacaaattttgaagtttcttgtttgtagagttttgtctgaaagtgtgcttatcacagaatattctattttcagatatttagtcttggacattgcagataatccagttgaaaatataatacgttattttcccatggtaagtatcaaatattttattatcacttataatttatgatttgtctcaattatggttctaaaaatttgtaatagttgcatttgtagccttttggaaattcttgaattaaggcaatattaatatgagtcagcagtaaattttttcaatatattttgttttactctatgtattttatgcttatgctaatccactttttcttaaaacacactgtcttgccttcagactaaagaatttattgatggaagcttacaaactggaggtaagtaatattttcttagtgttcatttttagattatgtgtcatagttaattttttagttaacatttgtcttaagtgcagtatatggaggttgcaattgtaggtaatagactattcccaaatttgtgttttcccaattccttgtttcatttggataggctttcttaaatatccctataagtattttcaaatttttgagtcagctttgaatcccttgaatttcgggatccctgggtggcgcagcggtttaacgcctgcctttggcccagggcatgatcctggagacccgggatcgaatcccacgtcgggctcccggtgcatggagcctgcttctccctctgcctgtgtctctgcctctctctctctctctctctctctctgtgtgactatcataaataaaaaaataataataataaaaaaataaaaaaataatgaatcccttgaatttcaaagttaaattgtaaagttctaaagttaaataaatatccaagtgatttgtataaaatataaaatgtttaagaaaaatttatcttactatcttatttatcttattagtattattttagttgctgagttagatgtttttttgtgagaataactatttcttatttttcaggaaaagttcttgtccatggaaatgcagggatctccaggaggtatgaagttaaagattatttttctttttttctagcatttaattaatgagctctgttttgtatttttttttctaaaattttttccccctcttcagtgctgcctttgttattgcgtacattatggaaacatttggaatgaagtacaggtaagaaagtactctgaaacatagccatgtttaaattctcattaaaatgaagcttaattgaaagtttgggaatttgcaattgatatcctgattttgttatctatttatgttgattagtcaggctcttgtatcccacgattaattagcctcttaacctttgtagcttgtccaccttgtatatatctacttaggctaacattttgtggttttggggagttagtgctaactgttgttaagaagccaaggtagttatatttggaaataatcatggaaaattatttgctgctagagaattgtgtagtcctagtttaaaaacttagatgcagatattatttcttcccttgcttaaaaggctaatttattatgttttcctttaacggcaattggataaaaaattacctagaagttgtttcaggttctttcacaattcagtgtagtctttcttaaccaaaatcagcttttccaagcgtattgcctagataaaaaagagagccctgaaataaatgcctgaccattgtacattgtttcctttttttttaagtgtgtcttgtacaagttagaaatcttgtaatcattggcaattccttgtctttcactccccatctcccaaatttatcattactaatcctcttttgcatcctaaaatataccttgaatctgtctcttatctttctctttatcatcatttaatcccctaatcgaagctccagtcacgtctctcttgggctttaacaatggtagtcttcttagtggtttcatgtattctctccttctccagtgttttttccccccacgctacagtcagaatgatcttttcaaaagataaatctgatcaaataatcaccttatcccaaaaagctttcagaggtttctgatccttaataattcttatcatggccagtgaaactttgcatgatgtgcctgtatcaacctttacatcattataccattttccctgttcctctcatttgagctgtattcagcattggatcaatattcctggcacacagtatactcaaatgtttgtttagtttgtttggtatcctttaagtttagattttgatggaaggttggcttaaaagtatcagttaatattatttgaatacaaatgctttgtttaattgaaaaagattagtgctcggtagactatgtttatgtattctctttattatttggtgtcttgatagtaatagtgaaaatagcttccacatttcgggtctttgctatgtgctaggtattattctaagctcttttatctcatttaagttttacaacaaaacaaggaagtagatatacttttccttgtctaacaatgataatattttgagcacatactatgtaatagatgccatataaggtgctgtaaacctattatcatgcatctcacaatagccctccaaggtaggaatttttataatcctcaatttacaaataagaaaaagcttagaaagttcagcagtttcccttagaacacaagctggtaaacagagggatggtgatatttcatctgcccatgctgttcatttttctactacaactcactacctctctgtagtataagctttatgattatgatttcctgcttaggtaaatttttgggtaagttcctattttaggtaaattgagattgattcatgaaataataccatcaccttagttttctgtttttgttttcagagatgcatttgcttatgttcaagaaagaagattttgtattaatcctaatgctggatttgtccatcaacttcaggtaacttctctctttctcctctttaaagtaatcggaaagtagtgtaattaaaatcttacgtccatgtaatttaagtgtagaatttatttttttatttttaaaattttatttattttttaaagattttgtttatttgagaagagagagagcatgagtaggggatggggagagggagaagcaggctctctgctgagcagggagcccactcgaggctggatcccagaaccctgagataatgacctgagccgaaggcagacacttaactgactgagccactcaggcgtccctagagtttactttaaatattaaaaaattaccatagtcaggggctcctgggtggctcatccggttgagcgtctgactcttggtttcagctcaggtcgtcatctcggggttgtgagatcaagccccatgtcaggccccatgctcagcgtagagtctgcttgagattctctctccctctccctctgtccctcccagtcatgctctctttctctttctctctctctctctctctctctctctgtctcaaataaagaaatcttttaaaaaaatgaccatagtcaaattttatttatttttccttttaagtaatctctgcacccaatatggagctcagattcatgaccctgagatcaagagtctcatacttctccaactgagccagtcaggcaacccctaatttgattttttattcaagttcaaatttccagctaaaggtattttctttcttttttaaagtattttcttaaaagctgccattactgtgacaaaagggttaaaggcatatcgttaaatgtaagagaaaataattgatgttagaaatttttcagttttttcttttttgattacacagataaagaatattgactctaagtatactatatgtagcagcttttataatctattttatgtttccttttccatgtttcaaattttattggtgcctagaagatgcactaaaaagtaagatatacctgtgaagtatctgtttaaactaagtttatttaattttttccaagaacgaaaatcagattgaagaatgtcctctggctgattctatccagttatgcaggaataaatctcacattgagagacatcaagagcattacaaaatgctaggggtacctgggtggctcatttggttaagtatctacctttggctcaggtcatgatcttgaggtactgggatcaaccccacattgggctccctgatcagtggagagtccacttctccctctccctctccccttccctacttgtgctcactttctcaaataaataaaaccctaaaaaaaaaaaataatgaaatggattgtctcagttaccaaactacagggttttttgttttgttttgtttttagtttttattagtttttacttcatttaaaacagaaagtgatatgtctgactttagcatgtttatgtaaaatatttttgttccttttaaattgtattatgtaaaactagaatttgtaagtttctttgccttttaaccctgttgtttaaaaacattgtcttttaaaattgatttttgtatttgaaaaagtaacatatacacatttaaaaaatacagtatatatacaagtctaactgcataatatatttaattgcatgtgtatatatgcatacatatatatgcatcacaacttcatatattgattcctcatacataaaccttttactttatttatttttttaaagattttatttatttattcatgagagacacagagagagagaggcagagacacaggcagagggagaagcaggctccatgcagggagcctgatgtgggtcatgccttgggctgaaggcaggcgcttaaaccactgagccacccagggatcccacataaaccttttagatagtctctagcctttaatgatttaacaatattggggaaaataaactggtaggtacattttgtttacatgtgcaaatacacctgtaagataaatatataaagtggaattgcagggtaaggggtatttgaaattgatgttaccaaatagtctttcaaaaggctgaaatagtgtaagaccccccaggaaacagtatctctttcctagtagttcccattcagtaccaattgccaaaagtattttaacagattttctgatcattgtcatcatggtggtgaaagtggtgactggtttgttcattcttctatcagatttttatgtttttctcattggtttataagagctctttctacattaaagaatgtctttagccaactggtttgaaatgccatttttattatataccaaactctgatctatacttgggtctgtttctggactttgaattctgttccattgctctgcttaatgctgcaactgtatcaaaccattttaagtactgtgatattatataagtaacttatggcatagctcaagattccctcattaacgttctttctagaattttcctggcaagttcttagcatttattttttggtgtgaactttactggaaagagccctatattttttaaattgctactatattcacagttcaaaaagaattgacacctttacatttttagtcttcctctccaagattccatttattcaaatcaatttctgtgtccttttgtgttttaaagttttctttgtgtagaacatatttatttcttatgaaatttacagtatcctgtattcagcacaatatactcagctctgtaggcagaatcgtattatgagaaattattcctctacttaaaagacaaaggccttatttacagtggtttataaatccctacgttatgtagtcccttacctctctattctgatctcctcctatccatttcatactatatatactcaggtcacactgaccttcatgtaattacttgaaaatactatgcatgttctcatctcaaggcacttgcctgtatctcttcacatctagaatgcgtttctccaaatatctgcatgacttgtttccttaattttcttttgactgtattgctgcaatagcttcctaacaggtatacccacctctacccttaccccctaatccctacaagtcaaaagaaaatactagtttggaccaaaatggtaggggaagaggtgagaagagggcacattttggatttgactgtatagctgacaggatttgctgatggattggatatgaagagagattagaatgaatctagtcctctatggaagatatggaagaaactgtatgagaaggtttacagggagtaaaatcaaggtcagttttggtcagattagagggctgttagacagtaggcagttttataagttcacagtttatggggaagaaccatatatttaaggaatatcagtatgtagatgctactgaaagccctgaaactgggtgagatcactaagggagtgtggatagagaagaatttccaaaacagatcctaacgtactccaacatatagagggtggggagatgagaaattaatagaagagatgaaaaagaatggccagtgagataggaaaaaatcagggtggcttgatgtttgggaagtcaagtgaagaaagtgtttgaagtagggaatgggagtgcctgggtggctcagttggttaagcttctgactcttgatttcttttttttttttaatttttatttttttatgatagtcacagagagagagagagagaggagagagaggcagagacacaggcagaaggagaagcaggctccatgcaccgggagcctgatgtgggattcgatctcgggtctccaggatcgtgccctgggccaaaggcaggcgctaaaccgctgtgccacccagggatcccttgactcttgatttctagtcatctcataatctcacaggtcatgagattgagccctgtgtcaggctctgcattcagtggagtctgcttgagattttctatctcccctgcccccctaaaataaaataagtaaaataaaatatcagtcttttttaaaaataaaatatcaatctttaaaaaaagagtggggaaggaaccactatttcaaaagctgataatatattatataagatacaggctgagaatggacattcggtcaggaacatgaagtccttggtgtccttaacaaacaggttttgtggaaggggaaggataaacattgctcagagtttaagggaaaatgggaagagaggaatgtaaatagcaagaatagatgattctaggaattctactttgaaggggaaaatggaaaggacagtagctagaggggaaatgggttactaaggaggattttatttgttttctaaaatggtaggaaatatggcatatttgctatttggaacaatccaggagaaaagagaaaattactattacactggaatgggatagtgtggccttttctcgttgttgattctgttatattcattatttctatggttttatttttttctcccaagttctgatagttggtatgtcatctttttaattgttacatttcttccatgagtccttttatttcttctttgaactcacatcagaaatgccatattctcattgatttcatggagaattaatcattttcatctgcttcatggtgtgattttcatgcaatgctcttcataggacttttcactataatgttgaaatagtttttttccccttgtgccatctttatgctaaaacctgcagtggttcctttttgattattggtgatctttgtactggaagtattcttagaacagctatttgcccaacagtaaagttgtgggagaggaacctgggtagtggttggggaaggcaaacagcttaagttttctcacttgtcttggaagactttcccaccaacacttttttctggtggtttaacttagtaagaagcagagcgccccttatgtcacgggtttttcttgtttgtattgataaacatggcatgcacattaaagccatccaggggaatctaacttaaaccaattaaatgagaatcactgggagtgggatttgagcatatatgtattgtaaaattctcaggtaatcctcaggtacagccaggcttgggaattactgttttagtatatttttagctaagatcagatacttcgctacatacaactcagtttctctttcatcttactatacatatacctgctttttgcaaaatggcatgaaatgtcggcataaacattttcctcagtatgccctacctcatccccacagcccactcatatttcctatcatactgtacaagggcttgttttatcttagaacctttgggcagccctggtggtgcggcggtttggcgctgcctgcagtccggggtgtgatcctggagaccctggattgagtcccacgttgggctccctgcaaggagcctgcttctccctctgcctgtgtctctgcctctctctctctctctgggtctctatgaataaataaataaataaataaaatcttaaaaaaaaaaaaaagaaccaccaccttttttgggagcactttaaagtgtacccattctgcctgatttctggagtctggcatcttgtgtgcctagcttggtctggttccatttaaaaagtaagtttttttgtgtgtgtgaaatataatacacatatagaaaatgcataaaatgtaaataaacatccatgtaaataccatcaggtcaagaaattgaacatacaccaggaccccttgtgttacaacccgtttccaaccactaacactttctccttttgtaaaggtaacctctattctgacctatttggtaatccgttctttatttatcattcttctcatattcagggttatggatgtttcctactttgatcaaataaggagatctctatttcttgttttcttgaaggggagagggatagaaatgcttttattcttccatctttggaagtagaggactattaaatttaaggaattagaaaatcaaatatatatttgaatccattaagtgacttattactctaatttttaaaatattttacaactgtataacattttatctttactgaacttcattttatttttatcattttttgagtttgggggatgtgtgtgtgtgttttaacagaggaagttagagatcatatagctaacacccagtggcagaaaacagataactgcctgactagcagttcagtgtatgataccctagtgcaagttgttaatgtggtttgatttatagttttgtcagtaaatgtgaaaatatgagataggaattttattttaatttttttatgataagaattttaaacttgcatttatttctcttttaaaaatatgtatttgggcagccccggtggctcagtggtttagagccaccttcagccctgggtgtgatcctggagacctgggatcgagtcccacatggggctccctgcatggagcctgcttctccctctgcctgtgtctctgcctctctttctcgctctctctctctgtttctcatgaataaataaagtctttaaataaaataagtttctcatgaagtctttaaataaataaaatatgtatttattagagagagagtgcatggcaagagtgttggggggtgggacaagcagactctgcactgagtgtggagcctgacgtggggctccattccacaaccttgagatcatgactttatatgaaaccaagagtcagccacttaacatactgagccacccaggtatccctaaactctttcaacagtatggcaccaaatttttcagtataaactaagaatacaaataatgtacacattaatcactgttttgggtacccaagaatttgaatgtatattcaagttaattaaatctttttcaggaatatgaagccatctatctagcaaaattaacaatacagatgatgtcaccactgcagatagaaaggtcgttatctgttcattctggacctacaggtaaggatttttgtattttagagagggttggggagaaggatgatggtatgaagggtagaaagcattttttgctctttataagttatactgaacaatctaaattatttagaaaacattgggtagacaatacacaatacacaatattaaacacaatataattgcaaattttaattttataatgaatccatgtgtattatattgagtttctgctgtgtgtataccattgtacctggttaatagaatatgctggctggaagatcaaacttctacttaagtctttacatagtataactgctataaagattaaaataataagagggatctggagaaggggctctaagtacactcaggtgatcttattaaaaataaaaataaaaggtgattaataaatgaaaggatttttcaggttaagtaggttgactactatgagctactccaatttttctcttgtaattagtatttcaatcccttctccttttcttccttatgcctgtcagagtactccttcccctattttcaaagttaatgatccaagcatgctttcaaaatcttttaacttgtgtcttcttttctaagaccttgctacctttatctatctctttttttactcagtctcattctatttcaggtcgatattggcctcccatccaaactctcacttggtctattctgtacattgtggccagatttatttttacaaaagatagttctgatgtatttttcctgtacaaaagccttcactggcttaaatccttcagaagaaaacctagagtgttaatagtaagtaaggtgcttctggatcttggtatctcccagtgttcctctttatataggcactccagaaagccaaactacttgatggtttcattttgtctcttttctcctcctagaatgcacattcagtctttctacccttaaaaacttagttcatgttatatctcctcaagagaaatgatgattaacttcatcttcctccaatccctagttattcggaactcctatagagctttatttatacctcctcactttctactttgcattagttatttatgcctcatacctcttttagaatgcaggtatagcactgcatctgaaatttagctatagcagccgtattatctgctgcaagccatcctttctcccagctctagacctgttggtaataaaaccacagctttcaatggaaaaattttcagcagtgtctatgaaagcaaaaaagataatctacaaaataaaattgtacaatgtaaaattaatgtcttatattttatgttctaagtcatagagtctggtgcctaaaggtaaccaaacatttaagtaccattatttcctttaaaattctattttaggggtgcctgggtgactcaattgattaaatgtctgcctttggctcaggtcatgatcccagtgtcctgggatggagtcccacattaggctccttgctctgtagggagtgtctgcttctcactttccctgccgctccctctttgtgggcttgcttgctctctgtcactcgatattgtcattttatataatctttaaaatatattttttttcaaactattttaaaaatgattattagtaatactaagacataattttagtaatacctaagacataattaattctcacgaggggaaatgtattctgtcatgaagatacaaagttgcttagtaatttatagcaaaaggatttgctgacgtttcctaaaaattcagtcttggaattctcatagtgcatatacatgataacactttatgaaaatgaaattttactagctctaacattctcacaaatgagttcccgttatattcatgcaataatttttaggcagtttgaagagaacacatgaagaagaagaggattttggaaacatgcaagtagcgactgcacagaatggctgactcaagagcaacattatagaggatgtgaatttctatttgggaaggagaaaatactagagacaataataatgtaaaatggtaaaaacacaagtctttttttttttttttttttttccaattacatgttgcttccaggtgtgtttctctgcaacttgttgagcaacattttaagaagatgttggacttctgcaatagatggcactggttttactcctttttttcttttcctttcctttcctttcctttcctttttcttttctttctttctttctttctttctttctttctttctttctttctttctttctttctttctttctttttacactttacagttttattataaacaagaattttggacttgcaaagaggtattattgcaataatgcacttttcatacttgaaatttatttgtatgatataaagttattactttaaacaaaatgcaagttaggggggatttgtttataaaatctgggtaatttataacaagaatttcctaaagtttgctaaaaattcattttgtgttctatatattacatttaaaaaataattttacagttgacttttatgatggaacctcttatggaaacattaacatgcaggaatctgccacatttttgttttagtataactcaatagcttcattacccttttatttttttaaatttcttaatccttattaatctttgaatcatgacattagctaactcttcttactttaacatccaagtattgcttccattcgtcttatcttcctaatttgttaattctatagaaaaaaaagtttaatgaacaaaggacgatgttttgcttggtaataccagatactcaaaaaacaaggagttttagactttcaagtgacttccttttttccttaaaagccaaatgttgtttgttcctttttagagttagttgtttagcccatttttcctttgtccaaaatagttctaagtagaatatattaactaatgtagcactatttttttttctaaatgaagcccaaaaaagaaaagtgccttgcatcaataaagaaaataaaaacaacaaaaaaacaaatcttcatgacctttaaattagtatgtagaacagtacaaagtttaaacacttttctgtaatttctttttctttttaattataaattagttaagacagagtctgaggcttaaagaaacctcagtaaattatttggaatatggaacatttactccttcattttatgttgttttaatgattctgtgaggttgttctggctcaggcagcagcttttctttgaagatgcatttattggggaaagtggtttgtgggaaacttcactgtatttagtgttttaattctttacattgagttaatccaaatatcccccataatttgcattaacaaagtcactttatggatccttaattctccatatttttatttatacatataacaattgttctaagaaaaacattttttctattttaagtatgccatgagggaggagaggagtgtttttaactttttatagttgatttagggtagcacaaacaaaactcctttatatctcacttttctcagtcctctcttgaggtgcttttttgacgggaatgatttacatacattcccttggtaccaataggtactatgcaaggtaacccattacaccaagttacttgctttgctttcctccctacaatgtaatataataccataagagcttttttcaatccagcatagcaggaaagtggaaattaaaattgagtccattcccattgacccagatggtattccttttctgattcccttcccttcccacattttactatcctgacaaaagcctattattaatcccattgtgatcctgtattctgttgtgtgattaggtcatttggtgtggtagtttagtacagtcaagatttgcattgtgttcagaaattccacttggcaaagtgccagataacacagctttcctgtatgtagatcactatataggtcagcaaagatctctcttgcaatctaataatctatgatactcctttattcagcagaaactctgcttaaaagaatcttcgttatagtacatttaggttttaaaatgagggagttaagatttttaaaattagtttcttaaagagacatatcctctctagtacttgggccaaaaatacagatttggtcattaatttaaagctggtaattttccactttttctaaccactgtaatttttatgttgtcactaaagtgcctgcccagcactgtatattaaagactgtctcttgaacactaggaaaagggactatcatcttcttgagtacagtactaatggggacaaaacatgaagtttattctttcatgtaagcaccccaagtttgttttaccctggatccatttttacacctaatgttcaactagttctagctcttccagtcttctatttggttccatttctggaattccgttatttctgtggatattttgtgatagttacctataatacaattaaccaatcatgatttattttctacaatatttgaataatgtatgagtatagcacccaattttaaatatgtaatctgggcaaggatttaaaacaaattgcagcaaaaacaggaaaactgctttactgtccactttaaaagtatgaagcaaatattgaaaatattcaaactggaatggcagtattcttaccttattcgtttgtgttaatttcatactcattgggtgtttaaacagcagttacgtttatttgtatctactctaaggtggaaatgttaaactgggatagcttctgctaccaactctcaactgtttgacttttagagcagaatatttgttttttgggggggggattttgtgcttcatctgagtttagaagtaatgtcagaaaatgttaagcatgtcctttttaagaaaatacaaggtttctaactgtcttattaccatggtaattcaagtgaattagaaatatttaactgcaatcttgaattataaagttggggtgcacatatatatatacttatatataaggatctcaacttgatgtaaagtaaatgagcagttacctggcggatttttattttttaataactggtttaatccataattccataacaaacttagcttcatttcagtatttactttctttgtccattcaacaatattccaatatggaagtgataggaaatagctgagaattactaaaagattttattttacttttattgattagaaggtttataggatctttgaatgctggattttttttgtcttacccatccatggcagctaaaaaaaaaaaatcaaaatattcaggtttacatgttagctctctcatagggagttgccatacctcacagttcaaagtgtattctatagatcagtaacattatactgacatgtaattgcaatttactatgcagcaaaaatgattcaagaaaaataatctacagtgtctatttacctttgtacaggcaattgcttaagttaactctgcttttaacatttgtacttggataaaatgcttatgtatgtataggaatgtcacagtgcaagatgctgctagcccaggcacaaagtattaaaattattttgtgaagactggtggttgtattaaaactgttgtgccattatacctcaaaaagattgaaatgctcatttgtactccttatgcctcagaattttggattattgtcttttaggtataagtaacccagttttactacctcagattaaggatgaatgaacactggaccttgagaagcacttaagagtatcttccaaaacacggtagtcacacacacaaaaattatggtcagtagtccaggcagggcctgaattttagctcaagaatatttctcaggattagttgagcagatttggagttaaaagtgagggaatttgtgtctgaaggaaagggtatataagtcatccacagagcagcttctagcccattaaaaaaaaaaaaaaaaaaaaacttgctttcacagtaccacgttctgttagcctacctacatattcttcatcaaatctaagatgctatctctgtaattttagatatgactaaaagggaaaatattgttgaataaaatggggcaagccatttatcataaaatgcatcctgagggactcctgggtggctcagtgttagagcgtctgccttcggccgagggtgtgattcccagggtcctggattgagtcacacattcacacattggggctccctgcatggagcctgcttttccctctgcctgtctctgcctctctctgcctctcttgtctctctcatgaataaataaataaaatcttttaaataaataaataaaatgcatcttgatttccaaaatgagagatccagatttccaaaatactagtgtaaaaaatgtgcatcctacaattatggaaatgtaaatatacaaaatatctgaggcataataaaaatcacaactgtcacttcattctaccttttcaaaagcaaagtaatgctttaaaatatgcatatatggtttacatgaaatgttttatgcagttttctgtactcaaggtttactcaatatggtttagaaaattttaaacatactctggctaactaaagctaaatatagatcaccattttgctcaaggacacaatttttatataatgtactttgtaactttcctataggaaggacttaagaccttaaggacactggttaaagtgatttatttaaatactaactttgtagataattttacttcaaattgttcagaagtaaggtaaagcattcaattttgcattctgttagggattattttttttaatatggatcttaattaccagaatgtacctaataaagctactgtctgtcatgctaaggttgtaggactcctgaaaaggcaaaactagcaggtttgttgctttcactagagacatcaattcatatgcataggtcattagcaggtaagtagtacactctcttggtgaagaagggtttttgttgttttagacagccaactttagcttactccaaggggagaaatcttttttttttttttttttttttttaattttttttttatttatttatgatagtcacacagagagagagagaggcagagacacaggcagagggagaagcaggctccatgcaccgggagcctgacgtgggattcgatcccgggtctccaggatcgcgccccgggccaaaggcaggcgccaaaccgctgcgccacccagggatccccaaggggagaaatcttaaatccagctgaggtaggtgtgagttagagggattaaaaagtggttgtctttaccttcccacttaatttacaaaaatcacacaaaactgaagtcacttatgaaccaggatgtgaccgaagactcaagaaaaacccagacatagagttttaaaacttcatcatatgaacaggtttaatgtaacatggaatgcaaaagattagaaccattaataaaatatccaattcttcaacttaaaaaaataattaaaataaataaaatcaaaataagatagtgaccagaataatagtaccatgacactcacagtaaatagaaaagcttccatcagcattttaaggagtaacaaatgcagtgatacatatttaaatattccactcaattttgttatttatttttcataaaaacattactcagaaggcttcagaaattgatgaaaagatgagaaatcaggttagaaatacataatatgccaagatttgttaattcactgttaaaaagtaccttatatttgctcattttaaacaataattatatttcacatataagacaggtagtaccttatctgcataagaattataaacttttagatgtacacttaaattgttttactttgaatcttgtcacattttatcattttcatttctactttaaaaggctgaccaggttgtttaccaatatatattaggatcaacaaatgctggactgtattacatttagttttatccaatttcatataatatatggaaaaatgatacactcaagtggtttctggtatttctttgaaacaaaaatactcattttatgaatgtgataacagccttattcatggtatgcttttttttaatgatcagtacagatagcagacacataactcttactacctatactgtaactacaaagaaatgaagccaaactttagaaaaatacaatgcaagaaaagattcaagttaaaaatatattcctttggttaaaaatcatcccctttataatactcatttgtaatctaagctcacagcatgtcccaccagcccaaagtaatcttctaaatgtcattatacttgttgtattacaatgttttttttttccgatccagtatttatggaggtcactgagttgcagcaacaaagtattttaactctagggagagtattgccttgttgcattagctccttttacaaatgtctttcttaaatgattttttactttagaaacctccgacacatgtagttttcttcagatactgtatatccgaactttttatagaaaccaacattttgtggtagacattcaagggtaatcttataacagttcagtttcttgcttagcaaagtaagggttgataataacctgaaattcaaaaatgggggagggagggaaagcatagagcatttgttaataaaagtgcatttgagtaataatatgaatgaagattatataaataaaacttcaaatttatattagagatttaaccatgacctttctcactatatttaaatattcaaattgtaagtgggtaagtatttaattcaccccaagcattttactgtttcaaatatactttacctagtaatctctagcccattatataatagaacaatactaaattcaccctaaaccctccttaatactagtttttttttttttttttatttatgatagtcacagagagagagagagagagagagagagagaggcagagacacagacagagggagaagcaggctccatgcaccaggagcccgacgtgggactcgatcccgggtctccaggatcgcgccctgggccaaaggcaggcgccaaaccgctgcgccacccagggatcccaatactagttttaagattaatgttaacaactaaagaaaaaaaaaaaaaaaaacctaaagactcaatctttttaaaaatatggccaaaatttaaatttttttttccctaaatctattcaaactactcaggaacagtcaacatttcccacgtgatttcccatgtgaaataaatagcttttgttatcattttaaagctaacgtttgtgaaaatatgtatcagattaactctggattgctctaattaatatgaaatacagcaaaaaagtatacattttccaaacccaatagaatgtgattttaggggctcctggctggggttaagtgtctgtcttcgcctcaggtcatgataccagggtcctgggatgggtgcccctccattccaccctgggctccctattcagtggggagtctcctcctcctgcccttccccctgctctcaaataagtaaagaaaatcttaaaaaaatggaatatgattctaactgccttagggagaaaaagaccagaaaagatctacaaaaatttatccagaagggtttctcatatttgcatagactgaaaagttgtgtatcattttgaagagagaacattttgactgaagttatgaaattataaaaggtatgataaaattaagtggactagaatactagaagctggtctggtctgttcattgatatatcctaaatacctagaatagtatctggcacatagcaagtactaaaaatttactgagtgaattcctaaaactcagaagagatggtactaaagcaagttctagcttataagataggcaataaacctatgagacatttattttaaaagatttagataaatgcacagaagattttaacaaagcctgtttcagtatgtttctaaaacttatgagacaaaaataaataaaacttaggagacagaacatctcctttgtttttaaacatgactgggaaactggggtgaatcacttgacctggccacaagtttttttcctactagtagaatactattattaaaagttcatttaaagggacgactgggtggctcagcggttaagcatctgccttcggctcagggcttgatcctggagtccccgatcaagtcccacatcaggctccctgaatggagcctgcttctccttctgcctatgtctctgcccgcccccccgtctttcatgaataaatcttttaaaaagttaatttaaaaaattttatggcgggatccctgggtggcgcagcggtttggcgcctgcctttggcccagggcgcgatcctggagacccgggatcgaatcccacgtcgggctcccggtgcatggagcctgcttctccctctgcctctgtctctgcctctctttctctctctgtgactatcataactaaataaaaattaaaaaaaaaataaaaaaaaaaattttatggtctacgaaacagtatacttctaatttctaaacttaatgataaaacataaaagtactttgttcattaaatttagcttaagctgctgagtgagcctaattgatgacatctaaaaagaatttcaaacaggaaaacattgacgaaagaacatattaactacaacagaaaaaatatctaaccttgtttctgcctacttacagtttgccaagctgctttcctctgcattcatcactaacaacaacatcttctactcttcctctctgaaaatgtttaacaatgtttaaaagacttaggcatgtagttttgtttttagctaaatcagcaagtgacaattcagtgatgttttatgaacaaactttaaaaaccaaaatgccttttttacttactataatgaatcaacttgtggcctaatcttgttttgtccatgtcttaaatctgcccaccccactgttttaaagatttcagaatccacatcaccaaaatgtaattttgtcatgttatactacaacatcttaactccttgcttaatagttttctttcaaacatctaaatacaattgattaatttctagtaaagaaaccccaccaaaattcatacctcacaatacattccaaatgttcctatctattttcactggattacctaggttctcatgtgagtcatgaggagtgaacgggcactagaaattagagaatacagttgacccttgaacaacatgggtttgaacagcacaggtgtgccacttatatgcagatttttttggataaatactctgtaaatattttcattatgatttaataacattttcttttctctagctttactataaaaatgccatacgtaatatatctaacatacaaaatgtgttaatgagctatttatgttattggtaacacttccagtaacagtaggctattagtagtttcaggagtcaagtaacatgcagatttttgattgcagataggtgggggggtatcagtgtccttaactcatgttggtcaagggttaatgatataatattctgaaccctttaactgcttggaaactgatggaaatttgtgttaatctatatatacagtattgtgttttttgaaaaatagcatcaggtattctaatcattactgccaaatacatgatgctgacttggtttctctaggattttaccaaatctgacaccttacaaaacaatttttagcaaacaattcagattattaatacattttcttccaacttccagaacacaatgggaaaatgttactaagtgatttctagtaagcaaagttttcagggcagtacagctcattttataatgaaatgcagtgagaaaatagattggtctaatggaaactcaaagttagttttgctagaaaacacctgttcattttagtcctaagcattaatgtgaacacataccttagcacaggaatggatgaatttatgttctattatcagagttgctgtagcaacaatttgtcctaaagtcacatcttccacaactgtaacataatagtccccggatttcttcatgtgctcaaaagattctgtggaaattggaaaagtgttatgtggtggacattaaactttagtaggtgccataaaaatgctaggattaactaataccattattgaatacttaaaagctacttcatcatggtaatttacactttgtttctaaagaaaatgtcagaaatgtccaagtggccaaaatatgagcaatcattatcacttggaatatggcccttacctttgaaaaacctgttagcaaagtacaactattaacagctatgtcagatgaatggcacttataatacaaataaattgtagatgttgccacttctgtgactaatgaattgaagactgtcttaatatcttcattactttaagtcattactttctttaacctttacaacactcagtatttgagtagaacaaaatgcaaattttaataagaatgtttacacggctccattctgtaacttttagtcttctggcttcaaaacattttgacaagtagttttcagttttctccttgtgacctgaagtggtttcatgactacctgacttgcttttttaaaaacagaatcctcagttttgcttgttttgaaagcaccttgtgaagtaggttgaaaattgtcttcatttctaggtaatcattccaaagtcccatgacaaatgcaaagatggaatactttactctcaaattgatttttagaacttatattgccaaataataggtttctccatctaatcagatatgcataaaaaagcctaatctcatatatagtttatttccatagtcttgttctagatagggttctggagtggaaagaagaaataaattcagtgaagaaaaacaatgaaaatcagaaaatgatgatcttcatcttgggaggctcaaatagagtacataacaaaattacctaatggaggaaatgaagatattatagcaaacaggaggacagtgttagagcactagatggaatcaggaaagttctattcctttccttaccaataactacctgtgatcttcagtcatttgacctctctggtttccattctctcatatggactaaaaaaaaggggctgaactatacattctgattcctatggatcttaaaatttaataaaaacaaactaaattcagaacataatctcttaccctatatttggtgatgaaatttccatgaataacctaaccacatgaaatatactacagtacagaacaatctctagagctgtcaccagctacagtaattatctaaaaagtcaggtgttttgtaaaacacggtaattattactcttggatcctataacaggttagccacattaaacatttaaataagaaaatggctaattgctatatgaataatttccagctatttgaagaaaaacacaagtagacactgaacatagccctaaatgaaaaaatcttgtttccctttatttttcattcaggaaaaggggctgtagtacttactcataaattgttcagggttgaccactccagtctctgtcagttggcctaataccttaaaaaaacctagtgtgaaaaacagatttcaaattatgagaagaccatataaaagattaaaagaaggaatgaatgtgtgaagctggtaggattgtgggcatttgtgttttcacaactttctgtaatcattttaaaaataatcattttattaaagattaagctgaaacccattattccttctgtaatcattacataaaacaaagaataataggttctaccaatgtttttggctgtatgagatttttggaatagcgccgaccttaatgattcaatatttaaaaaccagcaggtatatttttcaatgtgtaatttgcattaaatttggtgcaggaaatgccaagttttcccaaatacgtgctttgattttacttaaaagtgcaacaagactgtcattatgcccaagtatactattttaaaaataaaagcaatattgttgagacaagataaccgatttcattattgttaatgtgaacattttaaaactttgagaatcttaatttctacacactcaatatttagcttaccaaaattagtttctttagatttcctaccaaaaaggaaatgaaaaagttcattttttttttattataaaattttaaaaaatcattttggagaacttagacattaaaaatatatgtaaacaaaacctttgcaatgtatccaaggcaaattatctccactctcattccctattcagcttcttagagaagattcttccttatgtgtcattatagatgataatttcaccttcatgaagaaaagtcttttgggattcttaattagtgctgtatttaagccatatgaaatatttcagagtaatacttggacttagccatgatacatacatatattgggagttgagtgtctcagtcactttataaatgagcatgcaactcttgattctgaggtggtgaatttgagccccacactgtgtggagagtttacttcaaaataaaatcttttaaaaaatttaagtataaaaataattcaaaatgcaaatattttttaaacaacatatgtttctagagaaaatagaatgctaattacagctgacccttgaataacacaggtttgaactgtgcaggtccacttacagattttttttaataagtacattacggtaccgtaaattttatcttccttatgatttccttaatgacattttcttttctctagcttactttaaaaatacaatatataacacttataagatatgtgttagtcaaccatttcttattgataaggctttcagtgaacagtaggctattagtaagttaagtgtttggtgaatcaaaatttataaacagattttcaaatgcacaggggtcagtgcccctacctaccatgttgttcaagggccaactgtataattctaaccaggatttgtaaactgagtccctacctctatttaagtcagcagtacaaaggggcctcaaaaccaagccttctccaggatatgttggggaaatggctggagaaaatgtagctgtattctggctccagtccacttctttgagtagacttgggtcaaacataggagtttcatcaggtttcatctttgcagtaaggtctaaaatacaattttaaatggtaaggcatttttaatagggaattaggattgatgaaattacttaaaaattaacacatatgcaaggtattttattctatcctgaatctaacataaatgccacaaccacagataaatagaaaactcatggtgatcatcagaaaacaagtgactaaatttctaagttttaaactttaaaaccccattttctaccaagtgttttaaaacatttttcctggggtgcctatgtggctcagcaactgacttggtttctgctcaggtcatgatctcagggttgtgagatccagccagtgttggctccgcactaagcatggatggtgtctgctgaagattctctccttctctctctgaccttctccatactcacacatgtgcactctaaaataaaaaataaattcttaaaaaaataacacatttttcctatgggttggtactagcatagctctgtgaatagctgacttcccatgaacttttatgttttttcattattggattttattatttggctaagaaattatttgttggcagtcttaccactaagacttactgtgcatgttacttgtttttttatatggactatggaaagataattgatgaactggcttaaaatactctctacattaattgtaatatttggtttcagctatgacattcatattaaaggtatctgttggattttgttttcacaccaggattttccaaaaatctgtaatgtaactttctcagcggcatttaggcagcttaagaattgccagtctttcatgtgattataaaaggatcaattatagtattgtcttttttgaacatttagaaatggaagattcttactacctgtagtctaataaaaaagactaaataacagatataatagaaaaacaagttatataaagaataacaatgcgggcagcggaatgtctgtggaacacagagccactagaatggggtcttcctaagaactattaggagactgtaaagcaacctctcttatttctatccctttactcagttaaagaaactatttgatacttgcttccagaaacaaagaatttaagatacctatctataactaccaccaaacaaggaaacaggaaaaattaaagtccatttaacgatttttccaataaccctactcccattatgttccttatttcctaagtcacattatgcttaagggcaattgttattaactttttcttaaaggttgattaaactcctgcctgtggaacccaacataaccatacaagtaatgctgcaactgtagtagaggctttgggaaggtagtgtgatgtaattaagaagttaattagaagttaacattgttcagcacttctgatggaccagacattgttcaaaggactttacacattactaattcatttactttaacaatcttacaggatgagggtgattattctccattttaacaggcgaggaaatgcaggcaggacatgtaaagtaacctgcccaagatcacaaagtggagctagaatttaaatctaagatggaaaagagcatgagctctggagtcacactaatgttcaaatgtcaaatttgattatggctaatgtcagctctgataatgtttcatttgtaaaatggagatgaaattattaggacaaaatgaattattatatacagcacttaatagtgcctggcatactgcaaatgctcaacaagacatattttagttagcaactaattacaaattcatgtttgtaaatttttgatatttttcatctttacattaactcatgaatcaggcactgtagcaagggctacaaaaaggatgacaggttatctatatttttttttttaaggattttatttgtttattcatgagagacacacagagacagagagagagaggcagacacaggcagagggagaagcaggctccctgcaaggagcccgatatgggactcagatccccaatcccaggatcaagccctgagccacccaggcatccctgtttatgttatgttaaactgaaacattcttaggaaagaaagaataaaaaaaaaaatcatagtgtattatgtagaatccaaggggcttccccgccccccaaaaaggactcaaatatgttatgctataaactctatacctggttctaagaataataaggaaataaattgtgatgatcagcaatcaaatttaacaagcttacagtccacttgaaacatttttttataagttaactttaatgcatgcattttgccatctgtccctgataactgatccctgaagcttttaggtatacccatctgaaagatgggtaacaacactgtttttcaggtatacaaataaacaggctatttatttattaacaaggtaaaacatattaatttcagaagccagaaagtgttaaaaaacttaagtacctcagggtggcacactatttaaacagtttgatgatcattttatttatcatgtaggtataaccatgaagtttaaagaaagcgaaaagggaatttagatgaacattacaataatttaaagttaactagattactttttcctacgaagctgcctgagttcacaataaaatatagcctagaaaacacgcaaaataataattttgaagagaaaggggagaggaggtatacaggagaactaggattacgaagcatttaacgaatgaattttaaaacagtaaatactaatgttttcctgtgcttttctttagcctaatggtcctattccacgaatgatcataaaaataaataatactggctaaaatttatggagtgctttgtatttgttaacacataagaataaaatgaaatatcactattacctccattttacagaccaggaagcaggcaaggtaacttgctcaagataacaaagccaataaggaacaaagttaggattagaaccagacaacagagccagcttcaagggcactggacctgtgcagctgcccagggccccacacttggttctagtctatgttgccactgtcttgaaattctgcacaggttaccacagattatgcagccattcctgcatgactccagattctgtactctttgtactgaagatgaactagtgaagatgaattccctacttcattgtataagataaaaatttaatcaaacgcaacacttataaactgtatttgaaaaataagagtatcagacatgtcaaaatacaataaagcattctaaatagaaataagaatccattactcaggtcatcagaaataacaaaatgttattttattttaagtatggctattttataaaacaaagctatacttaaagtttccttcatcttactccacccccagttagtaaaattctgctggtgcccaattaatatgctgggaaagttaaaataggatgtgatttgacaccaaattttgaaagattttagaaaggaatgaaatagataaatttggtttacaaaagaaatattttaggggatccctggatggctcagcggtttggggcctgctttcaggccagggagtgatcctggagacccggattgagtcccgtgtcaggctccctgcgtggagcctgcttcttcctctgcccgtgtcgtgtctctgcctctctctctgtctctcatgaataaataaaatattttttaaaaataaataataatttagcatcttaaggtaccccaaggtactgcaaaactaggaaatttcagtaaatagaactgcagtggtttgagggggaatctcatcattatcactggggtgaccgattttaaaaaagtaagcccttaacctccctaaatatttctccagaacttttccaatttaactgccaagtttgtgtgcatttacaaggcccatatatgcctaacaacccaataaatgcctggtgaatgaatagcaaatggcaagagacttacttgaaggtcacatttcaaaaaactcaaaagaaggattcccaaattgccacaagtgatatgacaaaaatcatccaccaaactcatttttactaggatcatcaggttttcattcatttgactactctctggacacaatttctacaatctggtttcccagtttctacagcacacaaaaatacaaatagggaggaggtgctgctggaagcaagtaactaggagcaacaagttggacactgggaatgaaaaattttaaagtcgatacaaaaattttaaaagcataatccaaggcccaatgtaaactgctttacatacctcaaggccatcgctatgttacttcagtacacggtgaacggggaaaggttctctgagactttaggtcttgtctatatgcatttcataaccatttcaataataatttggctacattttttatctgaaggccaaacactctttattcgctgatgattttaggaggcctggccatttttatgaaaccgtgcaatttatacttcacttgagaattttacaaagttattttctgatcgttaatttgacccctataatctggcattattcccagactaccgattaggaaactggagcatgtggagccccaaggtaacactgcaaatgagtgaactgagcctagaatcctatcttgttttcctaccctgagccctaaaataccatactcaatacacgccaatctttacatcatcgcaccagacaggttaataagtctcattttgaagaaaaaaaaaaaaaaaaaaagtcagcgaattctgcctaaataggactgatctcaatgatttcttgagatccattctaagatttgctcaccactgtatataacctaacaaaactaatcccataatccaccctcccccctcccccccccccccccgtttcaacgttgtaggaaatgttaagacttcggtttacgtaaacatcagcacctcttgtaaggggaaatcctagcgcccagtgcgtccaggggtacgagccccgggaaaagagacaaaggatggcctcctccccgcacggaaagccccaaccagtcagggcagggtgtgctcctccgagcaggagcgtgtcctcaagcggctcccgaccgccgtggggtgcagctcggaaagggacgggggagggggagggggtcggggcactcgtgcccgttcaaaaccgatggcggcagagagactgtgggcaagcgtctcgatcccccgggccagagcctgccgagccgagagttcgactcccggccctgctccggcctgccagggccagccccgcgcggctggaccacccgccctcatcccgaaccgcgctcggctccaggcgcgcgtccgctcaacttgctcccaaccgcgctccacaaccacaagtgcccccacctggccaagctaaacgcacacctcgccccgggcccacctccctcgccccgcccgggcagcggtcccagtcacacctgtttggtaaccgtgaaggcaggccccccaggcccccaggtcacccggcgcggccccgctctcgctccccggccctcagcctccctcacccgtgggggcctcgcgctcggcgctcctctccaggcccgtcggactctctcccacccggcgacgcggtaccggatccggatccggcttcagcgccagccccacctcctcctccacctcccgagccacggttgccgtgcggccgccgctgcgcgagccgcgaccaggacgtggcagcgccaacgcctccgcctccgcctccgcctcagcccggccgcttacgcaggggcgctcggggggcggggcctgcggcggctccggcacgtggcgcggcgaggacggcctccccgggctccgcctcccggcggcgtgggggtcgcgccccggctggctccccgcgcgcggccctggcggcggcgtccggctctgggcctcgggggagggcgctctgcccagccgtcggccacgctctgtaagtggtcaccgcgtgggcctctttcattttcggaagccggcggtgcggcttcttgccctccttggggccccttccttcaatagcccgtttaactaggacttcggcgactggctggcagctgagtcacctcatgaagtggggccgtgacgctcctttcagatcctttttggatgaaccgtagggttgagacactggttctcagctgtggcggtttttgcctcccagaagaccattggcaatgtcgggagctttttcagcctccctgtctgtgggagacgtgtcactagcatctctccagatgacagagggtacaggtgggtagagaccaggtatgctgttcaccgtctccaagtacacaggacagggccccaggaggcctttccagccgggggggaaatgtcagttctgctgagacggagaaacaccggggggggggggggggggttaggacacggaaaaaaaaaaatgactttttctcccacctcccgtttccaaaacatgtgtcctcattttacagattaggacaccggagttcagagatgttaaagtaatgtaccaacgtcacacagctagctagtagctcccattcgctggggtataccataaatttcaactttctgaaattgcaaagtgttttattcttaaacaatactgttcaatgaacaccatatatagtcttgccgggagttttattttctgcttctttgtgaaacttaaattccggttaacacttttacaggttcgtgcattctcaccaccttcaaacatcagtgaggctgatggcatccagttttctgtatccgttcttctttttagccttttgcatgggaaagaatgtataagctataaaaaaagaaagaaacgccacaaatattaagaaacattatagccttgtttccttatcacactctggccctacgttttcagtgagttttctcggagtaacagaatcctgtaaatgttgtaattcagcaaaaaatgaagcagttataaaatgtatcacagagcacagttctaagaggtaaattttataatttagcaaaaactgaagcagtcaattataaaatttatcacagagcacagttctaagaggtaccaccaaaatgcaggtacctactgcatttcagatatattccttccttttcccttttgtgccagaggaacacaatttctccttaatagtcactagccagtacagtgagtgtcctccttctttgcctgttggtttacttgcagtgaggaaccaagcatagccagatgacaatctcaaagtctagtttaatggaatcattaatgtgttctctagtcatttttatttagttttttattgagatataattcacatgtaacagtgtattagttttagatgtataacatcatgatttgatgtacttacgtattgcaaaatgattacttcagtaagtttaggtaacatgcctcaccacacatacttacaaatttttttctcttgtgatgagaacttttaacatttattctctttgaggctttttttttttttttaagattttgttatttattatagagagacagaaatagcgacagagagcatgaacagagtagagagggagaagcaaggagcctgatacagggctcaatcccaggaccctgggatcatgacctgaacagaaggcaaatgcttaaccagttgaaccatccagatgcttctctctttgcaactttcaaatatacaatacagtattattacttatagtcaccatgcctacattacatcttcaggactaatttaactcataactggaactttgtgcctttcgactccttcactgattttgttccccaccccccacctctggcaaccactaatttgttctctttatgaatttgttcttgtttttagattcaacttataagtgagatcatagagtatttgtctttctctctacagtaagttcacttactgtagtgtactaaagctccatccaagttgttgtaaatgacaggatttcctttttaatggctgaataatatgccaccatgtgtgtacctacatatatataaacacaaacttctttatccactcatctaagaatagatacttaagttgtttccatgtcttatctatttattaataatgctgctatgaacatgtggatatgtatatcttttctggatggcagtttaatttgctttggatagataacagaagtggaattgctagaccatatgatagtttctgttttaaaatttttgaggaacatgtttttgtttggtgctgtttagaacagtttttttaagttttaattttaattccagttagttaacatacagtgtttatatttcaggtgtacaatttagtgattcagtaattctatacattgctaagtgctcatcataataagtgtcataataagtctcatcataataaccccccccactcacctcccttctggtaactatcagtttattctctatagttaagagtttgctttttggtttgtctctctctcttttctttccttttgcttacttgttttgtttctcaaaatcatatagtatttgtctttctctgacttattttgcttagcataatactctagctccatccatgttgttacaaatggcaggatttcatgacttttttatggctgaatattcatatatataaatatatatgaatgtatataccatatatatatgaatatatattcatatatattccacaccctctctatccattcatccatggatggacactttagctggtaccatatcttagctattttaaataatgttgcgatgaacatgtgggggcatatatcttttttgaatcagtgtttttctattctttgtgtaaatacccagtagtgtgattgctggatcataggatagttgtatttttaattctttgaggaaccttcacactgtttcccacagtggctgcaccagtttgcattcctaccaacagtgcagaaggtttcctttttctctacatccttgctaacacctgttgttttgtgttgttcatttcagccattctgacatgtgaggtaatatctcttgtagttttgatttgcatttccctaatggttagatgttgatgaacatcttttcatgtgaaagttggccatctatatatcttctttggaaaaatgtctgttcatgtcttctacccatttttaaattgggctgtttgttttttgggtattgaattgtgtaagttctttatatatatttaggtaccagccctttatcagatatgtcacttgcagatatcttctcctactctgaaggttgccttttaggggtttttttgttttgtttgtttgcctttagttttgttgactgtttccttcactgtgcagaagctttttattttaatgtagtcccaatggtttatttttatttttgtttctgttgtctcagggaacctatctagaaaaacgtttgtacagccagtgtcaaagatgttactgcctgtgttctcctttagggttcttatggtttcaggtctcacatttaggtctttaatccatttggaatttatttttgcatatgatgtaagaaagtggtccaatttcattctttcttatgaagctgtccagttttcctaacaccttttgttgaagagaatgtctttttcccattggatattcttttctgctttgtcagaaattaattgaccatgtaattgtgggtttatttctgagttttctgttctgttctattcatctatatttctatttttatgtcagtaccatactgttttgattacatagttttgtaatattacttgatgtccaaaattgtgatgcctcaggccttgctttagttttcaaaattgctttgggtattcagggtcttttatggttccatacaaattttaggattgttttagttctataaaaaatgctcttcatattttgagagaagttgcattaaatgtgtagattgtttttgggtagtatagacattttaacagtattcttccaatccataagcttggaatgtcttcccatttctttgtgttgtcttcatttctttcatcagtcttttatggttttcagagtacaggtatttcctctttggttacatttattcctagatatcttattatttttgatgcaattataaatgggtttgttttcataatttccctttcttctggttcattattgttatatagaaatataagagacttctgtacattgattttgtatcctgccactactgaattcatttatcagttctagcagttctttggtggagtcttgagttttttatatattatatcatgtcatctgcaaatagtgaaagttttgcttcttccttaccaatttggatacctttcatttttttgttgttgtctgattgctgtggctaggatttccagtactatattgaataaaaatggtgagagtggacatccctgtcttgttcctgatcttaggggaaatgctctcaatttttccccattgaggatgatgttagctgtgggtttttcataaatggcctttattatattggaaatatgttctctctaaacctcctttgttgagggtttttatcatgaatggatgttatacattgtcagatgctttatctgcatctattgaaatgatcatatgatttttatcttttctcttattgatgtaataatgtatcacattgattgatgtgcaaatattgaaccacccttgcaacctagaaataaatcttacttgattgtggtgaaagactttttaaaatatattgttggatttggtttggtggcattttgtcgaacatttttacatctatgttcatcagagaattagcctatagttcactctctctctctttttttttttttttttttgtgtgtgtgtgtgtgtgtgtgtggtgtctttatctggttttagaatcagggttatgttgatctcatagatgaatttggaacttttcgttccttttctattttttgtaatagtttgagaagaatatgtattaactcttctttaaatgtttggtaaaactcacctgtgaagcaattggacttttgtttgttgggagttttttgattagtgattcaatttctttttttttttaaatatttttttaaagattgtactcatttattcatgagagacacagagagagagtcagacacaggcagagggagaagcagcctccctgcggggaccaacatgggactcaaaccaggaccccggaatcactccctgagctgaaggcagaagctcaactgctgagtcactcaggtgtccctggtgattcagtttctttactggtaaagaattttctttaaaattctttaaagaatttgatctgttcaaattttctatttcttcctgattctgtttgggaggttatatgtttctaggaatttctaggttgtccagtttgttggcatatagttttttataatattttcttttaattgtttttatttctgtggtgttatttctcttctcttatctgattttatttattttagtcatttgtctctttatcttgataggtctgggtagaggtttatcaattttattgattttttttaaaagatttatttattttagagaaagacagcaaggaagcataaggaagagggggagagggagagagaaggtcaagcaactccacgctgagtgtggagcccaacacagggcttgatcccacgaccccaagatcactacctgagctgaaaccaagagtcagacacctaaccaactgtaccagatgcccctttattgattttttttaagagccagtttctggtttcattgatctgtcctattgtttttttagtttctatattattttctattccttactgtttccttcattctgctggctttaggttttgtttgttgttctttttagctcctttatgtgtaaagttaggttgcttgagaattttcctgattctggaagtagacctgtattgctataaacttccctcagaattgctttcactgcatcccaagggttttgacccattgtattttctttttaatttgtttccatgtacttttaaatttcttcttttatttttggttgacccattcattgtttagtagcattttatttaacctccatgtatttgtggtcttccagatattttcttgtggttgacttctagccattgtggtcaaaaaacatgcatgatatgacttaaatcttgaatttgtggaggcttcttttttgtgagctaatatgtgatctattctggagagtgttccatgtggacttgaaaagaatgtgtaggggtacctggatggctcagttggttatgtggctgactcttgatttcggctcaggtcaaaatcaagatcagattttgatctcaggatcgtggtattgagccctgcactgggttccacgctcactacaaagtcagcttgagaatgtctctctctccctccttctttgcccctccctcttgtgttttctttttagggatgcctggatggctcaggacatgatcccagggtccaaggatcgagtcccacatcaggctccctacacggagcctgtctatgtctctgcctctctctgtgtctctcatgaataaataaaatcttaaaaaaataaatctttaaaggaaagaaaataatgtgtattcttatttagtatgggatgttctgaatacaccttaacagatgtattctatctggtccagtgtgtcattcaaaaccattgtttccttgttgatgttctgtttagatgatctcttgattagttcctttatgtttgttattaactgttttatgtatttgggtattcctgtattgggtatataaatacttaacaattgttgtaccttctggctggattgtcatctttattattatatagtgtacttctttgtctattgttgtagtctttgtcttatttatttatttattttaaagattttatttatttattcatgagagacccagagagagaagcaagctgcatgcagagagccccatgcgggactcgatcctgggactccaggatcatgccctgggccaaaggcagatactgaaccgttgagccacccaggtgtccctgtagtctttgttttaaagtctagtttctccaatataagtattgctacacttttttttaaagattttatttctttattcttgagagacacagagagagagagagagagagagaggcagagaggcagagacataagcagagagagaaaccagatccatgtagggagcccaatgtgggacttgatctcaggactccaggatcatgcgttgggccaaaagcaggcgctaaaccgctgagctacccagggatcccctgtctttcttttgatatccatttgcatgatagatgtttctccatcccctcactttcaatctacacgtgtctttaggtctaaaataagtcttgtaggcagcatataggtgggtcttgttttatccatctgttaccctatgttttttgattggagcatgtagtccatttatattcaaagtaatcattgatagatatgtatttattgccactttattacttgttgcgtggttatttctgaagattttctctgatcctttcttgtctttctctttcatggtctgctgcttttctttagtgataggtttggatttctttctctttattctttacaacttattagtggtttttgatatatggttactttaggcttgtatataactcttctccatatagcagtctatattaagttgatggttatttaagttttttttaaagattttatttatttattcatggcagacacacagagagagaggcagagacacaggcaaagggagaagcaggctccatgcaggaagcccgatgtgggactcgatcccaggtctccagcatcacaccagggcggaaggcggcgccaaaccactgggccaccgggactgcccaatggttatttaagtttgaactcattctttatttctctccatgtcttaggtatatggtatcatattttacatctttttattttgtgagttcctgatattttacaaaaatacttatttttactgcttttatgtttgctatcttcacactgttacttttgttctttcctttccactggaagagtcccctttaatatttgttccagggcttgtttagtggtcataaactccttagtttttgttcgtctaagaaattatctctcttcctattctgaatgatagccttgctggaaatagtatacatggctgcaggtttttttgtgttttgtttgtttgtttgttttcccagcactttgagtatataatgctactctcttgtggcttggaaaatgtcttctgaaaaatctgatagctttctggcgtttcccttgtatgtaactgtctcttttgtctttctagctttaatattttttatcactacattttccattttaattgtaatatatcttgcttttgttgattatgttgagagttctatgtgcctcttggatctcgatatctatttccttctccaggttagggccatcagttttcagctattttcaaataaatttcccccctccctttttctctctctccttctgggactcttataatgtgaatgttattatgttggtagagatactgagttccctaattctttttttttttatattttatttatttattcatgagagacacagagagaggcagagacataggcagagggagaatcagactcctcaaggggagcccaatgtgggactcaatcccaggaccccaggaccccaggaccacgtcctgagctaaaggcaagttgctcaaccattgagccacccaggcatcctgagttccctaattcttttcttgttttgcataattttttttctttcttttgttcagcttgattgctttccattactcaattttctaggtcatttctaggctattaatttgttcttctgtatctttcatcctgctgttcatcctatcaagcatgtttctcaactcatttattgagcctttgtttctgctttgttattctttattctgtgataagagtctcagacatgtcttcattccttttctcaagtccagtaagtatccttatgatcattgcttcaaattctccatcaggcatgttacttatatctgtttcatttagatctctggctgtggccttgtcctgttctttcatttgggacaaattcctctgtcttaatcggtttgtctaagtctctgggcctacttctgtgtgttaggaaagtcaggtacttctattcttaagggtaatggccttatgaaaaattgaccctgtagtgccctgccatgtggtgtcctctgttccccagggcctggtacttctgagaatgtctttaatatgtgctttgtgggctcttctattgtatcctggccattttttttccttaaggttagtcgtctgcagaggctgtctgcctgttgtggtcagtggttggtccctggcctgaatgtggtgttttaactgggtgtgctcttgtctgcttgtgaactgagaccagctgccagaactgagaccctggaaaccagattggaagacagggtgtggctggagtttgagccaatcttctgggcaagggggtccaccttgctgtgcctgaggtaaacatgtctgagaagggtgattccaccagagcttggggggatggggcttggtatagcaagataggtaatgagtattggtgctctcttggttcccacagatggccctgtgcttatgctgagggatgagagggaaatggcacctgccatgtcctttgctcccagaagggtctctccatgactgttgcctcttgaagaagagcaaataacctcccctctatgtaccctaggaactcttcagattactgtttccatgctgtatgtcacaggttgttttccctgccttgtctctaagagcagccccaatatcttagggctctcctagagccaacttgcagacctttaaaactttaggccttaactaccactgattgcaagaactcacaagattcagccccgctcacttcccaaaccaattgctatggggaattatctttcccgtgcactcccctgtattctagtctgtctcttacccttctccacaatggtttgcttcatttctgtgaaaaatgctgttagaattttgatagggattgcattgaatctgtagattactttgggtgaatagacattccaacagtattaattcttccagtccatgggcatggagtatctttccatttatttgtgacttcttcaatttatttcatcagtgtcttatagtttccagtgtataggtctttcacctccttggttaaatatattcctaggcattttattcttttgaagcaattttaagtgaagctgtatttttaatttctctttcaggtagtttattattagtgtatagaaacacaattgactttgggtattaattttgtatgctacaactttactgaatttgtttattctgatagtttttttggtgaagtttttagggtttttctatatatagtatcatgtcatctgcatatagagacagtctacttcttttctgatttggatgcactttatctatcttgcataaatgctttagctaggacagctattactattaaattaaattaaattaaattaaattaaattaaattaaattaaattatttgagagagagaaggaaagcacaaatggggaaggaatagagggagagggagtgagggcggagcctgatgcagggctcaacctcatgaccctgagattatgacccaagccaaaaccaggagatggacagtcaaccaactgagccacccaggtgccctctcccagtactattttagatgaaagtgatgttgccttttgtcaaatcctttttctgaatctattaagatgattagatgatttttatccttaactttgttaatgttctatatcatcttgattgatggtgaaacatccttgcatcccaggaataaaacccacttcccagtctatgaaccttttaatgtattgtttaattcgatttgctaatattttgttgaagagttttgcatctatgttcatcaggaaattgacctataatttccttttcttgtaatgcctttatttcgttttgatatttaatactggcttcataagatgagtttggaagtatttccatctctttacttttttttttttttttttaagattttatttatttattcatgatagtcacacagagggagacagagaggcagagacacaggcagagggagaagcaggctccatgcaccgggagcccgacgtgggattcgatcccgggtctccaggatcgtgccccgggccaaaggcaggtgccaaaccgctgcgccacccagggatccccatctctttacttttttggaagtgtttgagaaggattggtattaattctttaaacatttggtagaattcaccaggggagccatctggactttgttggatgttactgattcagtttccttactggtaattagtcttcagattttctattaattcataattcagtttttacagattgtatgtttgtaggaatgtatccattttttttctgtattatctagtttgctggcatagatcatagtagtcttttatgattgtatttctgttgtattagttgtaatgtctctttcatttctgatttttttgagttttctctcttttattttccttggtgagtctagctaaatgtttatttttttgaaacccagcttttggtttcattgatcttttctattgtctttttagtctctgcttcatttgtttctactctgatatttgttatttccttccttctactaagttggtcttaatttgttctttttctagttcctgaagatgtaaaattaggttgtttatttgaggtttttcttattcttttattgttgtttctttgtttttgttttgtttttaattggttacacaaagaaaactttatttgcagcaaataaggagatcatggggaatggttcaaagccttgactcagcgtgttttttatttcttagtgtaggttttatcactgtcaccttccctcttagaactatttttgctgcatcccataaattctggtatgttatattcccattttcatttgtctcaagatttgagttctatttttatttcttctttgacctgttttttgttagcatgttgtttaaactccatgtatttgtcaattttccagtttttttcttgtaattgttctctagtttcataccattgtgattggaaaaaaaatgcttgatatgattttgatcttcttaaatttttatttttttttagagagagactgtgcacttgattcgaggtggggaagttgcagagggagagaatctaagccagtgctaagcatggagcccaacacagaacttgatctcacaaccctgagatcgtgacctgagctgaaataagagtcagatgcttaaccaactgagtcacccaggcacacttcagtcgtcttaaatttattaagacttattttgtggcctaacatgtgacctatcctggagattgttccatatgtgctggagaaaaatgtgtattcttctgcttttggatggaatgttctgtaaatatctgttaagtccatctggcttaacatgttaagtctaatgtttctttattgattttctgtctggatgatctatccaatgatgacaatgaagtattactactattattatattgctgtctacttctccctttaggtctattaatgtttgctttgtatatttagttgcttctaggttgagtatatgtgaatttacaaatgttatattatcttattgaattgacctctttatcattatataatgaacttctttgtctcttgttacaagtttgtcttaaagtcttttttttcttatataagtatagctatttcagctttcctttggtttccatttgcataaactatcttttcacatcccttccctttagtctgtgtgtgtccttaaagttgaagtgagtcccttataggtagcatatggttaggccatatattaaaaaaaaaaaaaaaaaaaaaaaaatatgttcagccactttgtgtcttttgattggagaatttagtctatttacattttcttaaagatgtctttattttagagagaaagcatgatggaggggcaaagtgaaaagggagagaaaatattaaatgggctccttagcaatcaatctttttttttttttaagattttatttatttattcatgagacacacagagagagaggcagaaatgtaggcagagggagaagcaggctccatgcagggagcccaatgcagtattcaatcccaggaccccaggatcaagccctgagcccaagacagatacccaactgctgagccacccaggcgtcccaatcaatcaatctttaaaaaaaataatatacatcttttatctgtgtgtccattagcaaattattgtagttatagctatttttactacttttgtcttttaaccttcatactagatctataagtgattaacctaccactattacatttgattattctgaatttaactatatatttacctttaccagtgaaatttatactgtcatgttttcctgttattaattagcctcctttcatttcagcttaaagaaattcctttaacgtttcttgtaagttcaatatagtggtgctgaactccagcttttgcttgtctgaataactctttatctttccttcacttttgaaggatagttttgccaggtagagtatttttggttgacagatttttttctttcagctcagtgaatatatcatgatattcctttctgacctacaaggtttgtgttgaaaaaacttgtagtctttttaaaaaaagatttatttattttaggagagagagagagtgtgtgtgtgtgtgtgcatgagggagaggggcaaaaggaaagggagggagaatctcaagcagactctgtgctgagtgtggaactgaatgaagggcttgatcttacaaccttgagatcatgacctgaactgaaaccaagagtcagatgcttaactgagtgtaccacccagatgccccttgttgataggcttatgggggtttccttatacatagcaagttgtctttctcttgcttttcttattctttccttgtctttgacttttgataattatagtttatgttggtatggatctctttggattcctcttctttagaacttcctggatctgaatgtctgtttccttcctcaggttggggaagttgtcaactattatttcttttaaaaaattttctgcccctttctctctttcttctccttttgggacccctatagtgtatatatcaggcctcttgacgttgtcccaatagtcccttaagctatctttattctttttcatttttttttctttttgaacctcttattggatgaaatctgctctgttttagagtttgccgatttttcttccatttcatctgctagaaaaaccttctattgagtttttagttcaattatggaattctttagccctgtgatttgtttggtactttgttatattttctatctctttgatgaaattctcattttgttcatgcattgttctcctggcctcagcaaccatctttatgaccattattttgaactttttgtcaggtgaatcacttatctctagttcattaaggtatttttatgagattttatcttgttcttttgtttggaacatgttcctccattcagttttcttagctttcttggtttgcattagatgaaacaaccacctttctcagtcttgaaggggtgaaccttattattcagtcctgagctcctcatggttttcttccaacctttgtgattgtccatgtggccttttatgttcttaatggttcccagtagttgagggtatgccagtattagtcagtgtcccaaaggggaggatttcagcactaaatgcagactaattagaagcaagacccttagggaactttttcttttcctttcttttaaaaaatttttcagggcagccccggtggctcagcggtttagtgacaccttcagcccagggtgtgatcctggggacccgggatcaagtcccatgtcaggctccctgcatggagcctgcttctccctctgcctgtgtctctgcctctgtgtgtgtgtgtgtgtgtgtgtgttttatgaataagtagattaaaaatcttaaaaaaaatttttttcattctgatctcagatcaagtgtataaaccctcacagttataaaagtctgtagtaaaactttttagtaattgatcagaactgatcagtctttcatacacacacatcaccccccaccttatctcattcatccatcaacaagttctcaattatacactatcaccttataaacgcatgcatgcacattcctaactctagacataagcccttattgttttaaattacttttacttcttagaattataaagatcatgcattagacatactggaaggcctctgatgctcagattaggatattttcatcattgatccacttccttttaaagaatgtaaatatacttccttcaccggcagactaggagatgtttatttctgtctgctccctctgcacgtcaaaccctggggcgataggccgttaagaactatttctttatttgctaccatcctactgaatacatgaatacaagccccagtggccactagtgcccagttatcaagagatgtgtcttttgggtggcagtcacaaaaaccaaggtggcagacatgtgcataagctcctttctcaaaaacattggcagtctggagtggggcagaggggagagcacagtgatggtgcctgttggccttactggtttctggagaggatggcaattggtccctggatggttgttaaaatagaagcttggccctcacctcagctattaagataataagctaataggcaaaaaagaaagaaaaaagataagctaataggcctctttcacaaaaagactacatgtttcaatctgctatttctgcagtgttcagtggagggatgtctggttaagaactgtttctctgtttgttacagtgctatggtacccacaaacataagccccattatggggctccctctgggcagcagctacaaaaactggggcatcagacatgtggacgagctcctttctgggagactgatggcctgagggagaacaggaagatgcacataccagcctccaatgtctggatagtattaaattagacacctgcccccaaggcttttaaggtaagcaaatagtttctttcatgcaaagactgggtttgtttcagtctgctgcctctatgctgggccttgggggataaaccatggagagtccacagaaaccctttatgaactattagttcattatagactatggacctcataggtgcaaatcccattggctttcaaaggtagatgctttgggagtccatttttcaggtggaagtcttcagagttgtggtaccagctgtggggttcatacctttcactcctcagagagaagctctgagttgtgagttccctgtgccagggttgaggtggatggtgagattgtatgtgaggctgtcctactcacttcagtgtgagtttttctcctttgcttgatgtgtaagagtcactcagctagtttctagatgtctctcagagggaattgttctgtatatagctgaatattagaataataataatctaatcaaagtacatttatggtacttactatcatagataacaacatatgtcttgttgttttgaccttcaaaggtggctcattttcacctggatactgtgccttcatattgtatacttgtctctagctactgctaggttgtcagggtcttgcttccaagcaaaaaaaacccaactgtagagggttgatcattagtttacagaatcagtgaggaggctggagaaccaacaggctcagaaaataagagaagccaagagggtctaggcaacccagaacagctagctgcccagagtctggggcaaccagcattttggtttttaagtttcctcctgtcaagagttataccttgcttgggcagcccaggtggctcagtggtttagcgccaccttcagcccaggacatgatcctgaagacccaggatcgagtcccacgtcaggctccctgcatggagcctgcttctccctctgcctgtgtctcttcctctctctctttctctctctctctctctctgttgtcatgaataaataaattaaatcttaaaaaaaaaaaagttatacattgctgaattcccaaattcagatcctgggcagccagaaaaagtacatttacaattgattattatgtattatgccatatgtattttgtttaaataggattgaatagaacattttttatggattttatttatttattcatgagagacagagagagagggagaagcaggctccatgcaggaagccctatgcaggactcaatcctgggactccagaatcacgccctgagccaaaagcagatgctcaaccgctgagccacccagacatcccaagaacatttaaaatgtgcatttaataaggccattttagccataaggaattgttttgttattattacttttattttaaagagtgctattaagtactagaaaatctgaaaaatatttccagaactacaatgttcatcctgttgtgggcatggccgttttattaattccttccttgctgtaagtgaaaatatacagaggtattccccttactcccagcccccactccaaaactaaaccaaattaattgtgaaatatggtatgattcaccttattttctggaattcacctataaaaatcaggtattggctatgggtggcagagtcatttttaggcattccttgattattccattctccagtgtcatttgacttccatctctaaatttagtctttaagtatccaacatagagcttatctacatatttgttatttattgcttactgcaaaggaatgaatgattattttaagatttgtaacattatggaaacaaagaacaaagaatgatcactccccataatcctgccctcagagataactactattaacagtttggtagttcttaatctagactgtctggtttccattttcagcttttccgtttagctggctaccctgaacaagttattggtcctcacactgcctgagtttcctcatttcagagtaatagtaatagtttactggttcacaaggctgagagagggtttaataagataaagcattcagcagagttactgatatataataagtttcataaatgctagtttgcatacatatgttagtcaagatagactagattatattggaataacaaaaaatccacccaaatatcagttgcttaacacaacaaaaatttacttcttgctaatgctgcatatcttattgcagattggcagggcgttttctccatgcagtcactcaggggcccagggtaatggaagttctatcatgttgtggtcacactctgcaatgcatggtacttttagtcatcacagcaacaaaaagactataaatcacacatcggttttttttactgcctcagcccataattgacatactaaatttcagcacttacaatttgctagtcagaactggtaatcatagccctgctctgctacaagtaagctgtagacatatggaatgtgaagtgcagaatatttggtgaatgctactacctctttcaagtccacctttcctgccacccagtaatgtagattatccaaattgtgttgtagtttttatgttttttttttaatttaatgtatcatggacatttccccatatcagtacatattaattcattcattgaccatttatttatttttaaaaagattttatttatttatttgtgagagaaagtatgagagagagagagaatgagcaggcatgagtaggggagggggcagagggagaagtaaactccctgctaagaagggatcctgatgtagtgcttgatcccaggatcctgagatcatgacctgagttaaaggcaggcacccaacaactgagccacccaggctcccctcactgaccatttagtaagcctttctatgcatcaggcctattctaaatactgggctataacaatgaagataacatttgataatccctgtcttcatgtaatttattgggttgcaaacaggtaagaaataaaatatttttttgaagtataatgtgttagggcagccccggtggcacagcggtttagcgccgcctgcagcccacggcgtgatcctggagaccctgaatcaagtccgtcgggctctctgcatggtgcctgcttctccctctgcctgtgtctctgcctccctctctctctctctctgtgtctctatgaataaaaaaataaagtctttaaaaaaaataaagtataatgtgttagaaggtaataaatgttacggtgagaaaaaaagaaacggaagaggcagagggagttttgagggcacagtttatttaattatttttaaaagattttatttatttattcatgagagacacagagagagagagacagagacataggcagagggagaaggaggctccttgcaaggagcctgatgtgagactcgatccaaggatctggtgatcatgacctgagtcaaaggcagactttcaagtactgagccacccaggtgccccttgatgatacagttttaaatagaatgcccacagaaacctttgtgaggtgactgtagttaaattctgaaaggtatgaaaaatatcttgtgaatatcttttataggagaacatcccaagaaaataaaagtattagtgtggcttggtgatatgaacacaaaaacacattttcctatttttgtgttaagtttcaaattttctatgaaaataattaaaaatgaaaaataaaactggttgtaaagctgacatccagattttatatcagtattttggaaaagaaaaacagaaaattaaataaataataaatataataaatattctcaatctttttttaaaaaaggaaaagttttaccaatttatctcctcagaaacagtattttaactgctttgtttctctacatcctcattgactagttcctatacaatccagcattcgattaggattgttgttcatcactgcataattgcattatgtatgttaatcttacctttccaattatttgttaaacttttttttttaagtttttatttatttattcatgagagacagagagagagagaggcagagaaacaggcagagggagaacaggctcaggcagggagcctgatatgggactccatccagggactccaggatcacaccctgaaccaaaggcagatgctcaaccactgagccatgcaggcgtccctatttgttgaacttttaattctgtcttactttttatacctctcattccctttaaagtgattagacatatataatcaattccctataaaaattacagattgagaaataaaacttagtggtgactttcatttaaatataacctcaattgctaataattctaacagtattttcctatatcgagaatgaaaaaaattaataaataagctgcacaaaatatatctataagcaatttaaaagttttgagtattagagaactggtttaaaaatacttcaagtatttttttcaagtaattggctaaattgaagtataatttgaatagacctttcttagtcacatacttatgattcttcccctaaaaaatttgttttttcagtggtttactttgttgccatacaactaggctacgttgcacaaacattgtgagtaaattctgtcagtttttccttaagatgacagagagtcttaacaatttagatgattgtgattgaaataaaaaatgaaatcagccttattcagcccaaagagtttactgaactctgtaaaagttatttggctagattatgaggtaacacccagacaccaatgaggagtgtctctgaaagatcactcacttagaaccaccctgcatttaggggaagtggtgacaggctggtcaaggaagactcttgttacagacaaatttgtcagtgttagtcacacaactggaacataatgttaagaagaaaatgtatgacactgttgggaagctatgttggaagagctgtggccaaagaaaagagaattacaaattgcacttccatagcacagataacttggaaatatggtacataaaaaaagttttgttttcataatttagttcactccagttataatctattttatatgaggtaaaatctctattttgagaatgtcattacctcaggaaggaagaattactgcattatactgacattaagttagaaatatttttagggttcggaatgattacattttcggtatcagactatccaaatcataaaaacagttttggaatatagtgttcatacctcagcatcaaacatagaaaatgataagtcacaggtcaccaaactactctgagactgtaaatagaaattttgatctctgaatctcaatttcctcatctgaaaaaaatggagatacagactttcttccttctgcactttactggtatgttttgggtataccaaatttgtgagcctcgttcttctcagcaaaaacttgagcaaaaggaagaataaataataattgaaccattcatggtgcccttgaaaagagtgttccccattttcattgctaatcctcctctgaagggagaatttccttaaattttgacctgcagacagcaggtttttacactgctctgccctatcataaattctttgctcaattatcatttattcattcattttttttagtaagttggtcattcaccagttgaggtcattccagctagggactggagatacaaagagggataagacagttccagtcctcatgtataaagagcaagggagaccaactttatacaagtatttacaaatgtactcagttgatgcaaatgtacagaatgctaatcggaactttcaacaggggactaggtaatgtatattgggaatcggaatagattttagatatatcaaagctattaacaagaaaaatgaggagttggctaagcgaagagtgtaaggaaagtgatttaagcagagggaatagcgctgatggattttgagatactgaaaggaaagccaacatggttacagtttagagagacaaaatccagatctcagacaccttattaagggattggtcttaattctgagagaaatggaaaaccattgaaattttttgtttgtttcttgttttatatgtttaagcaggaagtgacataatcacttgcatttttaaaagatcattctaggcactctgagcagaatggtgcccaagtcatagatgtagggaaacaggagacaattggaggaagtgaatgacagggttggcaaagaggaggaggaaaaagtgaactgattcaagagatatttaagagacagaatcaataggatttgattgtgagggaaagatgaatcaaggatgacttccagatttctggcttacggaaatgggtggatgctatttatttaaataaggaatactggaggaagataaagttcaggaaggagaatcatgaatcatagttgaccagcacatagcatacacaatcagccattttgaatataaaaatctcagggtttagattacacatagatatgaaagtacagattttttttaaaagattttatttattcatgatagacacagagagaaagagagagagagagagagagagagagagagagagagagaggcagagacacaggcagagggagaagcaggctccatggagggagcctgatgtgagacttgatcccaggactccaggatcatgccctgggccaaaggcaagcactaaacccagggatccctcagattcttttttaaaaatattttatttatttatttgacagagagcacaagcagaggtagagggagtgggagaagcaggctcaatgctgggggctcaatcccaggaccccaggatcatgacctgaaccaaaggcagacgcttaaccaactgggccacctaggcaccctgcaaatgcaggttcatatcaaaatcatgcttataacttgatccctaagtcttgctttttaaattctgggtgacatttataccttttccttttccttttccttttccttttccttttccttttccctttccctttccctgtcctgtccttgtcctgtccttctttgagatagagtgtacaagagagagcacaagcagggggaggagtagagggatagagagaagcaggctctctgctgagcagggagcctgacgcagggggctcaatcccaggaccccaggaccatgacctgagctgaaggcagatgcttaactgactgaatcaatcactcaggcgccctgatatttaaacctttcagtggtcttttaccttcctattcttgggtatttcagatctttttaggtcagatcttaagtgttgtcctggttccagctttaaattgaacagtttgaagccctctttttttttttttccttttgctttttctcctctttgttatagattgtaaaaccttaacttttcttttatccttagatctctcatgtaagatctaattttatctgaagatcactcccatagcttgaattttcttcatttcttatactttatttttctaataactcaataacttccttccctggagctacccatcttccctgtgttgtatcaatttccacaatggaacaaaaaaggagaaaactattatgaaggatgaagtgtattttatcacaagctattattaccacatgttgctaggggacacctgtttcatagtaatgaaacaggattgaactgaatgtctacaaatggttttttaatctttgcaaaatatagagttaaaaataagaatatataaaaaaaataaaaataaataaataaataagaatatagaaacattgaaaataaaggagcataaaatatatatcaggtaaatactaagcaaaacaaagctagtataaatctatgaataccagaaaatgtaagattttaaagcaaaaagcatgactaaagaggatcactagataggataaaaggagcaaatcaccaggaacaaggagttaagagacaaatcctacaatcataataagagatttcaacacctatttctcagtgatacatcaagcacacaaaaaagcaagattgacaagattatagaaaatttgagcaaaacaaactaatatgcttgtttcaatgggcatatataaaatattctacccaaaaattgcagaatatatattttttgaagtggaatacttttgaaaaaccgtgttgaaagaactctaataaaattacaaagagaaggaaaaaatttaaatgaaggcttattctgtgtttatctgtactgtgtagataaggaaattgagattctgaacattgaaaactctaaaaacaaacaaaaaaagccagatattaagtggtaccgtcagtattagaactcagacttaattctttctgtagcattactataatattaaaacctgaaacttggggcacctgcggtggctcagtcggttaagcatctgtcttcagcttaggtcatgatcccagggtcctgggatcaaggctgctgagatggctgcaatttgtggatcagtataccttagatggttgagctgtgaaggagggaatctcaaagatctgtgggaaggttatcattaggagtatggctaagtgtttgcatatgtgtaaagtgagcccaggtgagacctaccagtagtgactgagaacttaacacaaatgtcagtgctggaagaatgtggaatttcaatccattcacactagagagatcttatcacatgccctaggagtatgacaaaaccagaataggatcaaggtgaacactgtaatgaacagcctaccagaacaaaactcaacatactttaaataaatataatacagttcttcacagtgtagcagctaaaattgttctacacaagggagaaattactagacaagtaactcaagaagaagggaaatatgaccattaagagaaaaaatagtagaaacaaagatgatcgtggatgttggactaaatagatatgtactttaaagcagttattataaatatgttcaagaatttaaagaaaaagatggagtttcccttagaggtgtgactgaacagatggggaagctcaacagaaaaatggaaactagaaaaacaaagtgaaatggaagttctgtaactgaaaaactgctaaacagagcttagagggaaacttactgtggtaaatgctcctaatagtgaagaatggctaaaaatgaatgctgaaagcataaaacttaagaaaagaaacagcagaatgaacaaaacagaaggaaacaataagagaagaaaattacataataaacaaaattgtacaaggctcaagtaaaaggatactaaaagcaaacttctagcaaggttggttaaaaaaaaagaatgcacaaataaacaatagtagaagtgagaaggggggcttagaaactcttccaacattcaaaagataaatttatgctaaagttttttaaaattagattaaaattgatagttttagaaaatatgatttcctgcagaagttcttcctatctcaaaaataaattgaatatctgaatagtagttccataactactaatgtaataaccatgatataaatggttagtaaatttaaaccattcattaagcataatataaatggttagtaaattaaaatctttgttggggatccctgggtggcgcagcggtttggtgcctgcctttggcccagggcccgatcctggagacctgggatcgaatcccacgtcgggttcccggtgcatggagcctgcttctccctctgcctgtgtctctgcctctctctctctctctctgtgactatcataaataaataaaaattttaaaaaaaactttatgcagagatacctgggtggctcagtggtttagcgcctgcctttggctcagggcatgatcctggtattctgagatcaagtctcgcattgagctccttgtgaggagcctgctttccctctgcctatgtctctgcctcttctctgtgtctctcatgaataaataatctttatttaaaagataaaaaaataaagaaaataaaatctttgtgcaaagcaagcttcaaacccagagttctatcagtgaatgaccttacaattccagtagtatacaaattatacaagtgaatagaaaaagatctgggcagccccggtggctcagcggtttggcgccaccttccgcccagggtgtgatcttggaggcgtgggatcgagtcccgcgtcgggctcccgggaatggagcctgcttatcgctctgcctgtgtctgtgcgcctctctctctctctatctctctgtctgtctctctctctctctctttgtgtgtctcccattaatgaataaagaaataattaaaaaaaaaaagtcaacttctaactttttaaaaataaaggcagcccgggtggctcagcggtttagcgctgccttcagtccagggcgtgatcctggagactcaggatcgggtcccactttgggctacctgcatggagccttcttctccctccacctgtgtctctgcctctctctctctctctctctcatgaataaataaataaagtcttaaaaaaaataagaagtaaaaaaaataaagctagtataaccttgctatcagtataacctcagacaatagatgacctgtcatgaccttagtgaaaatcctaaataagttcagttagaaaatggaacctgacagtatgcaaaggagataatacatcattaccaggatgagtttatctcacaaatccaggtttcgtttaatattaaaaataaactgtgtttgattaaattcaacaatttgaattttaaaacctcttaataaataaaaagggccattctaaccagataaaggttacaggccaaatacagcagctaacattattcttaatttgatatattgaaagcattctcattaatctcagaaagctaacattattcttaatttgatatattgaaagcattctcattaatctcagaaagaagaaggtagcataaaggagaaaagatctaagtgaatctttgggtgagaaagacaaccctggaactctacaacactgtacagcccaatctaagtaaatgatcatacttcttgattataggactcaatatttttaaaaataattttttcccaaaatgatttgtaaattcaatgcaattccagccaaaatccaaatgaaataagtgtgtgtttgtgtacgtgtaaattgtcaaactatgtaatttatatgtaagagccataaatatacttatgaagaagaacaaggtggaaagatttgccttacaggttaccttattaaaaagctatcataactaagccttttggctccctgaacagcatcatggtggttggaaaaagcaagaaccttacaaaagatggccagaagggagtaaaaaagaaagggtcgatccattttctaagaaagattggtatgatgtgaaagcaccagctatgttcagtattagaaatattctaaatatactagctataagaactcaaggatccaaacttgcatctaatggccttgagggtagtgtttttgaactaagcttttctgcaggtagaatgatgatgttgcatttagaaaatccaagctgctactgaggatgttcaggacaaaaactgcctgactaatcttaaactgtcataaatgtgctccgtggtcaaaaaatggcagaccctgattgaagctcatgttgttgtcaagactactgttggttatttgctttacctattttgtgttggttttactaaaaatcacaacagtcagatttagaagacctcttaggttcagcaccaacagatctgctaaatttggaaaaagatgacggaaatcatgacccaagaggtgtagacaaatgacttgaattaatcactaaatcaatttcaagcagcatatggaaaaagacaaagaaaaggcttgccaatctatttatccactccatgatgtctttgttagaaaagtaaaaatgatgaagaagcccaagtgtgaattggaaaagctcatggagcttcatggtgagggtagtagttctggaaaagctgctggggatgagactggtactaaagttgaataagctgatggatatgaaccaccagtctaaaaaactgatttaaaattcagacatctaatagtgacaaacaaaaaaaccttgtaatatctaaaaataaaaggtataataattaaggcactgtgttgctggttcagggatagaaaaaaatgacgaatagaatagaactggatacctaaacaaaaccacacttatgtggaaaattgatttgtgacaggcttttattgtagatcagtgaaagaaaaagcagacttaaaaaaaagcattgaaacaattgaaaaacatgacatttaaacccctccttcctaccatgcactagaataaagtccaaataaatcaatgactggaatgagaaggacaaaggataaaacttcttgaaaactattacagaaaaatattttctggctttgaagtccaaaaggatttcttaaagaagatctagaaagtataaatcaggaagcaaagatgacagccaaaagtcttgaagtccaaagttggaggactcatacttcccaatttgaaacctattgcaaaactacagtatcaagacactgtggtcatggcatgaagatagatctataggtcaatggaataaaatggaaaatctatatataaacccttcctttaaggccaattgatttcccacaagggtgccaagataattcaatggagaaaaaaataatgtcttcaacaaatggttctgggacaactgaatatccacatgtgaaagaatgaaattagactcttaccggaaccctacacaaaagttgactaaaaatggatcatagacctaagtgtaaaaaagctataaaaccactagaagggaacacctgggtggctcagcagttgagtagagtctgcctttggcccagggagtgatcctggagttccgggatcgagtcccatatcaggctccctgcatggagcctgcttctccctttgcctatgtctctgcctctctctctctctatgtctctcatgaatagataaataaaatcttaaaaacaacaacaacaacaacaacactagaagaacacatagtagtaaatcttagtgaatttgggttaggcagtggtctctgagatacaatccctaaaagacaagtgataaaataaatttgaaaaattgcacttcatcaaaattaaaaacttgtagagaaaactatgccatcaagaaagtaaaagagatctcatacaatgggagaatatattgattgagggtgataaagataagccctccaacagaacaagagatgcaaatactggcagtcaagaaagcaggccctgtaatattaaggcgtgaaagtagggcaccaacagtatctgctacaaagtcccagactctcttcagtagaattaggcaggcccagggcacctgggttgttaggcatccaccttcagtttaggtcataatctctgtatcctgggattgagcctctgtatcaggctttctgctcagcagggagcctatttctccctctccctctaccttctgctccacctgcttgtgctctctctctctctgtcaagttaagtaaataaaatcttttttaaaaaaaggagaagagggacatctgggtggctcagcggttgagcatctaactgcctttgattcagggcttgatcccggagtcccaggatggagtcccacaatgggctccctgcatggagcctgcttctccctctgcctatgtctctgcctctccctctgtgtctctcatgaataaatgaataaaatcttaaaaaataataaaataaaaaaggaaaagaattaggttgtcccgggtcttagcttgagcttcccccagaagtatacataagctgaggcaaaagactcatgagctgttactttattagggcaagcagttccaagatacaagggcagaaaaggagaagcaaagcagaggagagagaaccagtatgaaaatgcattgtggattttgggccattattaaatgccattgattgcttgatctcttgggatagttcttacgaagccttgaaaaccccttggacttttgcactcgaagacccaaaaagcacctgaatacaatttttttaaaataaatttattttttattgttcaatttgccaacatacagaataacacccagtgctcatcctgtcaagtgcccccctcagtgcccgtcacccattcacccccaccccccgccctcctccccttccaccacccctagttcgtttcccagagttaggagtctttatgttatgtctccctttctgatatttcccacacatttcttctcccttcccttatattccctttcactattatttatattcctcaaatgaatgagaccatataatgtttgtccttctctgattgacttacttcactcagcataataccctccagttccatccatgttgaagcaaatggtgggtatttgtcatttctaatggctgagtaatattccattgtatacataaaccacatcgtctttatccattcatctttcgttggacaccgaggctccttccacagtttggctattgtggccattgctgctataaacatcggggtgcaggtgtcccggcatttcattgcatctgtatctggggtaaatccccaacagtgcaattgctgggtcgtagggcaggtctatttttttttttttttttggcaggtctatttttaactctttgaggaacctccacacagttttccagagtggctgcaccagttcacattcccaccaacagtgtaagagggttcccttttctccgcatcctctccaacatttgtggtttcctgccttgttaattttccccattctcactggtgtgaggtggtatctcattgtggttttgatttgtatttccctgatggtaagtgatgcagagcattttctcatgtgcatcttggccatgtctatgtcttcctctgtgagatttctcttcatgtcttttgcccatttcatgattggattgtttgtttctttggtgttgagtttaataagttctttatagatattggaaactagccctttatctgatacatcatttgcaaatatcttctcccattctgtaggttgtcttttagttttgttgactgtatcctttgctgtgcaaaagcttcttatcttgatgaagtcccaatagttcatctttgcttttgtttcttttgccttcgtggatgtatcttgcaagaagttactgtggctgagttcaaaaaggatgaaagatctaaatgtgagaaaagattccatcaaaatcctagaggagaacacaggcaacaccctttttgaatacaatttttaaatgactgattgcttttcccccacaggtcgttagttgatatctgtaaattaagactcttctacacctcatacctcaggctccctttaatcaacatccaaaacataattgatggtaatggatagcagggataattgaaatccaaagaataatagctaccatttagtaagtacaaggcagttttatataatgtctaatcctcacaaagtagcttttgttatactgattttattaatgtccaagctgaaattcagctaatttaaggaactcggccaacatcacaaaactaataagtagcagaccaggttttggaaccatatcttctttttttttcttttttaaatctcaaaacaatgctctttctattacaccagggtgcctcttagaagaaaggattgagattcctaaatctcttcttagccaatactttttaaacatgttatttattttttaagtaggccatataaacacatggtttaagattcaagaaatagaaaaggatataaagtgaaaactattttttccctgcccataagttacccagttcctcttttcaggggcaactaatgttacaagagctttgtgcatcttctccaaaatatttatgcataaatataattgtttacccttttaacaaaaagaggttatctaccaaatgtatactgttgctagatatcttagagtattaaaaaaacaaatggctataagattttaggctttgtgtgtagaagaatatggaaaaagcacttttccaagatggaagtttctgatgaattctgttcaaactataatttattatcatttggcatgtctgttacccttgctcaacatagtttttgtttaccatatctttttcagtgaagagccagatagtaaatattttaggctctgatctctgtcatgaccactcaactctgctgttatagcataagaacagtcattgacagtatgtaaacaaatggacaaatgggtgggttctttttttaaatattttatttatttattcatgacagacacacacacagagagagagagagagaggcagagggagaagcaggctccatgcagggagcccgatgtgggacccgatcccaggtctccaggatcacgccctggccctggcccgaaggcaggcgctaaaccattgagccacctagggatccccaatgggtggattctaataaaaccttattcacaaaaacatgtgacaggccagatttaacctgtaggtcagtttgctgtctaggggggaactttttattttttattgtttttaaagattttatttatttattcatgagagacagaaaaagagagagagagagagaggcagagacacaggcagagggagaagcaggctccatcagggaccctggcgtgggactggatcccgggtctccaggatcatgccctgggccaaaggcagcactaaaccgctgagccacccggggctgcccctaggggaaacttttaaactagaaaaatatagcacaccagcatcatttgggtataccagaatgattaaataaacccctgatttgtactgtttgtcaatttctatagtgtaaatactcctaaaaaatggctgagttcaatctaccaactgtttagcaataggattgcaaaatttctaaatatttaagaattggttctcatgatctgatgagaggcagttacagcgcagcactacatgcaaaacctcacacctgtagaatagcaaaaatcaacaacataagaatcaacaggctgttggtgaggatgtggaaaaaggggaactctcttgcactgttggtaggaatgcaaattgttgcagccactctggaaaacagtatgggggttcctcaaaaagttgaaaatagaactaccctgtgatccagcaattgtgctactaggtatttacccacaggatacaaaaatactaaatcaaagggattcatagtagcatcatcgatatttatagtagcatcatctacaatagccaaattatgaaacttgcccaagtgtccattgaatgatgaatagataaaaaagataggggtgtgtgtgtgtgtgtgtgtgtgtatatatatatatatatatatatatatatatatacacacatgtgtatacacacacacatatataatggaatattattcagccataaaaaataatgaaatcttgccatttgcaacgaaatgaatagagctaaagagtacaattctaagtaaaataagtcactcagagaaatacaaataccgcataatttactcacatgtggaatttaagaaacaaaaaataggggaatgagcatgggggaaaaaagaatgagagaccaagaaacaggctcttaactatagagaacaaactgatggttatcagaggggaggtgggtcagggatgagtgaaataggtgaaataggtgatggagattaaaaagtacacttatcataaagagcactaagtaatgtatagaattgttggatcactctattgcatacctgaaactaagaatataacactgtgtattaactatgttggaattaaaaattaataaaagataagtatactattcgtatactttttccattcacatgttctttatccattcatcaatcagtggacacttaggctgctaccataatttggctgttgtaaataatactgcaataaatataggggtgcatgtattcctttgaattagtatttttgtatgctttgggtaaatactcaaagtagcgtgattactggattgtggggtagtttccatttttaatttttaaggaacctccatactgttttccagagtggctgcaccagtttatattcccaccaacagtgcaagagggttcctttttctctacatccttgccaacatctgtttcctgtgttttttattttagccattctgacatgtgtgaggttatatctcattgtagttttgatttgcatcttccctgatgatgagtgatgttgagcatcttttcatatacctgttggccatctggatgtcttccttggaaaaatgtctgttcttctacacatttttattctggattatatattttttatcttttgttttggtgtggaattctatcagttctttatatatttgaatactaaccctttatcagatatgtcatttgtagatatcttctcccattcagtaggttgccttttagttttgttggttgttttctttgctgtgcagaagctttttattttgatgtagtcccaatggtttatttttgcttttatttccctttcctcaggagacatatctaaaacatagttaatactgggatgcctgggtggcttagtggttgagcttatgcctttggctcaggtcatgattccagggtcctgggatcaagtcccacattggggttcctgcagggagcctgcttctcctgctgcctaggtctttgtttctctctgtgtgtctctcatgaataaataaataaaatctttttaaaaatttacaaatttcaaaattgaaaataaaatatagttactacaactgatgtcagaaaaattgcccgtgtgctcttctaggatacttatgattttaggtctcacatttaggcccttaatccactttgagtttattttcatgtatggtgtaggaaagtgatccagtttcattcttttgcatgttgctgtccagatttcccagcaccatttgttgaagagactatctttttcccattgcatattcttgcctcctttgttgaagattagttgaccatataaatgtgggtttatttttgggctttctgttctgtcctattgatctatgtgtctgtttagtgcagtgccatattgttttgattactgtagctttgtaatataactttgaagtctggaatgtgatacctctagttttgtttttctttttcaagattgctttggctatttgggtcttttgtggttccatacacattttaggattgtttgttctagttctgtgaaaaatgttagtattttgacaggattgcattaaatgtgtagatttcttagggtactgtggacattttaataatatttgttcttcagatccataagcatggaacatctttgtgtcaaacttcagtttatttcatcagtgttttatagttttcagagcacaggtcttttaccgtttgattaggtttattcctaggtattttattattttcggtgcaattgtaaatgggattgattccttaatttctctttctgctgctccattattggtgtgtagaagagtaacagatatctgtactttgttttttttttatcttgccactttactgaattcacttaccaattttagcaggtttttggtggagtcttgggttttctgtatagaatatcatgtcatttgcaaataatgaaagccttactttttccttaccaattcagatgccttttatttctttttgtggtctgattgctgtagtaggatttccagtattatgttgaataaaagtggggagagtgaacatccttgtcttgttcctgaccttagtggaagagctctcagtttttccccattgagaatgatattagctctggatttttcatatatgggctttattgtgttgaggtatgttccctctaaacctactttgttgagggtttttaatcatgaatgatgttgtactttgtcagaagctttttctgcatcttttgaaatgatcatatggtttttatcctttgccttattgatgtaatatatcacattattgatttgcaaatattgaaccactcttgcatcccaggaattaatcccaattgaatatggtgaatgagtttctaagtgtattgttgaatttgttttgccagtattttgtcgaggatttttgcatctatgttcatcagtggtatcaatatcagcctataattctctctctctctctctctctctttctctctctctctctcttttttttttttttttttttttttggtgtgcctttatctggtttttggattggggtaatcctggcctcatagaatgaatttggaagttttccttccttttctgttttttggaaaagttggagaaaaataaatttcaactcttcttcaaatgtttgatagaattcacctgtgtaacttgttgggcattttttggttactgattcaatttcattgggggtaatcagtcttttcaaattttctgtttcttcctgatctgttttgggaggttatatatttctaggaatttgctcattttttcttggttgtccattttgttggcatatgattttttgtaatattctcctataattgtttgtatttctgtgatgctgcttgttattttttctcttttgtttctgattctgtttgagtgctttctctctctctctctcttttttaaaaaagattttatttatttatttacctgagagagagagcaagagcacatgaatggggggaggaggagaagagggacaagtggattccatgctaagtgcagagcccaatgtagccccatgacccaaagatcataaccaagagttggatgcttaactgactgaaccacccaggtgctccactctctctctttttttgctgaatctgagtagaggtttatcaattttggtgaccctttcaaagaactaactcctggttttattaatctgttctattatttttttagtttctatatcacttatttctgctgtaatcttttgtttccttccttttgcctgggtttgagttgtgcttgttctttttctagttcatttaggtgtaagtttaggttgtttatgtgagatttttcttgcttcttgaggtaggcctctattgctataaacttccctcttagaaccatttttgctgtatccctaagattttggactgttgtatttttctttggtttccatgtaattttttacttcccctttgattttgtggttgatccattcattgtttagtagcatgttatttaacctacatgtatttgtagtctttccaggtttttttcccttgtggttggtttctggttttatagtttttggtcagaaaagatgcatggtatgactttgacttttttttaatttgttgaggcttcttttgtggcttattatgttttttttttctgctgttttaggatggaatcctctggatatgtctgttaaatccattggtccagtgtgtcattcaaagccactgtttccttgttgattttctatttggatgatctgcccgttgatgtaagtgcgtgttaaagtcccctactattattgtattttttttttatgtttgctattaacagtttttttttatgtttgctatttattttatgtttgctattaacaattttatgtatttgggtattcccatgttgggtgtataaatatttataattggtatatctgcttgttgaattgttgtctgtattatcatatagtgtccttctttgtttattgttacagtatttgttttaaggtctagtttgtctgatacaaatattgctacactagctttcttttgacctacatttgtgtgataaatgtttctctatcctctcactttcacctgcatgtgtctttaggtctgaagtgagtctcttgtaggtggtatgcagatgggtcttgttttttttaatccattccatcaccttatgtcttttgattagagcatttagtacttatatttaaaataattgttgatagatatgtatttattgccattttattatttactgccattgttttgtgtttgtttttgtggatattctctgctcctttattctcttgctctcttctcacaccataagttggctttctttagtgatacactttattttttgtgtgtctgttactggcttttgatttgtggttaggtttgtatataacatctacattaggtttgtatataacatctacatatagcagtctacgaagttgatggttgcttaagtttaaacccattctttactcctcccttcctcatatttacgtatatggtatcatacttcattttattttgtgagtcccttaactgatttttatagatatatagatatccttatttttacaacttttttgttttgtactttttaaaattatggtctttcctttctactcatagagtcctctttaacatttcctgtagggctggtttagtggtcatgagctcttttaacttttgtttgcctgggaagctatctttccttctattctgaatgatagccttgctggatagaatattctttgctgcagattttttccttttaagcactttgaatatatcatgcctctcctttctggactgcagtttctcttgaaaaatctgctgatagctttatggggtttcccttttatgcaactgttttgatgcttataaaattctttatcactgcatttcaactatgtgtctccatttggtccttttgggttgattttgttgggggatctctgtgcctcccagatctgaatttctgtttccttcccccaaatttgggaatttttcagctattatttcttcaaataaactttctaatcccttttctatctcttcctctcctggggtccctctaatgctaatgttattacacttgatggagtcactgagttccctaagcctcttctatttttgcatattttttttctttcaactgcttagcttgtttactttccattattctaggttgctgattcattcttctgcttcttccagtttgctgtttattccatgtagtgtattttgaatttcagttattgtgttcttcatctgtttggttcttttttctctgtgtgttaaggatttcattgatgtcccttactcttaagtccagtgagaattactttaaattctctatcagacatatgactaatctctttttcacgtaggtctctttctgtgattttgtcctgttttttcatttgggacatattcctctggatcctcattttgcctaactctctgtctgttcctatgtgttagaaagtcagctatgtctctgttcctgaaagtagtgggtggggccacattttttttaaagattttatttatttactcatgagagacagagagagagagagagagagagaggcagagacacaggtagaggagaagcaggctccatgcaagaagcctgacatgggactcgatccagggtctccaggatcacgccctgaactgaaggcagcgctaaaccactgagccacctaggctgccctggtgggccacatttttaacaaggtggccctcgtcttctttcacagaagacatgcagttgctgtggaaaactgaccacttgagctcctttgcaaagcatgtgcaggcaaggcttcagtgcctgcaaggtgtgcgtatctgtcctcttccatggggatgcatagtcactgtggagactgggccagctggggcagatctgcaaagcacacctgggcaggggctacagttttaacaaggtatgcacaccttctgtgggtgatgactacctttcgcagccaggactgagtccctgaaaatcacacaatgggaagatatagtcttggcaaggtttgcacagatcttctaggggaggggacttgcaacaccagaagtgaggcaagcccagctggagggggtggggcatgtataaacaaattaggtagtgaatgctggttcccacaggtggctgtgtgcttatgctgggttgtggaagacagaagtggcacctgctaactcctttgttctggagaagttcttcacttactctgagattagtaactatccctcctataagccctatgcgtttttcaaactgctgattctaagctgtaactccttgggctgtttgttgtgctgtctcttaagggcagggatttaacttcctattgccccctggattctcccagaactaagctaactggtttttttttttttttaatttttatttatttatgatagtcacagagagagagagaggcagagacacaggcagagggagaagcaggctccatgcaccgggagcccgacatgggaatcaatccagggtctcccggatcgggccctgggccaaaggcaggtgccaaaccgctgtgccacccagggatcccagctaactggtttttaaagctctagactttaagtcccattgactgtaaaaacttacagaatttggcccttctgattttcaaagccaaatgctatgggaattcatctttgctgtgcaggcaccctggtgtgatagtctgtttctcatcctttttcccactcaaggctctccccttccctccctccagtggccagacctgcagggtttacctccccaccaagtctctacccttcctaccctctcagatgtgacctcttgtctacatttaattgtggagtttattctgccattttggggtcatttcctgggttgtttacactgatgtgttatctcgtatttgtatgacaaggtgagtttagggtcatcctacttggtcttcttccatagttagttccttagttaggtaagatttttaagtcatgaatttatgttgaattttatcaaatgcttttctacatctgttgagatatttgtatggtttttcactttaatcagttaatgtagtaaattacattgctttctttttcttagtgaaatcaactttgtacttctgaaataaactcaacttagtcatgttagattttcctttttattcttgctttcttttatacttacttgatttgacttgttactattttgttaaggatttatgcagctatttgtgaatgatattgtcctagaattgtccttctttttactctttttataatgtcttcacttactgtcacactagctctgaaacattttggaattatttatttcttgaccattttgatagaacttgcctagtaaggggcacctgggtggctcagtggttgtctgcctttggctcaggtcatgatcctggggtcctgggatcaagtcctgcatctgcttctccctctgcctatgtctctgcctctctttctgtctctcatgaataaataaatgatatctgaaaaaaaaaaaaaaaaacgaaacaacttgcctagtaagtcatctgagactggagtttgtgaaaattttggacctctttatttctagtagtgctttttgccttaaagtttattatgtctcacaataatctactatattagctatcttttggttaaaatctgcatgatatattattttatcattcttttactttaaacttttctgtctaccttattttttggtatctttctttcaaagaaagtatcattagatttttagttttatctagtctggccatcttaccttttaactgaagtatttaatctacgttatcatttaatatcttatatatttagatttattttttttattttttattttttttaaatgctgttgtatttttttttaatttttatttatttatgatagtcacagagagagagagagagagaggcagagacacaggcagaaggagaagcaggctccatgcaccgggagcccgacgtgggattcgatcccgggtctctaggatcgcgccctgggccaaaggcaggcaccaaaccgctgcgccacccagggatccctatatttagatttaaatctattattctactttgtgatttctagttgtctaatttctttttctctcctttattgaattgttttggattaagtttttctgaataatcattctatattttaccctttacttagaagttaaagtaagttttttttttttttttttttttagtgattactagaaatttcaacatgcacattaactttaaaaagtcctaagctggtggggatccctgggtggctcaacgggttagcacctgccttcggcccagggcgtgattctggagtcccggaatcgagtcccacatcaggctccctgcatggagcctgcttctccctctgcctatgtctctgcctctctctctctatgtctttcatgaataaataaacaaaatcttaaaaactaaaaagaataaaaagtcctaagctgggatgcctgggtggctcagcagttgagcgtctgtcttcagctcagggcgtgatcccagggtccgggatcgagtccaacatcaggctcgttgcatggagcctgcttctccctctgcctgtgtctctgcctctctcgctctctgtctctcatgaataaataaataaattctttaaaaataataaaaattaaaattaaaaattaagaaataaaaataaaacaaaaagtcctaaactaatcaatacttttacctttggtataacataagaatacttcaagtccacttatcttcctctttatttctgctatttttgctgtgtatttttagttatgtcttttcaaattttattccataaatcattattttttacctatatttgtcaataaatttgtttcttcttttgtccatatcaggcaatatagactattcctttggttgataatctttatgagtccttttctgctgtcgtttctgctggttcttattcatgatgccttgtttcttgtatgcttgtttttttttgtttttactataaactgttccttttcttgaaaactatttggtgattctgtgaggacacagatgaagatgaattccttcaaagagtattaaatatacttctaccaagtgcctagagctctaccaataacaggaccacttactttaaaattgtagtttgaagtgttgggaatcaccacttgatattttaagaaatattttaaatgtttattaagcatttttaggtatgcctgggtggctcagcggttgggcatctgccttcagcttgggttgtaatcctgggatccaggatcgagtcccgcgttgagctccctgcgaggagcctgtttctccctctgcctgtgtctccgcttctctctctctcagtctgtgtctctcatgaataaataaataaatcttcaaaaaaagcatttttagatattggtaggatataggtattgtataactgagtgccgtattactgaaattgaaggcattgtttacattttcttctgagtttttttatttgtactaaaatatacataaaatttactgttttcataaaatgtacataacataaaatttaccattctcaccagtgactttacatatattcacaatgttatgcaaacatcagcatcatccatttctagaacttttctatcttgaaaattgaaactctgtccttgttttttgttgttgttgttttttttttaagttttatttatttatttatgataggcatagagagagagacaggcagagacacaggaggagggagaagcaggctccatgcaggaagcctgatgcagacctcaatcccgggactccaggactgcaccctgggccaaaggcaggcgctaaaccgctgagccacccagggatccccgaaactctgtccttgttaaagacaaattcctcattttgtttctcccagctcctgataattaccattctactttctgtccccatgattttatatactgtaggctcttcatatgaggggaatcatacactattcaccctttggggttgactttcttcatttagcttaatgccttcagatttcatccatgttgtagtatatgtccttataaaagttttatttatttatatttttaaaaagattttatgtatttatatactagagttagaaagagaggcagagacacaggcagagagagaagaagcaggcttctcatagggagctcgatgcaggactcaatcctgggatcccgggatcacgccctgagccaaaggcagatgcttaaccccctgagctacccaggtgtcccccttttaaaagttttaaagtgattttcttttcatagttagatacttaattcacctagattaatttgtgtctaggtgcagagtgtatatatctaaatttattacaatatgagtgtccatttgtcccaataccattgttgattattccatccttttcatattaatttgtaatgtcatctccgtcttctgtttaatattcatgtaaatgtaagcctttttctaagctgttttccctagttagtctgtttttctattttgtttttctattcttatatggagaaacagtatttgttattacagcttttaaagaactcttaatatctgataacacatcctccactcagcaggtctgagttttcttagcctcagttctggtcccagggagctctgcatagtcctgtaggtgagggttgagagagaatgcgggccaagaatgtaagccactttgcttgtgcggtcaggtcctgttgggttcagttctgatggttgtttctacttgattgctggagatgccaaagctatagatatataaatcagaaagtacccacttcatggcacttcctagactgagtcatcagttgtggtccattgacctccataaagcctaatagcttcctcaagagttgaaacatttgacatatccattcagtaaatattcattgagtacctactatattgtggctgtggtaacaatccatatagtctctgttctcatgatatttatattctagtttattaaaaggaaactagttattttttgctgagtacagtgctttactaaaaaatgcgaagggccttctacatgattattaatgaaatttcatcctttattggtctttattctctatatttcaaatagttccaaagacatggtaatttgaaaaacgcttgattgctggtgatgaaatctttgaccagagttccatgttttaatgtgtacagcattcactggctaaaaatttatggatatctgtgtaattgaggccagatttatgacacgcaacaaaatctacaggagtgacaaaggctgccaccaaaacttcacactctgaacatgcccaccacccctgcatccttcctaaaaatatctcacccagagaatgcgcctctttactctctcagtctgtaaaatgtgatggttaaaaaaaataaatttagcaaacggtgttattaatactagccttttatgaaaactagtcacacaaaaaaagtaattgaaaattgcccttttgaatagatgcattctggctcagggagaaaggactggcaagaatttctttgaattcaaatttaaattatttcccttcattggggcccctgggtggctcagttggttaagtgttcaacttctgatttcagctcaggtcatgatctcagggccatgggatcaagccccgtgttgggatctgtgctcagcagagtctgcttgagattctctacctctccctctgcccttcttcatgctcatgctctctaaataaataaataaataaagttaaaaaaaaatgatttcccttgatggagaaccaaagagatatcacaacaaactgaatgactccgttgttcatcttaaatgctgataggtgacttacaaagttgacttaactggaaggcagaactacacatttctgtacaagattggtgtgattaatatttattatggaaactattatttcagttcttacatgtcatagaaattacagtattcatggtaaaggaatcattattaatcatctttcttttctaaaacaattcttgacaaatatgtctctgagattctaaaagacacagacaaaaaaatcagaacattttaacccaaaaatgacataaatgacttaccttcttgccaggtaatgtttatcagaatgtttaccaaaatgaggctgcagtcattgtttctgtcagcaactttgcaatattttgtgtatatcttataagggattgacctgccataatttagaaattaaaatactattgctatttttttctttttttaaaagttatttgagggagaaaaagtgagcaagtgagagagcatgagcagggcagggggagagggagaagcagactttctactgcgcagggaaccctacttggggcttgatcccagaatgctgggatcatgacctgagctgaaggcaaatggttaactaacttagccacttaggtgccccttgctatttatttctatatctttatgtggttatgggttctcaaaatccacacaaaagagagaaatggcctagataaggggtgcttatctggctcttttggtagaacgtgcgactcttgatcttggggttgtaagtttgagccccatgttgggtgtagagattacttaaaatgaaattgtaaaaaaaaaaacagccccccccaaaaaacaaacaaagaaatggcctggattctaaacctgacatttgttgttggcttcctttaaatcacttgtgtccaaatttttctttaaagattttgtttatttattcatgagagacagagaaagagacagagacatagacagagggagaagcaggcaccatgcagggagcccgatgtggaactccatcccggaaccctgggatcacgtctgagccgaaggcaaatgctcaaccactgagccacccaagtgtcccacacttgtgtccaaatttgataaaacctgtagcctgataaaacaaacgggaaactctttttccttgatattaaattaacaaccactttttaaaaagattttatttgtttgagagacagtgagagatagcactagtggagtaggggcagagggaaaggaagaagcagattctcatgctgagcagagagcccagtgcggggctcaatcctaggactccaggatcatgacctgagccaaaggcgaacacttaaccgactgagccacccaggtgcccttgaagaaccatttttaatattaaaacaaaaatgaatttattgaatagattaaaattggcatgaactttaattgctaccctggttgcttcaggcatattgcttcaggcagctaatggtgaactattcaaatattcccggaaaagcctgagagtgtgaatgagagtcacctctgcctcagtgtattatcacaacaagttatgtaatttaccatcatgtttctcttttagttttcccatcagaataaacaagcacaccctgtttcatttattccacaactgtctatctattagtacctagtatgttcaaggctctgtgctagattctgtgaatataatggtgaataactgaaacagatcagagtgttcagaggtaagactatcacattttatataactaaaatttatctcatattttcttgtgaaaattaaataggaaggtctgtgtcatctgggacatagtagttgcccaaaacatgagtgcctcagagataacataaactatatgtaatcagcaaatcttgattagaccttaattaaaaaacaaacagctataaaggatatcattgggacagttttggacgtttggatttcaacttcatatgaaatattaaagcattattgttcattttcttcagtgtggcaatgacagcaggattatgaaagagatatccttgatattaaatgatgcttgaagaggtatttggtgtgaagcatcataatatctgcaacttagtttcagtgtttcagaaataaatagttatatagagaagaatgttaacaatggttaaatgttgttggtggtttgtaggtgcccatggtactgttctttcaacttctgaatgtttgaaaacctctagcataaaaagttgtgtaaaacttttaatttctttttttcttccttgttaagaataatttatgattatgcagttccctcagaaggaatctagccccaaaaatatgagttagaaattggagaccatacaaatttaagaccatttcagaacagattttactgtttttctttgaaatctaagttgcatcaatcaaaggtaaactcagatctgaggcagcactcttcccgaactttgtcacaatgatttaacttctgtttgcctgaactctcttttaccttgtacattcacctttgccagaggaattgtgtcttcacagtcaccagcaaagtactctcactcagtccacacaaacttttgcattatagcacaccaggatctggggaagtatggtaccaagatgatcagaagatgcagtttcacttggtgagtttacagttttattggaaagttcaacatgatgaagctgaagaacacactcagaacaatttcaaaagcacaaattaaaatagcacagttccaaaagggggttataaagaggaagaagctgttgctcacatcagcttggaaagaaagctatcacaataatctagatggatatccatggatttcagaccttcccatagattaatttttttttctgagtccacgtaaattcagggcaccaccactgggactttctgatgctactcacagttccaacccaggcattctttttcctaaagctgaagccagggagtgaccttacatatctaatcagagataaattgttttttgaccctggttttcatcaagtccacagagccccaaagagtaaaaaatgagtctagtatgctgaatatatattgtttactgcaatataacacattattaggtaatcatgacattgatggtccttagagttggacatagaagggtgtcattgattttctcaagcaatgccagagaaaatgatagatcccctaaaaaagtgatggtagggaaaaatgagctcaatttataatagacactaagaacttctgcagattctatgacagattcattaataatatttatcctgtctgacagagactattaaaattctgatatatttgctcaggtgacttctgctaatacaaaatatatcaacttgatattttgcggaagactgaagattcattaaggaaaaatgtagaaaagtgtttctttttacctctaggtggtgctatgtattgttatatgtaagcacaagactgcctagttttgaagttgtaaagattcctaaggattatgcattttacagatgaacaaactgagactcgttgaaattttgtgctgtttaaaataaaaattctggttagaggcagagccaggactatggcctctttttgtaaaatgtttaatgtatgatttattcaagaaaaaattagtcattctataattatttcaacagtattacactgttgtaacaggtttaagagttcattttacttttactgatttatgaagttttctttagaaaattttaaaagaacatttgcctaacttatatgaaaatagattataaagaaagatgataggattttattatgcatacatcaaaattactttactaaagaggaactcatgtttaaagaggtaattcatttaaaaagaaacacaaattgttgatagttatgtgaaaacatattaaaacccactaataatcgaatcataactaaaacagtggtattcctattccttccagatcagcaaaaatctatgattatcctcagagatactgaagcaatgataaaataagcaccttgccctctgtcagtgggagcataaattggtacagcttcctctgaaagctaatttgacagatgttatcaggaaacttcaattgtgggacaccagtggctcagcagttgagcatctgcctttggctcagggcgtgatcctggagtcctgggattgggtcccacattgggctccctgcatggaacctgcttctccctctgcctgtgtctctgcctctctctctctctctctgtgtatctctcataaataaataaataaaatgtttaaaaaaaaaaaaaaggaagcttcaattgttcaaactctgacatagttcagcctctaggcccttctctgtgggaataatcagaaatgtggacagtgatttatatacaaagatattgatcacagcataatttataatacttataatcattttataaattagggtatggttatgatatcgggcagccatttatagactgcttgcaaataattttaaatgacataagaaaatgttaatattttgctgaattagagaggagattaaaatctataaacctggggctacctcagttatataactgtagatcatctgagattggagattctctgtctccctcttcgcttccttgtactggtagtcatatgaggaaaccctacaatattatttcccagaggcagaataattatgtctgatttgctttcccttttaacttttttttttaaagattttatttatttattcatgagagacacagagagaaagaggcagagatatagacaaagggagaggcagtctccatgcagggaacctgatgtgggagttgattctgggactccaggatcacgctgggagccaaaggcagatgctcaactgctgagccacccaggtgtccccccttttaaactctttaattaagattgagaaaatttctaaaccctaaagtctaaagttcattttagacaggactgaataatcatgtctaaacacacctccctgaatatatgttgtccacttttcttcaagattttccttctcctttctttattgtattctatggtttttgttgactcaatttttaaaaaagattttatttatttactcatgagacacacagagtaaaggcagagacacaggcagaagcaggctccatgcatggagcccaacgtgggacttgatcccgggtctccaggatcacaccctgggctgaaggcggcactaaacccctgagccacccagggatcccctgttgactcaatttttaaaatctgtttttgtgcattgtaattcaaattaagttttctaactaacataaagttcacacattcagatgtcttgctagatgctccttagttcattcttgaattaattactgaaaggtgctcggtttgattgaaagctgcttgctagctcccggtccccaacttaaaactattcattcttgttctaggaaaaactattggcccatctgaaacttcgctttgtagttcaaattgtcttgtaatgatgcaactcataaaaagcatattcaatgttatacagtgaaaaaaagtctagaattaaacggcaagagaccttcactttttcctggggattggttagcaggacattaaggaatgaatggtttaacatttccatctggcactaattatatgtgatctttggcaagttatttatcctcagtttttttgcctataaaattaaggtggtagcctgatgacctatgactcatgacctgcctgccataggagcagaatatttgaaattgtgctgacattggaaaatctggggcatgtggctcctatgcatttaagatcccttctgattttttttttaagatttttatttatttattcatgagagacacagagagagagagagaggcagagacacaggcagagggagaagcaggctccgtgcagggagcctgacatgggactcgatcccaggtctccaggatcaggcctgggctgaaggcggcactagactgctgaaccaccagggctgcccaatcccttctgattttgaaatgcttttctgctcacagtgtccttccaacagcatcttcagcaaggaacctcctggactcttgtctcttaagcttgatcccagatcccatagtttagaggcactgctggctactattttcttagttactcaggtaaggcagtgcttaagtattggagccacaggcaaagaagctgctaccaaactcctaaaataaggccttgtgtgagccccaggcatggacacatctggaagagtacaactatatgcacagatgtttgtacatcctttttttgcacagggaaatgttaacagaaactctggtgtgtaacaaatccctaatcctctccatctagggcctgccttaacgtagatagaaaataaatagctggctacttattatacaagtcatgatttgaggggataccagagagggtgcttcatccaaaaatacccattccactgagtgttagtccaatgttactgagtttacctttggctcttgaaagctaccacaggggatccctgggtggctcaatggtttagcgcctgcctttggcccagggcatgatcctggagtcccgggatcgagtcccgcatctggcttcctgcatggagcctgcttctccctctgcctgtgtctctgcctctctctgtctctgtatctttcatgaataaataaataaaatattaaaaaaaaagctatcacaaatgctttaaaaacatacctctcaaaaaatggaaagatatctaaccttgggaggacaaggaatacccattaaggttatagtaggtcaagttcaaactaaaacaccatgaatgatacatttgcatcttcccatttcacattctctttattcattcctatgttatcaagtgtactatgctttaatgttaagtcacaggggtccctgggtagctcagattcttggtttcagtttaggtcatgatctcagagttgtgagatcaagctccaagtagggctctgtgctgggcttctgcttaagattctgtctcttcctctgccccctacccttgctcagtgcacactcgggcatgctctgtctctctcaaaaaaataagtcatctctcaatttgtctattcacacttgaattgttgaaaaatagatttcaagttaagatttactttattttcaaaattattttttaaaagattatttatttattcatgagagacacacagaggcagagacataggcagagggagaagcaggctccctgtggggaccccgacgtgggccttgatcccaggaccctgggaccatgacccaagccaagggtagacgctcaatcctgaaccacccaggcgcccctgaaattattttttttatctgtatcatattccattttttggccatcagtgtttgtaggaaaaaatacttatttctgggtgccttgttaaacaactacatttaaaggaataataatgaaataaggtttttaaataagagattatgaaaatgtgttaagtataggagatatttctgtgccttggcattgtaaactgtaagcaatgaacaggctttattttctctcagagttcttagagctattcatagtttataaacaaagtgatggttttccttatatcataatcatttaaaacttagcttatattaattagtgatgaagacaaaagtaaattctaagaaaacagcattctcagcattgcagatggatagtatagcatgactttagccagagcttgtaagatttacagtgtacttgacccattttgttgacatttttgtgatttctcttccttctacacattaaaagtattctctgaagttttagatacttatccatttgttcaacaaattatatgttgaatgctcactgtattctgggcactatgcttgtgactgaaactacaaagatgattaagacaaagctctcagtgggagacaaagataattgcaatgtaaagatgcacaaacagaaatatgtttgaagtttcaagaggtctcatgggagggagctcctggttctacctgggaatgtcaaggaagacctgcctgaagaggggatgattactggagaaagatacaattgccatcgagagagatagacagagagagagagagagagagaaaggtagatgtatgtaggaagtgcctggctgagctgcagggcacttagccagcctgagagattctaggaagctgcttggagatggaccactaaaggttggaggaaagatatggagtaggagagtcttcctaaaagacagagatgttggcttaacttgttcagagaatggcaagtattcataaaggtcaggagacaggattcatgagggagttggtgagggaggatgagggtgatgcaccatgctgaacatttagcaatttattagctcatttaatactcatctaactccatgaaatagttagcattttctccattttgtagaggaggacatttataacagaggacatgtccacaaattttttgatactcttccctttaagatgtataccctaattcctctccccttgattgtgggctagttaatgacttgtttccacttaataaaatatggcaagaagtgatgatttgtgacttttgagactaggtcataaagcattatggcctccttgttgtctcccagatcattcactctggaggaagccagctgccatatgatgaggacacttaagcaaccctgtggagaggcccatatgtcaagaaagtgagccctcttgccagtagtcgttaaggagctgtagcctcctgctatcttccatgtgtgggagccattcagaaaaaagatctagccccagtcatgttttgaggtgatttattatgatttattatgcaacacgagataactaatacagacaaggagtcatcaacatattaaaggtcacataactcataaattacaaatttgaaatttgaacccagaatttgaaattcaaactccagagttgttgcacctaacctatttactatcctgccttgaaacgaaggcggggacctgtctttagagatccagtgcttatatgacacggacacacatgcattcatatatatgcacacactcatttttcctctctgtttctttttcttttatgactctatcttgatagtaataggaaaccactgaaaacaactgggttttagaaagaccctgtggtgtagaggcctaattataagagggcacaactgcagttagaagaatagggtcaggtaatgaaagtaatccagacagggaatggccaggtcttagactaaggcatgagacagaaagggtgtggcaggttcaagaaatgtttagtgggtagagttgaggcactcctctcggtggctgactggatgtctgtggtgctggcctgtgagagggcaggaaggggaagtggagggactttcagaactgagtcagtcatggtgccacagtaggtaggttagggaggggatgttggtggctggtgggagagtaggagaggatcataatgagttctgccttggatatggtgcattgagatgtatctgcacttgagaggtatctgcactggaccagcactactgaggaggtctgagttgaagtggggatttgggggtcaccagcctgcctttagaggatgctgaagtgacagcacagctgactgcactgtgagagagtgtgtgcagtgaggggaagagagcaattactaaggggagagaagaaaggagaaccaagggaaaagatgggcatctgaagagccaaggagaaagggagtaccattaaggtgtcaaatacagccttgttttctgacacttgccactttatatgtctgtggaatgtggccagtgacttctaggcctgctatttgaaagagccccctgctgagaagcttctgcattgtgccctgaggcacatccgaaggctcccagtgaaccttatatgtgcacctggtcttagctcctctacttactgaactcgtttagtttcaacatttatgcagagttaagcatccagtaggcacatactaagtgactgttgggttagtaaatgcttattatacatacaaggcactgggtagagcaaggctttactctttgcatatgtagaagtaataatagaagacctcttgatgagtcccattgactcagataagtagctgcatgcagattttaatgaggatttgatgtgtcctgtagagatacaaaattttatttctctttatttctttgtcattaatgttaattaacaacaataaaaaaagagtcaaagacctgggattccaaaacttttcctgatattttaagattgagtttacagatgcagtttggaaagttaatatggattaagctgagattttttaaaagggcttctttaataacataaaattctttcacctccagctgttctaatggtaacttcctgtccatctgggagtcattatttttaaacgttgtgtttgagttaaatgaaataatgtcagtgcttacacttttttagtaattagatatagtgattattgttctcttttaaaattatgcttggattttcaattaagaaaatagtaagtccataatatagtttcaaaagtccaaaaacttttacagactaaaaaatagtgaatttaaaaaattaaatcctgtggctttcatattaaaggcaaacaaaagtttcccacatatttaaatgattaagacagaaaactttaaccaagctatcaatgctgtagctcttttttttttttaaagattttatttatttattcatgagagacacagagagagagagagagagagaggcagagacacaggcagaaggaggagcaggctccatgcagggagcccgacgcaggattggagcctgatgcaggactcatccatccccaggcctccaggatcacgccccaggccgaaggcaggcgctgaaccgctgagccaaccagggaccccccatgtagctctttatagtatgaaagttctgctataaatctgctggatttattaacggaggatgttcatttatttagtagggcattaaatcctataacataatgctgcttactaagggcttgttttggtttttttgtttgtttgtttgtttgtttgtttgttttaaaactctccaaaagtaaaaagaccaggaagagaaaagagttcagtgggttcatctggaagaaccttccatcccatccaccaacctaaaccttcttacccttaactcctgcactattcctttgtctctgagccctgcccttctcccggtccttcccacctgccttgaatcatgtgctctgatgctgggcgctgaggctttcattctctcattttaagttttttatagttatttcataagtaattagaataggttggtctctacaatttacctttcttttaggctttatctccatttcccacagtggcttaaccagtgatgatcactgaacatcctgtaactagtactgtgatggttagtttttgtgtcactttggccaggctatggcatccagttaagagataaatcaatagaagatgtagttttcctcctaggacttaattaggatcaattctggataggaaacacataccctaataatgcctgactaaatcattttgatgggcctgtcttctctaatatgctttcctaatctaagttttcctctttgccctgggcacagtcagtgggcaagacagaccctatatcttaagttctatgaataagagcttttttgaattgagctaggcttgggaattaaaaccagatatgcttttcagttaattaatttcataacataagagaaaactaagagcttgagtttttaaaaaagttaatgagaagatattgaagtcactgggaacaagcttttctcaaatatgtttccttcagcttaatacattttctaaaaaattaattaagcgaggggtacctgagtggctctgttggttaagcgttggactcttaatggtcatgatcatcatgatcatgactcatcaggtcatgatctcaggatggtgaaattgagtcccacatagagcccataggctcagtggggagtctgcttaagatactctttctctttgggatgcctgggtccctcagtggttgagcatctgcctttgactagagcatgatcctggggtcctgggatggagtcctgcatcgggctccccgcagggagcctgcttccccctctgcctatgtctccgccttttctctatgtatctcatgaataaataaataaaatctttaaaaaaaagtctctctctccgattaaataattaaatttaaagattaatttaaatttaaatattaaataaatctttaaaaaaacaaaagacaaaccaaaactaattaaactagatttagcccatagcaaccttagccttttcttttttctttccttccttccctttttttaaacagagggagacatttgattaaattactgaaaatattcactgaaattcactgaaaatattattcaatggggaaaacccattagatatataaagacagataacattagatagctaattaggaacaaagaattgcataatgtagtacagatagctaagaagaaactctttgttttgaaatacatttttatgcaatgtcatatggtctagttaaaatcactgtcgtggaccttttggtccaaaaatggaagtcctatagtgtatcatttaatgtcttcactttggctgactcactgtcttggcattgtttctgctgcagatatatatagagatggttcatgtcatactttagaagaatgtttttggacaatagagcataaagaacacagttcaggagacttctgaattattagatttttttgaaatagagtttatttaaaggaatatttcatgagcaatgcaaataatttagtttttataaaacaggacaaatattaaattagaatttgatgggggtggggagagttgtgtatgtttatgtgattaacagctgatctccagtcaaaaatccccaagtagtagatattacttctgtaaaaaagaaagctttttttctgttttacttagaaaatttaatgaatcaaattattgccattaaaaaaaactatcattctcatttagaaaccaactaattgtggggcctataatcaagtcagaaagttaataatacagtttattaagacaaatggctaacttaccaattcagtcaataccccttgcttgggaaacccaaatggccctgggaccaaggaagatctccaaaactaaatgtaaaacatctctgatgaaacaaatgttgttgccagacacatttctacaatattttccattattgaccgtacaggaggtgagatgtgatgcaaacgaaagcacttattctctgttattgagagcaacacaggcttctttgggacattttgacaaaggacagagacatacttctttctcactgggtaaagggaatgaatcgtttccttccaaatgagtctgtaccagctgaatgcagaaagcagtcatgtgccagggatgagttctggcctttggcttcctgcttcttccaagtggttttccacctcttaatgtacctaaatggaattcggagaggctgccccctacttcctcccaaagagacagctcctccagtgagtcacacagacacacactctgaggtctcaggcattttctctgctaagcacagacaggattgcattgtaccaacatcccacattgcctacagcttcagcagcctcctccactttctcagagtgtcacagcctagtgctgtagccctgaggaaccagggcatgtgtctggggatcctacagaataggagggaaaatgggtaattgatgcccatttcagatcaagagcaacaggtattttgctgaggctgagcgtataggggggatggaagtgtgtggggtctggatggggtagactggtggagatagtaaatgtctaagatttgggttgcctgcaacagtatgtcaagccttaggtattgctttctaaatcaccactaataatttcttttccattctcccacgagacctcaagtctggtcattaaattttctaactttgagaagattatgaatgtaaagctcaacaactgttggattttatttaccaggatacagttagatgattggattaattgttggtgactttgccagtaactgtgactcctgtgggattgttacttctgaaatgctaatttctttaaatttctaatattactgctgatgtgtgttaaaaattactctgaaaaattatcctaaattttaaaattttaacttaaataatttaaaaattattttgttcgggatccctgggtggctcaggtctaaacaggtttagagcctgcctttggcccaggacgtgatcctggagtcccgggatcaagtcccacatccctgcatggagcctgcttctctccctctgcctgtgtctctacctgtctctctttctctgtgtctcccatgaataaataaataaacaaaatcttttaaaaaatttatttattcatttgtatattttaatttttacaaaagattttatttatttatttgagggagaaagcacaagcagggtgagaagagggagaaggactctctggtgagcagagagccagatgcaggacttgatccctggactctgggatcgtgacctaaactgaaggcagatgctcaactgaatgagccacccaggcatccctcatttatttttttaaggatttatttatttgagagagcttgagcaaggggaggggcagagggagagagagacagagagatagagagaagcagactccctgatgagcagggagcctaatgcagggcctcagtcctaggactcctagatcatgacctgagctgaaatcaagagctagatgttcaaccaactgagccacccaggtactccaagatttatttttattaaaacagtaaagaagactttatccaagactcttgtaataagagcattacatcttaaaaaacaaaaacaaaaaaacaaaaaaccccacagagggcagcccgggtggctcagccctgatcctgggtatggggcatccagtcccatgtcaggctccctgcatggagcctacttctccctttgcctgtgtctctgcctctctgtgtgtctctcatgaataaataaatacaaaatcttaaaaaaaaaaaaaaaaaacattgcagtaggggagagagatggtactcaactccaaatacagtgaagagctggagattaacagccaactaacaaagagaaggggtcagtggataggaaattaccatgaggagacatttgaggatgggggaatttgccaaaccagcttaacaggattcttgccaaaggcaggactaggacacatataaaaggtagcagatgaggaaattgattccagcaaggatgaaggccaaggctgaggcctagtcaagtaaaggtctcagaggagcctgactgaagttcggtcaaggagaatctttgtcatctgtactaaatctggttgttcactgcagaaagaggaatggagagtacagttaatcagagagaggaggaaaagcccttctcagccttgtgattgggaagtcattcacacagggttgccatgtgagggcccagtgcatttcttctgaagggtggccacaaatgctgccagagtaccagcagcatcaacagttgggccagccagagcttacaggccttctgctcactgtggcccaccgcaccaggtccagccaaacaaattgctattaaactagatctaaggattatatttgtgtatggtgtaagaaagtaatttagttcttttgcaatgtagctgtccagtagctggatcactctcttacattttattttttaagattttatttatttattcatgagagacacagagagagaggcagagacacaggtagagggagaagcagcctccatgcagggagccagatgtgggactcgattccgggtctccaggatccaccctgggctgaagtcggcgctaaactgctgagccacgcgggctgcccactctcttacattatacacaaaaataaactcaaaatagattggagacctgaagccataaaactcctagaagaaaacataggcagtaatttctttggcattggccatagataaattttttttatgtctcctcaatcaaaggaaacaaaagcaaaattgaactattgggagtacaccaaaataaaaagcttttgcacagcagaggaaatcattgacaaaaagggagtgtactaaatgggagaggatatttgcaaatgatatatccaataaggggttaatgtctaaaatatttaaagaagctgtacaactcaacaccaaaaaaaaaaaaaaacaaatagtctgattaaaaatgggcagaggacctgaatagatatttttcagagaaagacatccagatggctaaaagacacatgaaacataatcagggaaatgcaaatcacgaccacagtgaccatgactttacaactatcagaatggctagaatcaagacaagaaataacaaatttagcaaagatatggagaaaaaggaaccttttgtattgttggtgggaagtaaattggtacagccactatggaaaacactatgaaagtttctcaaaaaattaaaaatagaattaccctatgatccactaattacattccagggtatttgcacccccagaaaacgaaaacactaatttgaaaagatatatgcacccatatgttcattgtagtattacttacaatagtcaagatatggaagcaacctttgtccatcgaaagatggatggttaatgaagatgtggtatatgcatatatatacatatacatacatataatggagtattacttaaacataaaaaagaatgagaccttaccactttaaacaatttttttttcattttaactctttcattttaactcatttagtggcatgaaagtacattcacattcacactgtccatttgcagaacttttccatcatcccagaatgaaactttatacccataaatacaaactcccaattgccccctccccttcgtccctggaaactattgttttactttctgtctttctgaatttgactactctaggcatttcatacaggtggaatcatacatttgtccttttaggacaggcttgtttcagttagcataatgtcttcaagattcatccatgtgatagcatgtgtcaaaatttccttcctctttagggctgagtaatatcccattatatgtgtataccatattttgtttatacattcatctgttaaatgacacttgagttacttccagcttttggcttttgtgaataatgctgctgtgaacacacatataaaaatatgtttgagttcctgcttttaattcttttggatatatactagaagtggaattcctgaatcatttggtaattatatttttaatttcttgaggaaccatcatactgttttcagctgtgtctgtaccattttacattcccaccagcgatgcacaagagttccaatttctccatatcctcaacatttctctcttctttccctccctccctctctcccttccttccttcctttccttccttctttcctttcctttccttttccttccttccttcctttttcttttcttttcttttcttttcttttcttttcttttcttttcttttcttttcttttcttcttttctttctttctttctttctttctttctttcttcactttctttcatttttctttctttctttcttttctttctccctctcctttgctttcttattttctcttctcttttctttcttttatagtagccatcctgatggatgtgaagtgctatctcattgtggttttgatttgtatttccctgacaatgatgttgagcatctttttatgtgattttttttaaagattttttatttatttattcatattgacacagagagagaatgagaggcagagacacaggcagagggagaagcaggctccatgcagagagcctgacgtgggactcgatccaggggctccaggatcatgccctgggctgcaggtggcgctaaacagctgtgccaccggggctgccctttttatgtgatttttaaaaaagattttatccatttattcatgagaggcagagacacagagagagaagcaggtccccgtggggagcctgatgtaggacttgatcccatgacaccaggatcatgacctgagccaaaggcagacactcaaccactgagccacccaggtgccctctttttatgtaattatatataccatttgtatatctcctttggaaaaatgtctactctagtcctttgcctatttttatctttctaaaaagattatttatttatttattcatgagagacaggcagagggagaagcagtctccatgcagggagacccatgtggcattcgatcctgggacttcaggatcatgccctgggctgaaggcaggtgctaaccactcagccacccagggatccctgtctttgatccattttgagttaatttttatatatgatataaggtatgggagcaattacattcttttgcatatggatattcagttttcccagcaccatttgttgaaggccatcttttccccattgaatggtcttggcattcaattgtcattgagttgtcattgagtttaatcttatactgtgaagaggaaactcttagagttgcattacttttagatgtacatttcacttttttatttatttttatttattattaagattttatttatttattcatgagacacagagagagaggcagagacacaggcacagggagaagcaggctccatgcagggagcccaacatgggactcaatcccaggcctccaggatcacaccccaggcccaaggtggctctaaactgctgagccagccgggctgcccacatttcacttttaaataggttttcaaaaatctatgcatccatcacagtttttcatcagccctttgctagagagtcaatgggggtagtgactttacttctgttagaagtgacaaggctgctcctatgaaggattctccaatgaaggatccttgaggaaacccagacctccctgcatttactttgttggattgagctttcctcctaaaggaatatattcctttagcttaacaaacctttagaattgaagtgcacatgggagaaataaaaacactagtcatttccatgccacttacaacattacattcctcacagttgattaactgagaagaagggaattttaacgtcaactttattgaaggactggagagaagtagagcaagatgggaaaggagcaacactactttaaggaacaggccacattccaagcagggcacgcctgatttggagctaccctggacagcatgaggcattgagtggaagagaaaactgtagcccagaaagggaagtcggagaatctaaagatgaatgttgcctacttcacagctgtgtcagggataggctctggaagtgagcatgagtaatccatagatgtgtgtgcgcataacccagacccatttctttcatgtttattttgaagcaatagcatatgtttctccagacctggcggtatttcttttagttattttctatccaatccttcttttaagggaaaaatgagaagactatggtgctgaaaaacacctaacagaggattttctttctgtgaccatcacctctacctccaacatatacacaaacatacacacactctctcacacacacacatctctccctttaggacttgtcatgattttgtagtgattataatttgagttgattatgcatatttaaatagaaggtgcatttaaaatgtagattaaatcattgacactgggatatctctggtgagtactagatatttttaatagttacattgatacatttcaagaattaggatgggttttttttttaagattttatttattcatgagagacggggtcggggggcaagagacacaggcagagggagaagcaggctctatgcaggagcctgacgtggaacttgatcctggtctccaggatcatgccctaggctgaaggcagcgctaaaccagtgagccacctgggctgcccgaattaggatgtttttaaaattattaaagactgacattctgtgctgtaagcttctttggtcaaaatcatctctactacacagtagagaaaagcagtttcaaaacttggttcagttatctctaatgcactttttattcacaaaggaaaagatatacccagatcacaaagtttgtatgttattaataccttagtagtctaattaatgtggttgcaggaaacttgaccattgctggatgttagtctcagaaaaagtaccactgagaccaaacccatcctttcttatttccctgctaagagttttccctcttatagaactacttctctgtcacttcttggtctttgtactgttttaagagaattgacttgtgacactagagtataccacatatcactctagccaatgcttttttctctaaaaaaatcacacttaactatatttcagaagttaatgagagaggctgtcttgtgatatcatgaggaagctggggtttccactttcgatgatcttttagcatctactctctctctctctctcttttttttaaagttatgttgtccaacttcaggacctcaaatcttgtgactaatttcccctgctgtatgacctgtatagcctgtatgaccagccccttaacatgctactttttaaaaaaaggtatacaataaccaaaaaatatgctttaacacagtagtgccatcttgcttgattagctcatatagttcctttatttacattttgaagaatgcatttttccctgtttggaattattactattatttgaggtaatctctgactaaaataatacaatagctaacaagtttttgagtaggatagaatggaatagaaagcatttttaaccttgggataaggtatttctgacaacatttttcttttaaagattccagtatgatagcatgggaatatgggtatgtccaaactgataaaatcacatacattaaatatgtacagttttttttgtttcaattatattttaactaagctgtttatttaaaaaataataagtttggtggtgcctgtgtggtgcagtcagttaactatctgactcttagtttctgctcaggtcgtgatctcaggagccctatgttgggctccatgctcagcaaggagtctgcttatgactctttctgcctctctctctgcccttctcccctacattctctctctgaaataaatacatctttaaaaaataataataactttgtttctgtcaaataaatataggttcagtcttacccccctcaaaattaaaaagattctaataaatggaaagaggggatccctgggtggctcagcagtttagcgcctgacttggacacagggcgtgatcctggggtcctgggatcaagtcccacttcgggctccctgctcagcgggaagtctgcttctccctccccctctgcctgccattctgcctacttctgctctctctgtcaaataaataaatgaaatatttaaaaatatataaaaataagcaaggcacttggatgactcagttgagcgtctgcctttggtgtgggtcatgatcccagggtcctggaatcaagcactgcatcaggctccctgctcagctgcggggagcagggggagcctgcttctccctctgcttctccccctgcttgtgcacattttctctctctgtcaaataaatacataaaatcttaaaaaaaaaaaaagaaaagaaataagcaatcaacagcctgaaaggagtggcaaaatgtatatataataaaggacttgtatcctgaatatatttatgtgagtgtatgcatatatacatacaaatatacatatatatacacacacacacgtaaagaactatataagaactgtataagcaataataaaaacaatccatttttggcatgcctaggtggctcagttggttaagcatctgacttttttttaagattttatttatttattcatgagagacacagggagagaggggcagagacacaggcagagggagaagcaggctccatgcagggagcccaatgtgggactcgatcccagtactccgggatcacaccctgagctgaaggcaggcactcaactgctgagccacccaggtgtcccaagcatctgactctagattgagcattccatctcacttacttttatctgtttgaattttttacaataaaagtttttaaaaggtttatgaaatacaaaaagttaattggatgggtcatgggttgctcttgttgctgtgcttttcttgagtcatactcaattgtctatattaatggagcagtacaacagtggtttaagatcatgagctttggactcacttattagcttgcatggctttgagaaagttccttggtttctccatagtccagctagctccctttgtgaggctccagtgagatgagttatgtgtaaagtaaagccaagttcttgctcaattaatgttggttattaccactagtgaagggaaaatgtggcagagatcatgttaaaaaaattcttaatttctgttggagtgggactgtggccgtttttggggagtggactcaggggattcacacaggggaagatgtgctgagaggaaatcacacaagtgtgccccacccccttctgcttcaggcttcccctgacaatcaacacctagactttatctccacgagactgtcttcaaatccctaacagaaaacaagaacataggcaatcctgaaatctttttatcttgtttgtttgtttttgaatttatacttattttttttttcttttgagggcacctgtctctgggatgtttctcttgggctagtatttaaattggctgttttctaacttcaaaacagctagtggtagggagagaaggctaagatttttggagctaaaaatagcaaaataaataatccccagctgggctaataaaaaagcaagcatgtgaccatattcaatctcaggcctggagtacagttccctctgactttctccccatagcgactgtcaccttcaggatttcacattgttagaggctaatccttttctttgtgactgcaattctttccttcctttattcaaagactacatcagaggcactgggaagtaaggatgagcaaggccctcttagttcttgggttgggacacacttgggaaatagcttatggggacacatgggttgtccaggcaggcctcttcgagaggtcaggagcacagatcctgtcagataggaagggccccacgggtctgtttttcttgctttacatggtgctggttatacatagtgtttgagttttggtgtcattgttctttagaggacctaaatgcaatttgccagaaagagtgggctttgaagacttaattgtggcaatatttctaaatcccttacagaaatcactccaagcaccactatatatttgttttagaaaagcagatttaggcacatctgctcagggtcgaagttctccgcacaccccttaccgtgtctctgagattcccacgcttcagcggtcttgctcgatggggtgatttctctccttcccttcagacctcccctgaggacgtgctcacatgctcatgtctgtttctggccctctccctcctctcctgaaatgtaaggagcatcttttaaaatggaaattggccttcctgtgggtcttccatgacatcttgtttttggaagcttcgatgtactcctttatcttgtatttttgtaaagcttttttgttactttctcatcattgttcctccactgctttttaataacacaagaattgatgctaattaaagttatagccaacacatcacatgtgcatattattgtctggtttcttcaggatgattttcagtagtttgtcttcctcacattctggtttcccggtctgtacttctgaaacagttggcttgatttagcttcacttgagtaagtcaaacatgtactaaattacctcacagaactctgagtattttaatcagtttcttaaaaaaaaaaaattcctcttttaaggaaaaactacttaaggattaaatatttaaaaatttttagggattaaatgttttcaaatgttttcgtaaatacttattgaacacctgctattaggattgggattttctcactgacctggatccttgtttccaatcctcctgccttcctgccctcctcctgcacttctctccacatccttcaaagcctgtcctctggggtccccctagtcaggcagttgtctggggttgctctgccccccagcactctgactcgtgagcagttatcacctctatcactctcttggcagttaagtcgtaaacttctcgtgcacttgtgctgtctcacatgagtagaagagtcttttgggccccgaatcacttaatatatttttctccttctgagtattcaaaatattagatttattaaaaaggtaacagctccttgcttctactgctccatcttcagcaacctactttggttttcagctctacagaagcatttctttcctttctcaaaagaacagtcgaccatgcagctttacctgcctcactgagggatacatctgactgtatagatctcttagaactaaaatgagctgactgcctccagtaatttgtgacctcgtacttggagacggaactcaattaattatgtgccaaacagttattctacatatctcccctcccccacccgcttttaaaaatagttgcctaacagattgcagaagactgtgccctgggcttttctggaacacagcttcttagtgttatttcttagaatataaatcaaggacaaggtttataatcaaatctcataggtttagaagtcatttttgtttagagatcaacatggtttgatctcaagcagttcttgggactagaggaaacattgtcaattcatgttgtttgccttaaaaaaaaaaaagcaaacaaaacttgaaggtctgcattccagatttgtcttaaccagtgacaattaatgaaaacatctgtccagttccctctttaaagatcttcagaggaggaattctgggcatgtgaagaatcaagttgacagtgcagacctccatctatagcacagcaaggtctgggcgggggcatggcagggagcttagttctggcttcctgctaagaaatcagtagacggcatttactcttcgttttgtggtggttttccacaaaatttataagaaagcaaaaggaagtttctaaactactgccagatggcaagtacgtggagctctgaagcaaggctaaaacccaatcaaaaaaagaaaaaacacatttaggacaagacagttgggccttttttgagaatacctgaaattgaagcatttgcaaaacttgtgtgaagacataggcagagtgtttatacaaaataatttcttgagtggagatttaggaatcaaagtcaaacatgagtgacaaagatgacctcaaaatggtctcctaatttctgcctattctctgctcttgttagctgtatttctttcctgttcaggctatttttgaagagctggcttccttttccccacctttggtacagatcaactgttgctgtaccccctgccctaccccaggacgaatggtggcttttcaaaatgtccgttgtaggaaaacaaaacctgtatatattaaggtcttgtttcatctgtgatatggtgtcttttccattctcactgaagctgccctgaattagctttactgactttttcaaaaaacgcctaacagttctacctacccgtaatcactccttgctctggtactttctgtatgaaccaggaacattttcaaaacaaaacagactcctggtattttcgagattgtcctgctacatagcagtggtgtttatcaacatttcccattctgttgatttcatgctcatacattaataaggcactttcaaatcacaaaagcttaatttcttgagaatcgtatcttgttcagtattcctgtctcataaagtcagcctctatagaaggcacattctcaagtacaggaatacattttatactcaaccagacagcaagcaagagaaggtgtcaggtaagttccttggttcctctgctgtgacttggatggtttaataagatttgggttgacatctccacgattgcttgagtaacaacaatgctgtcatttgtatcctgaccagagccttgcgcttaaagttgattttctagttgaactgatagatctgtttgtcgcttcttacccagtccctcttcttactatctctgcacatttacagaatttaaatggcgtggcctgtgagcatgaaacagaaagccagtggaccacaaggggactgaacccctgacactgggctcattagctccattcttaaactaggacagccaaacagccagttagtgattcacttggcagcagtggccagactcgtgctgatctagtccagaacaggaaagtatgtcagaagcagagggcagctatcaagagccaagaccccctatacccattaggccagtgatttttagcatcacactgtttcacactgaacttcagaatcaccaacaatcttttaataatgcggcttttaccctcccaacagaagaggaaaatatttgccacttatattattttttaatgtttgagaaaacttgaacattttttcaactttaatcatactgtgttctgcagctaaatttttggttcagctttgggttgagattcatccatgttgtgttttggaatttatcccctgttttgattccattttatgactgtattgtaaatcattctactctgattattctatattcgattatttccagttttttgttattataagtagttctgctatgcatattcttgtgcaggtctcctgttctgcacatgcaagagttgctccagggtacatacatacctaggagtagaactgcaggattgtaggatatatcaccaattttaccagatgatgtccaaatgtccactttcctcagtgtcacatatatatgctgtcttctgtcaccttttaagaattttacagtttttcctgtcacatttaagtctgaaattcatttggaattgatgtggactactacacacatgtatgaaggcactggtccaaattcctttgtttcctaaagataatcaccagcaccattcattgggaagtccgtctgtttcgtgatctgcaaggctggctctcagaaattgagggtccatatgtgtgcatgtttgtttctcaagtctctgtttggactttggttaattttacttaccccagtgccaaaattaccctttgagtacagtgtgatatgacttcttgccatctggtgaggttactccccccacctgttggtctttagggagtgttttccaaatgttctttcaaagagttagctgaatttataattaggccaggaagatcgaaacaaagtttagatattttgatcagtaaacctgaaagtaaatgtgttttacctgaattttatttggtcataaaaataaaacaaaatttagatttgagatgagaatttgtgctcataaaaagcattttctttattgtgcagtatctgcaaaccatattaatacaggtatgtcaaacttgtttggattggttgtgctgtttgtatcacaaatttaattaacattggccttggaccacttccctgagcagtaatacagataatgcctggccaatgaagccacatgagactctaactagatttcatgaaataaagggtctcaaattattttaagtgcttataatttttagtaatatgcaggcctatgcacaaataccaaaagggaaactcaactaagagtgcatgtgtgctggtgtttactaagggaatagagaattttaatgtacacattcagcctgggaaactttgtattgtttattaaataaaccagagaaagcaagagaggaatcagcacagtgggaaataaggtcagcagataaggcttttttttgctactctgtttcctgttctgggtggctctgcagtccactctgagaatttcattccttttacccagattgaaaatttcccatttcctgtcgctctctaccacctcccccattcttgagctgccaaaccaaagcagttcaaacagataaagacacagctaatttgttgaagagcacagagctttcggtaaacagcttcttcctggatattactgtgtagagatgacccgacccttatcagcagatttaagaattgaccaagttattatcgtaccatatctgatgggtctgtgctcagcagggcaactcctccttgccttcttcacaacaaaaagaaggaatgactacaatagctgcaaaaatgctttattggggggtggcaggattttttttaatccgtctacatgtttggaataaagcagagcagatgatagctgggtagggttatgcacgtaggaaaggctcctgtgagtatcagtgacggttctggcacaaagagctgaattcagaaagccctgttctcttatgaattatcaaattggtgaagatgttgccatgttttaagtgattagtctaaaactagctagaccccgtcaaacttgactatattgactatacagggtagaaacagttatgaaaggaataggataggaaagtgtcttaggggatcaaagaagttttgagtttaaaaacctagcatttcactgggaaatcactatgctcaatgtaggtggagtattgggtacttaaacattttcaattctgtggtatttttttccggataaattacagtcagaaaccgaggttggtctgatcctaccacataactaactggtaactaattaaaagcacttgagtaacactttttttttgaagtacagttgacagtgttacattagcttcaggtgtacaacagagtgatttggccaagtcttacattcttgccatcctcaccacaagcgcagctgccatctgccccctcacagcactattacaacccctgtgctgcaccctttgcccccaagattcatcctgtaactggaggcctggatctcccactccccttcatccgtccctttatcctcctctcctctggcaaccatcagtttgttctctgtacttaagggtctgtttctgcttgtttattcatttcctttgtttttttagattccacatgtgagtcatatgatacttgtctttctcaggctgatttatttcacttagcataatatcctctaggtctgtccatgctgttgcaaatggtaagatgtgtcatccttttttgtggctcactgaataactccattgtgtgtatgtgtatacacaccacatctttatccatttgtctattgatgggtactttggttgcttctgtatcttggctgttgtaaataatgctgcaataaacataagggtggatatatctttttagaattaatgtttttgttttctttgggtaaatacccagtagtggatttactggatcatatgggatttctatttaaaaaattcttaaggaccctccagtttgcattcccactaacagtgcatgaggattcctttctctccaaatcctcttcaacacttgtttcttgagtttttgagtctaaccactctgacaggtgtgagatgacatctcatagtggttctggtttgcaaagacttttaacataaaaaggaacaaaaactatggtgtacagaacacaaaaagtaaaatctgccacctgttgcttttcggcttgtataagagcagagggtcaagaacagcaagtggcttttcttctacaaagtttgtgtctctaggggatggatatgttaactaactagatggtagaaatcctttcatattatatgcatttaccaaatcaccatgatgtacactttattttttttttaagatttatttaagagagagagagagagagcatgagcaagaggaggagagggagaaggagaaagaatctcaagcagattagcagattccctgctgaacacagagcccaacacagaacttgatctcttgaccctgagatcacaatctgaacagaaattaagaataaaacgcttaactaactgcaccactcaggtgcccctacactttaagtatcttacaatttttttcagttatgccttgataaagctgaaaaagaaaataagttcatgtctctaggtccctgacctttgatgttcaaggttgtgtaaaaaataatttgtaccaagttaaaattactgattaactatagcatcagcaggtctctaacttgctgatttaagataaagaattggaagagagcttggttggtctcctgtccccagtgctttcatgttcatgtgaaactgagagtgtaaacctgaaactgtgtctctcaaggccctggccagggttcttttcatggactgatgtctctgtatagagaccactaccaatggggttcctcaagattcatgcagggtttgtttttaacactactggtacagagaaggaaatctgggttccacttctagtctgccttggtactaattagttatagccatgttgctttgaacaggtcacttggctggagtctcgtctagaaaatgaggatggattgtctaagtctttagatcttgtacatgaacgcactcagcatgtctcttaaagcatagctggtgtgcatgtctgtttcctctatattaaactatgctgaggttgtaaaaattctaagttgtcctaattccttgatttctaaaatagccattattatattcaatgaacatatacgtgttaactgatcctaagtagaaactatgaggctctgggatgcctgggaggctcaggtggttaagcatctgcctttggctcaaggcgtgatcctgggatcgagtcccaacacatcaggctccttgcatggagcctgcttctccctctgcctgtgtgtctctgcctctctctctctctgtgtctctcatgaataaataaaatctaaaaaaaaaaaaaaaaacaactatgaggctcagatccagtcctcaagggagtaatgaattattataagcaataatcataataaggatgattgctcctaagttccaaaaaggaccaaatttagtggctgttcaccggagtaagaaaatttggggctgtgaggaagcttggaagtattcatggaagaactcttgaggtctaaaaacttttttaaagatttgacggggcggcaggggtgaagagcataagcaggagggaagggagggggcagagggagaagcagactcctcactgagcaggaagccttatgtgaggctcaatcccaggaccctggaattatgacctaaactgaaggccgacactcaaccaactgagccacccaggtgcccctctttctaaaattcctaaaatgctagaaaaatgggatttggtacatgtgggagactggaagaaagtctgcaaaatgacatggcgatgagcaagtgcaaatggtcttggagaatgtgggctgggatacagagcatagaagccctcttagctcctgactggagtcatcagagctgacatacagccagtgctatgctggggctaaattagtatcgagattgttaggatggcgggggggggggggggcaaactcagagaaatcagtacagaggctgtgaaacactaaggcactcaggtaagccttcatctcaatatattttagggcttttaaccaagttagtgacctgcatttcaggtgaggaaagggaatatattatttaggttttttgaagtgggaaggagcccttatattttggagtgaggtttgtaggaccagacagagtataaaaagtcatggaaaatgtgatacgcgctttgctttagaggctgtgtcattgtggtgggcacaagaaaaggacagtgacaggtgtcagtgacatcaatgacaaaagtttgcctgagggaaaaagcaacgaagacttggcctgatgaaaagcaagagctaagggagaaaatccagagctgaagttttgtagccaagtgaggatccaatagctcttaacaacaggcagtaaattcacacatgtgagttgaggttttttagaccaggagtcattcattttgagtttaaaacgaattcttcccaagtcaacaatgtcctttcatctgtcatactgtttagattcctaatattcatgcagttcatttttaagtagtagaaaaaagtgaagtggtggaagaacctatcctagagatggagtatattcctgtctgctgacattctggtaccagcaagctgtcctcacaacacaacacgtttccaaaggcaaaagttcatttcttcagttttaattctatgtaaacagtaaagacaagaagtacaaaaagaaacaaataaaatatcttgcttttatttaaaataaaatgcatttatacagtttttaaaccatggattattggacaatactggtaatccacccctcctggcacccttttgggttgtgtgagctaggaattttccaactagcaccaatgcggactgtaacagcacagcggacgagaacatggccagtccaggcattagagttaaggacgctgtggcgaatcatgactataatgaagtcattcttaatttagcaggtatgagatctgcacattaattatatttttaaagcatttaattaatgcaaagatgctacatctaagccatttgctagctgtgagttttttttaaaaaaaactgtacaattttataaaatttgtgtttgtacattagttacacaaaatgcatacttcatagacctttacttcatattgtaatgcaaaagttgcatattttaggcagacagtgaatatgctggtgaatactaaaaatgttgtaatacaatagggtgtaaaaataaaaacagaagacagtatacatacatgcttattcaaagacaaaaataaaccaagccaaacggactgatagcattttccttcaaggtcattccttcaaggtcaaacaatgacattattaagtatcagggacctttcacaggcctgatttacttgggggtgggagtggggggatggagaatcaatggctaccagaagtaggtatttttaaaacacaagatcaaattaaacatacattaaaacacatgcattaaacatgataaatagacttcatatagtttaagccctggatagctttaaagtagatggcttgactttcttggtttggctagattaaatcagtgatgttttgttcccgacttgccccctactttagttttcaattcatgtccctaaggaatgtgtgccatatttgagtccatatattatatcacgagagcagattaacagtcgtgcttgttagtgcacttactaactggtctggtaaggcaaaaaagttttcatgataaaatgataaatttcaagcttactttattaagcagcatataacaaacaacagctttcaaagttaaatattgttatggccatggaatttcatcacacagtgtctctattcacacccaaccactggtaagtttgtagaacatctcttcatctaaactctcattttggtcttttgcacgtgttgagagaaatatgtagccaccaatgaattcatgaaccactttgcaatctacttccgtacaaatgaaggacaatcgtacttcatctgcaaactctaccgtgacctagaatgaagaccaagaactgtcagtccctggaaaactctgtgtggctgggaccagcgaagcttccatgctatttaatgtctcccctctcacaaaatatttgttgagccttgttttttttttttaatcctaaagagtaagtttattaacccctcccccacacctttttagttttcatgttctgaaaaggaagactgaatgcaaggggtttaggtcattctgttcccaatggtctctggttagtctagttatgagaaggtctctcttcaaggcctgggagaaaacttacttcttgcatttaatttaatatttgctctagatatttaacctttaggtatcatgtgtggatacagtagccctcccctaccttatccatgggaaatatatttcaagatccccaatggatgcctgaaaccacggatagtatatatggttcttgtcccttcacacatatacctgtgataaagtttatcaattagatacttcattatttgttattgtaagagattaataactaatagaattacaacaatatataatcaaagttacgtgaatagtctctctctcaacatattttactgtactgtactcatccttgtgataatgagaaatgataaaatgcccacgtgatggatgaaggtgaaggacgcaggcactgtgacatagtgttaggctactacagaccttctagcaatatgtcaggaggaggatgggttatctgcatctcgaccatggttatccacagataagaagggatactagtatatttcagaaataggagattctgtgcagtaataggaactgatacaataatcctaatgatcctacaataacacatggcttatcagtaaaagatggtttattttaaatgattttcattgtactccaaggctaggggcagcatgatatacagtagtagctgtgccaggttttagacctctgagcatcagtctaaatcctgattctgttaactaagtgtgcagtcatggcaatcatggccattaagccattaactttgagtgtcctcatttgtaaagtagggacaatccaaccacctcacaaggccgtggtaagattagaaataaggtacaaatgtaaaaacatctagcatcatgactggcacagagtaggaattcaataaacagtagctgctactgacagggatgtaccactacaggaaaaccaccctctaagcagatcattatgttcttagaattctaataattgggacagttatgaaatggcaagttaagtgggaaataaccaaccatgttttatactttaaaaggtaatggtacaaataatctacagaatttaatagccttttaattcttaatttactaattcttagtagaagggctctacatgcactcaggtaacactgttcaagcttaccatttttatttcccagtttacattccactgtttcatgttactgaagcgccatgttttaattgcatctcctgtgctggcatccatcctaatcagtctgttgtatgcaattccaataagttcttctttttttcctccctgaaacctatagtattaaaaacataaagtttaaaaacaagtgggggatgggaggacatgttgctttgtttttaagatgagctttttaactcttacaaaggatattttcatataagtaaaaagaaatcattttgaatttttaatgcaaaaattacaagtatagaaaataggtttcaatattcttgacattttactgtaaaattgctaatggatctcagtaggtactttaaatgtttaattgaagtagattacataaaaaggcactaattaagatttatacataaatgtttaggagaaccactgaccttgcaataaagtgtgtgatgccaaattctggtaatgactgccaagcttgaataaatctcatcttggcctcaattagactcatctgagctacattctgatgggcctccaagattcttgctgttatctaaacatgattaaacaccacctttaccatcgagacaatattctttcatgggaggatcatgacaaaaagtaaaaaactgaatcacgtgccccaccccacaatcacatattttaagaactagaattaggaaatctctgcagctacttttggaaattttagtataatgatgactcttcaaaataaaccttgatagatttcttcttaatttagtttccatatatccagaaacaaaaggtactattagaggagtatgtaactgccactcttgaggtatattccaagtacacacatatatgtcgctgcttctataaaaggcatgttctaatcctatgaataatgaagttttaaacttagcaccaagacacagtatcagaatgagtacctggaatataaacttctagcaggaatatttattagcacctttaaagtacttgaaaccagcataataattaaaatttttttctaaatgaatcattagaaaagttaacttttaatttaaattacactcactttgggatgactactgccaaaaagagtggaaggaaattaatccataaaaagggattgtggctaaggctttaaatattttatgtatttttttcttttctttttttggtaaatatggagaacttaccaaatctcttatatagcctggctgtagatggcaatgcgaagaaagaaaaaggaagcagaaagaaaaaaaaaggcaatcagaaaaaatggcaatgaagcaaagaaaaagttgcggtaacctgcaaaccaaaattccagccaaaaaccatgcaaaaaaaattactttaggtggaaaccaagcaaagtaaatgcaagcatgaaaatgaaaacaaggaagcagcgattattttccatttagaacactgagaaacacttccacattattttaaactgataagtgttactaaaattatgggtaaattatttgtagggaaaaaaaagagcaaatacccttttccctgttcatttaccagttcttactcgttaggcagaactaatgcttttagtagcaaaatcaaaattaatattcaaaaacctttaatgttttcagattgagtctgatactatgacccatgcatcactgttcagaaataagttgaaggtattcaggaccatacggtttatttgcacaagaaaagcaaacccctcaaattaccatctgttttttgcatcctttttcctggaagggaaaatgaagagatgctatatactacactaggaacaatggctataaatagattatctagttcaatgtatattcacatggataaaacagagacaactcttttctttaaaatgtaaaaattcagcttgggaatcatagtcatataaagatacatacagtgagtttaaataattaataaatagttgcagggatttaaagtagattaaatataacacaatctttattgatgggccctggtaggaatagaggagctcatggcccaaacctctttctactggattcctgaatgccactgtattgtatagtttaacaattactaagcactatatccaacgactggtgcagtgctggacacacaacagcaacgaactctgcctgtcagcacttcttagctgacagtaggaattgtcagggcaatacatggtctctactttctgggaacaaccaatataaatctagtcagagaaaagagcattaaaaaagaatgtgcatttgataagatgccagcatggaagaaaaggctagaagaatccttaaccacggaccacacacatgctgccatcctgcgagttaaagacagtcagatagtcactgtttttgtcctccagagaattttcactatgacaagctagctgagaaatcagggatagagaactatctttttaaagtgaaaactatcatttaaaaggcttctgagaaaacaatccagtacctttgacaactacaccaacagttggcaatcttcagtaacactttgtatttttctttcctgacagcagatagtgtaaatgatatgcttgctaaggtttgaaattgttccttgtctttgaaggcaaatgaatccactttcagaaataaggtttttttttaaatgagtaatttttaaatgaaataactaagaataaaaaaaaaattagtacttgattcactttccctttttaacttacaatctacattccacaaagctccccagggcagcatttcctccattccttactactcccacatcataggactgtgggataaacaatttccatgtagcttacacaacctctgaaacttaaagacaaatacttggtgattaaaacttctgaacatttctagctaagtgatttcagacccatttgataaacattatatttaaagttaagaattagtaaatgttctgggtatttcattggtgccttcagtaatgttttaaaattattctttaacagaaataaaaatgaaactagatagaaatgaaatatttatttgaaaggtcttcttcaccgccccacctcagactgaagcctttgccttttatggcatgatgtttggtgtagcaaatactgggggctatcccaagtgaaattcccctgcaaagaaccttttatgttgtaccgaagaaccattttcctaaatagcaatccttttatggtattaatttccaggaaaggaattctaaacagagtgaacaaaagcagcgaatttcaatgaaaatttaccaaactttgtcacatgtgcaaatcttggtttaggtttttttttttactgttaagaaaagataaactatttctacccttgtaaagtttatttccaaggctggaaagtccattttgacagcaagaagagttgttatagactttgttgagaaatgctggctgcgctttatactacacttaattatataaggaataaaacccaaagcatcctcaccatattcaattccctgaaagaacacaccctgttcacaggatgatttccttaggttttgagtaaatatgctcccaactatcttacctcattatctgtcctattaaatgaaaaatattttttaatgactaatttaaatggactgaaggttacttacatcctattttatgctctgatcactggatatgaaattaagaccatcactaacactaaaaagttttaagaggggaactgaatttaaagtgtatgtacaaaatcataaaaccggaagaaaacagatgaagtaaaatgaatcaaatacctgcttgttcttgtatttttttagatagcgaggggacaccaaacattcaggatttatatcagttgttatctgttctggtattaactgaggatctgggtttaaatgctgcatcttcagaaaggaaagaatattttgaacttccaagttataagaactgtctgccatggtcttgcctttggaggctaatctgcaggctgccatccagtgtgcatactgtttttcctgttgaaaagaaatattgaaatatgatatgtatcacatatcctttgggtttaaaaatctaaggatgactggtcaactctaagtaatcaaagaaaattaaggtttatacttttaatggaaaacttacattgtcacaacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcagcctcatttatgtatcttacatgctgaatttgctgtttgggatctattatgagaaaggaaatttttaccacccataattttgtttgaggcagagcacagagacacatctaatacagtttgtggccctcagaaaacctgattaaaaagagaagggtcctattgaaaggatattaccaaaaaataccacatggcaagtttgatgctgtgtttttttttaaaaaaaaaaagattttaaaaaaaattttaagatttttatttatttgacagagagagtgtgtgccagagagcacaagcaggggaataggaaaaggggagaaacaggctccctgcttagcgggagcctgaggtggaaatcgatccctggatcctgggatcatgacctgagctgaaggtagatgcttaaccaactggaccacccaggtgccctagatttatgtgagaggggtagggtggggtgagagagagcctgaccccacaaccctgagatcatgacccaagatgaaaccaaaagtcagatggatgttcaacctactgagccacccaagtgccctgatactgtgtgaaaagtaaaataaagattgttaagcctccatagcatttatagttgcactggaggtggatagtggccttggagaacagattcagcagatttcagtagccctttgaggatctgagccaaagtaccatgactgagaagtaaataggaaacaaaaaataaataaataaataaataggaaacaaaaatagctttctgatgaacctcgcctgtaacaaggaaggaggaaagagggcagttacagcagagagaggtataagataaaggagaaagggactttgtggtttaagataggagagactccaggaagttaaatgctgatggaaacatcacactagaaataggaagaaagaaatctagtgtccgggagataaagagggtctctgatggagcgaggctcctgggatggcagaaaactcagcccacttggataggagagccttaagagaagaggtgcctccttccactgtgtggaagttgagggaagctagctttctcagctgtcgtggcagagaagctatgtgacctcccttctaatggctttctaagaaaaaagaaatgaagttgtcccctgagattgaatggcatcagaggcctgagaagatctgaaatattgttgagaatgtctaaaaaaacacagaagtactgcaagtgttgaggcccaggttgaagttggagatccatgaatatctagtgaaacctatccactcggttttgtgattttttccccccccttccctcctttgagtgctcagcagcctaatgtaagcaagtaaaagacaggtggttggagtgagccctggttaaggttttggtaaatgtatataatggaaaagacagtgaatctagggaattgaaggttaatacctggtaaatggtgtgcaggctggactccggaaaaggaagaggtgaaaatatgttactaatggggagaaagttgaggggttgtagggagagagtccctcagatagtctgaagagaggaatgaagcttgtgttgctgttaaatttgcatttaacatttcagaggaacagtaattgggttacactgaagtgtagcatgttgccatggaagtaggcagccaagatggcatgcagtgattgttgtctgagatgtagcctaataagtgcctctgcgcctacaccaacacctgacttcccactcactttgcatttccaagctttttgggttttttggcattttactcttttttttcttttttaaagtttatttatttaagcaatttccacattcagcatggggctcaaactcacgaccctaactaagatcaagagtcacagattcctctaattgagtcagccaggcaccacagtactttacttttaaaggtctaattattatggggttgtatcctttaagtccatttggatgattaatgaagtgtgtaaaagatcacatatcttcagacatctctgttttaactttgcaggttaaatgaattgccacacaacttcctgatagtttgtaatacttgaagagaaagttaaatgctgttgctaatatttttaaaagaaagcaaaaagggagagaaagtccaccaaattcatgataggagttgcatctggagagaagaagatctcccatttatcatttaaaatgtttctttaatataatacttcagttttaacatttgtcctatttgtgtggtgggtatgtagaggtctatctttttccttatacaatacactccactatccacttccaatgcggctataaatgctatggaggcttaacaatctttattttacttttctgtggcatttgatgctattgactactgtctttttaaaacaactgttactttagttcccaccatacctcatttccatggtcttcataagcatttgtgtttcccttgcaagctcctcttcctctaatctgtcctataccgcaaacataggtgttctgtagggttctgttcttagctttttcatagtacagacaaccattctaaggctgcagtaagcattaatcctaaaactaataccattagtatcttcagtgcagctttccagctatccagtggcctacaggttatctccaaaagatattccacaggtaccaaaattaaactcatcatctttccacccaaactcaggtcgtctatattctcaacccttttcactcaactgcgcaagccagaaataaattcctccccatcagcctctcccaagtctgtcacccagggtgctgctgaggcttccttagggttctctgagttggcaccctcttccccatttatactcatcacctgaatctgcatcagtcactgctttaaaattactcctctatactatagccaatataaataggatgaatcccatcattttcatgttagtgacttttcagtggcatttcactgctgccagtttaaaaaacaatctccttaacgtttttatcctcttaatttctgccaatttcttctgctattatcactcattttagtagaaatcagattcggcaaccactaagaagtattcatcctcccccttggactctacgttccagcagcacaaaacacccccttggttgttgatgctttctccatacatttctgcacaacagtctctgcctgcctggcttttactaattcactttcccttcgtgaaactctaactctggcattatttcccccacaaagtctatcctgattctctccattgtcactgaacactgataccttgtccctttgctcccccttagacctgttacttttttttcctaagattttatttatttattcatgagagacgcagagagagagacagagacagagacagagatacaggcagagggagaagcaggctcccctcagggagcctgatgcaggacttgatcccagtccccgggatcatgtcctgagccaaaggcagatgctcaactgctgagccacccaagctcctgacctgttactttttaaagtactgttgtccaaattgtaactgtttatcttccctacatgctctaaactcctagagggagtactgtcatctgttcttgctcacgtctctagtatctaggacagttttcagtacaggaattcaatcagtatttactaaactaaattttttataactttatattttagatgtccaaaggccttggagagcatctagtccaacacacttatttcttagaaaaagatactgaggtccaaagaagctatttttctaaaatcatagggcttgtttaatagcagagcagaatctaggccatttgattttaagactggtgttatcttcattagtgtgatgtgctggaaaagtgctcttttgggagaacctggtagaggcagcatgtgtaagccattctccataccaggacttgacttcacacagggagaaggttaaggatgtaacagggacaaagacgacaggggccagaacacagatctagtctacagacagagaggagatcatctggaatggtcctgggcagcttaggagtgaagcaacaacagagctgcaatagagtctaagagtaacaaataatgatggagacccaaaagtcaaacccatgggtcttatgagagaaaggcaggagcctaattaaaactttgaggaaaattacagaattctaacacatgggcatagcagtcttctacccaggacagagacttcccattttttaaaacaacagttcagaggactactgggcagaacacagggtagagatttgaattatttttgttgaaatatactaaaaatatcctaatgtactatgcagaatggaaaattaagactatagatcaaggaaagcacctctgtattttaagcaattaaatgaaattattttgggaaacgtttttgtgaatgaatcaggggcccccttcttgggtacttttgtccaaatatggatatttttagttagaaagacttactgctttaacatataatcataaatgtacatgcaaaatgtagcccaaaggagaaatgggccgggccgataggaattaactccctgaatacagccctcaaaactggcctgctaaagaagtgcaatctttgctaccctagagaggctggaaacaggaggctgcccctgcagctccacagcccagaagcaccttgctcctttctcaattctgtctctccagccccttaacataattggaaattcaagtttcacatgaatgtatctgattggaatcaaaatctcactggaaatgagtccagaaaatgtattttagttttctggcctttgctgtaaagagtgtggaacagtgagatgccaaactactgcatcctcccccggacacactcgtgccaaaggtgtggtgagtgcagttcttatgtcaagtaagccaggtagccaggtactttttagtgaatatgtccacaagtgaagggctcatcaacgatctgcaagaccctgcagaaaaatcatggcaggaggcagcaagatgttctccagcggcagaagaaccagtccaacctgggtaggaaattcgccttctacctgaaccactacatcaatcaggtaagggaggtgaagaagcagtatgaagaactaaagaagtcacccaaatagcaaataaagttggggggggcggggggagggacgacgaccaaagccagtagctctgagctcccagccggtgttagtccagaccacaggaagcaagcctgctaaaatggagtagaaacatgtccaataacatgtgcctcaaataccagatcctagtgatagcactagatttgaagagacaagaggaaaccaatgagattccggttgtcagctaggaggagcctcagagcagtatcctggggctttcccagaggcgagactgagagctgagtgttgaacaaaaatgtgcagggaagagttatggggtaggggaaaaacttggccaaaccccatagatgcctgctaccccactgttgagccaaaaatgaggctagggaacctgaaggggacaagcttgtcatcagtaaagaaagaggagtacaatgctgatgaggaagggagaagtcagcaaaaacagaggactacaacatggatgagaatgaagaaaacctgaatgctgaaatgctgaagatgagaaaagaggtaccataaatttacctgacaagaaaagtggaatcacttcaaatgaggactgcacaaagagtttacaacaaaatattcatgtgaaattgaatacccaaaattgtgacaaaaactacttataaaaagaagaagaagaagaaaagaagaatctagacctaaaatagaacctaaagaagcaatgaatctgctaaaaaactaccctggcccaccacagtgaagtttatcaatgatcagccaacagaaattactccatcaacactgctcattccaaggctttccttacctctcaggttcatctgatgagctggtgtgccactggattcttctttgctcttatagcaagaaatagatgtatctttaaaggtgcaccaatattgcttgtaaccttttagagttagcttttttggcctacatgtcaaatagaattaacagaaaaataacttttgaaataactttatcaataggattagcagccaagtttcacaacagcgaaagtctaaggccaagttttacacatgctgagctccgttcccttgggccagcatgttatattcaatgttgctgttaatggatttgcgccttctcgaacaatctactcaggaatacctcacaaagaatgaatgggcaggggagaaagacagaaggaccagaattcgagtatttctgttagtgttggcatctctatcactagcaggtcacatggaaaggacaagaaaaggtgaagtaaatgtcaccaatgggaaggctcctaggtcctgtaatccaccagtaggttcttgggtgtgtgcagggctgcctctggggcctctctggacaggcaggtgtacctagcataactaaagtgaggaaaatacttgtctctctcagggtgtatctggtgtttcaacttgccacaccaaagccaaacacaaagaaaacagaatagtcacgatggagtatggataaggaaggatgtgtaacgggagaatggggtagggagcagcatctgaaatcatgccctgatctcagaaactgttctctatggtgagctattctatgtttagctacagtaaagggtttattccataatggctttacatcttatattccatatcacatcctgtcctctttaccctctctgctttaatgcccaactctcttgattctgtggactgtgcctagattgataaaagtctagataagatacactcataaaatgttccatgatcaaatgaataaaatgcaatagaatccggggctttgaacaaggaaataaccactggcaataatggttcattatgtcctgctttcacccagaggggatgctttgtactgaaatgccactgtatgtctcagaatctacacaatgcaatctaggctatactgtctttgtttttcccttttaagaaaaatgtttattagaaaaaaacaagttcatgagtactacagttttaatttggtaaagatagttattttctctcaatttagtgtttctctaactgataaatgcttgtagagatgcattgctaatcttacagtaaatttcaacaatgtgaacattactataaaattaatatttatcattcattaatatttggaatccctcccctttttgtacttacttaaaaactttaatatagtcagcaagttcaggaatagaagtgatgtcaccctaaggaaagaaatcattttttcctgatttttcttgaaatttgaagctctaatatatagtatctgattatcaagtatgagcttattcaataaacaaaattacataaaatacagattatgaaggttttttttaatgaaggttttaaaggtagaatcattatatggttatacgtacggtcattttcaaatgacataaaaagctaataaaaattttgatcaaaatagcagttcatataacctttaagaacatattattgattctaattcagctagaactgtttgtatctgcatatgaaattatgcaaaatcataacagccctaagtgtttcttctgtaataactaatttctaagttttatttttatttttttaaagatttatttatttatttatttatttatttatttatgaatgatagacatagagagaaagagagagagagaggcagagacacaggaggagggagaagcaggctccatgccaggagcccgacgtggactcgatcccaggactccaggcttgtgccccgggccagaggcaggcgctaaactgctgagccacccagggatctcctaatttctaagttttaaaaccaaacttagtatttaaaaattttcccaagatatatttttctcttccttttgtagctcactacaaatgtgcagctcactaatggattttaccatgacttgagactacctttcactctgcaaaaatgtcttcccactgcttatgacagaatgggcagatatcacaagatttatctttgctgtactagaagcactgcagactagaacaatattaattttataattttccataaagtttctgaaaagccaacacctgtattctgtaaagcttgaaatatttctctatatccacccaatacttataagaacctatatccacaaaaagataagcatcaattcaaactatactagcaggaaaaagattcaccctaccaaaattgttgatgtttttcccccttccaaagtgatctccaggtctgaaagggcagcatcaacttcgtccacttctttgtcactgttgttcaaatgattctctgatgtcatgattgacagcttattgatgtgatactgaaaacagaaatgatatttatttaagtgactattctaaatttagtaacattttaaaatgagattactgcctgcatctatattcaacgcttttcatcacttaacttgaaaagagaagtgtccaagaactggaatgataaggaaataaatagcacctgaaatcagtgtccgaaatatcctaatacttatccaaaaggtgtttggacatgtaaatccaagaaaccaagtggggggtggggggcagagacacaggtggaaggagaagcaggctccatgccgggagcctgatgcaggactcaatcctgggtctccaagatcacgccctgggccaaaggctacgctaaactgctgagccaccagggctgcccctgagcagagatttttttatgtgtttttttccctcactgcagtattccctgtgtctaaaacaggtcctgaacccaatgaacactgaatgaattaacagaataggaataaggtcttgtgtaaagatggataacattgattaccttatattactactgttacccagcggaggaaaattagttatcagtattaggctgaaatctaaagctctactctccccaaccccactcctcaactcaattcaatactgaaaataaaatcagaggaaggtgtttatattctcagttacagaagaatggtaagattaggacgcctgggtggctcagcagttaaacatctgccttcggctcaggtcatgatcctggagtcctgagatcgagtcccacatcaggctccctccatggagcctgcttctcctgcctatgtctctgcctctctctatgtccttatgaataaatgccaaaaatcttttttttaaaaaaggaatgataagattaggggttttgggtagttcaacttgggtggctcagtggggagtttgcttctccctttccaaactctgcctctcctcctgctatgcactctctctctcaaatgaacaaaataaataagattgattacatttatatgtggatatacacacataagtatatatttgggtagatacataatgagtagtaatactcctctatgtagatagaaaaatctctgcttttgagtaactagtcatgattttaaatatgcttaggtaagtaagtcacttattacagatctgttagatcttgatggaatgataagcagaatttttaaatcacttaatcagttacctttcaaagcatttagtagcaatccaaatttctgaagcattcattcactgaatacaatttattcataggaaacagtgaactaatttgaggccagttgtcagttttcctctatattttaagatttagtgaattggtaattaatagtctctggctgtaccttcggttatgctaaaatgagatccttacagtgacagaaatttccatgttcacgaatcatggagaatgaagtaggtagaggcccttgggcagttgcctcaaatggcagagtaacattaggaatcatgaagagagttggtgaaaaatacagattcttaagagagatggtgaaaaatagattcttagattcaccccccgagattttgattcagcagatctggggggtccagtccagaatctgtatttttattaagtgactcaggtggctgtgatgcaaaaagtccttagcagttatccaggaggagtaactgggtggcactctcagttaagtgtctgcctttgcctcaggtcatgatcctgggctcctgggatcaagccctgccattgggctccctgcttagcagggaatctgcttctccctccgcctctccccctgcttgtgcttgctcaagcatgcgtgctgtctctcaaataaataaataaaatcttaaaaaaaaaaaaaaagttatcctgaagaaaccctggctatgaatgggactggtcataaaatccagctttgctttcagaggtgcatggggtatctattaaatgttataatacagacttgaacgtaactgcttcaaaacagtgttactaacctatttctttatttacaccttcttagtttatttttttaaagattttatttatttatttttgagagagaagtatgagcaggggcagagagggagaagcagactccctgctgagcggggagcccaaggcagggtttgatcccaggatccagggatcatgacctgaaggcagaagcttaaccgactgacacactcaggtgccctacacaccttaccttaaattacttgtttctttatactatgtagattcatgaaacacaaggaaacagaagccccaaggagaaaataattcagagtgtacggtatgtcggagataaaaatactagacatttccttgccgttttttcaaagtttcccccttctggtactggatgggttcctagagcctttgggacagtctctgggaaggcttctaagaattcagggggtttttggtccagagttctctcattaaatctagattctttttttttttcatttattttttattggtgttcaatttactaacatacagaataacccccagtgcccgtcacccattcactcccaccccccgccctcctccccttctaccacccctagttcgtttcccagagttagcatgcacatgagaaaatgctctgcatcacttgccatcagggaaatacaaatcaaaaccacaatgagataccacctcacaccagtgagaatggggcaaattaacaaggcaggaaacaacaaatgttggagaggatgcggagaaaagggaaccctcttacactgtgaactggtgcagccactctaaatctagattctaaaatggtccccgagacctatgctttgggacattccgtttccacagattaaaattcatgatttctgaggcattttctactgcactaaaatggaacatctgctgtatagtgggtgagggaaagctacaaaataatcccatttctgtgaaaatacaactgtgtgtacattttgactcttggacaacatggggggaggggcgttgattctcctaaaactttactgatagtctactcttgactagaaaccttactgataatataagcaatcaattaacacatattctggggacacctgagtggcccagtggttgggcatctgccttcggctccgggtgtgatcctggggtcccaggatcgggttctgcattgggttccctgcatggagcctgcttcatttactggactatatttacttgagaaaacctgcatgtaagtggacccatacagttcaaacccatgttcaagggtcagctatattctcactcaccaaatttttttgagcacctatgtgccaggcacattcgtatctgttggtattttttaagtgcattacttttataataaaaagataaatactatgtaaaaaatctgagtttcacacacacacacacatatagatgtcacacatgtcatatatgtttcacacacacacatatatatgtgaaactcatatgtatgagtgtatgtgtatacatatatacacatttttttttaagatttatttattcatgagacacagagagaggcagagacacaggcagagggagaagcaggctcttcacagggagcccaatgtggaactcaaaccctggaccagggatcacatcatgtcctcagctgaaggcggatgctcaaccactgagccacgtaggtgtccccccgacatatattttatatgtattattctgtcattggcaaaaccttcactagaaaattataagcccatattctaagtgagaaagatgtaggcagaaagccataaaccaagtgaggtactctgagtaaaattacaccagaactttttttttaaagatcttatttatttattcatgagacacacagattgagagaggcagaaacacaggcagagggtaaagcaggctctacgcagggagcccaacgtgggactcaaacccggtactccgggatcatgccctgggccgaaggcaggtgctaaaccgctgagccacccaggcgaccctactccagaatttaattcaagaaattcttcagatagtctgaattatctagaaacacaacagaagacccttaactagttgattaagcaagtctatctaaactaactcatctatcatgaaagattttccttgtgtaagctttgtttcaattcctttccttcatcatataacagaagaaaggggcttctcttccatcacaaaggacaattttaggagtcttaaacagaaaaccttcctggatgcataaaagcatttagaagattaagagcatttttatttgtgttctaaagagaagaaaataaaatcataaggaaagctttttttctttttttaaagatttttattttatttaagagaaagaacatataaactgggcagaggaaaaagcaggctccccgcagagctgggagcccaatgtagggctcaatcccaggactctgggatcataagccaaaggcagccacttaaccaactgagccacccaggcaccctgatctttttttttttaagatttttattacctaagagagagcgcgcgcgcaagaatgagtggaggtaggggcagatggagagggagaagagggacagagagacagcgggagaaggagaagcaggctccccactgagccgggagccccacacatgggggacccatcccaggaccctacaatcatgacatgaagcagaaggcagatgcttaaccgactgagccacccagacacccccacagtgaaagcttttcataactaaatgtcacctctgcctcctgtacttaaagaacaccaattttgttagaactttacacaaaaccagaattcagaattctaccataatctgagagcattcaccaaagcctcactcaatctaaaatgtaagaatgacttaatctagtggtcaactgcatgcagctcagtgtgtgtctctctctctctcttttttttatttatgatagtcatacagagagagagagagagagagagaggcagagacataggcagagggagaagcaggctccatgcaccggaagcctgacgtgggattcgatcccaggtctccaggatcgcgccctgggccaaaggcaggcgccaaaccgctgcgccacccagggatcccctcagtgtctcttaaatgcggatttgtggatgccaccctatgttattttattagaggacagcagtagtgaagtggacaattttttgtttttaagattttatttatttattcatgagagacacagagagaggcagagacacaggcagagggagcccgacgtgggactctaacccgggtctccaggatcacgccctgggctgaaggcggcactaaaccgctgagccacccgggctgccctggataatttttaaataagcactactgtaattctgaaaaagttgatatgcagttcagaaccacttttggggtaacactggtttaatataaggaaaatattagctacctacttcttaaggattatcattctaaaaacttttttatgtttagtttcactattttatcacctttaaaatgtattatttttgctatagccatttaacaaacattatcatccccagctacttaggaaattatgcaagtaataagcttcattttagaaatgtgattttcaacacagatcccatttctaagggaaaatggggtagtgttaagctactatatatctagaggtaggacaatgtatttctcctataggatacagaaaaatagctgttaagtataccactaacagtacaccaccaccaaactcttagatgagatgacaaaaaaattaaattcatggatttgtctttaagtgtattcagtttccacacagcaaaaagtaaacactatcaaaatactactggaattacaatgctactttatttaaaaataatcccctactctttcccttgaaagtcccatttaccaatactctccactacctgtaaggctgcaaacatcatcatttcttcttctgtgcattcaatttcttctaggagaatagcccatttggcctgctcataaagctgattgattctgattgcatcatactgcagcaaaagagacacaatctttttactacatcacccttaacataaaaatgtttgaaaagtgaatattcactttcaaagcttaacaaaaagttttaatatactttttttctgggatttttatacagtatcaaatgctcaataacaaggatacctatcgggttaggtatatctatatattcccacatctaattttccattaaaaatgacattaaaaatatgccaaaatattattactcagtattagaaataagattctgtatgttattttacagggaaataataattagatattacagagctcttaacaaaatgaatctaacttgagagacatttaaagtaaggtacaagtgactgattttcacttgttattgcaacctgccacactaaaatgttacagtcagggagtaagttacttcagggaacaccctgctcactatggaaaagcatacttagacaaagtactaggtccttagtaattatattaagaatctgaaatacagagtacatatatatacttgtggtaaagatttacttatatgttactgaattatccatttagttatgttaataaaaattaatagtaatgtactagcaatactattttagagtggtaacaaaacatatggcatcctcttccctagcaaatataacttacgttcccaaaacagttttggttttactgaaatgagacatgatatggcctgaggggactaagactgttttttgtagttccaaattatacattttaccgttaaagaattacttaagcacataataaaaaatggtaagcatatacattaaaatctatactataatctagacatgaaaaggatgagaagtagccaagagaggttttcacctaagaacgataataaggaagcaaaagatccaaaacaccatgccatatgttttctagggaaaaatactccaagatttcttatcaaatttactcttctcagaaaagcaaagtatttcagtaggacagatgatgcagtcatttgatagtaaaaatatataacaatgtttgcctaactaagtaggaagaaatgtagacttagtttttctttgaagcaacatcttgtgatttataattagaaatttgaaagtcattgaaaaggtactatttcagaaacacttttttttccagaaactcttattttactaaaatcacagcttaaagagagacttaaaaaaaaaaatccctaaaactaactttatcaattctatagtaccaagctagtgcatttaaaatacaaatcaaccaaaaattcaattattttaacaaaaaagaaaaagtttaattatgttcccaacctaggaacacaatacttatttcaaatacagatgcctttgtctaaagcttgggtttgtaatattattcagatgttctatatacaaatgattacttaccccatcaattctaaaaaacaaacatccaaatgaaccaaaaaaaaaagagatccctctaaaccctcggtacctttggattcaaatcaaaaaagctgtaatacttgaatcggagaagcaaggcctcattttccttcacatcttgttccataagagatcttgaggaatcaagccacctggacaaattaacaagagcagtggaatgcaagacaagattaataaaatatttctacctctagttggagaaagaaattcttcagtgtgtctttaattcattaatttttaaaaaatttatttgagagacagcgtgtatacaagcctgatgtggagctcaatcccatgacccaaaagatcatgacccaagctgaaataatgagtcagagcttaaccgattgaaccacacccaggcgtccctcaatgtttctgtattttaaaacttacccttggttgatttttgctttgtcaagaagagcctgaggcttgaacattttcgccagaatttctggtgatgtgattggctgactgacagcaagtataccagggttgccttctgacaaagcactgtcaccaaaccaagcagaagttggtgacaaggggcttccatcatgagcatcgtaagtgggggtcattgttttactgtaaagtcctgggcttgaatatatacttcctaataaataacatgaaaaataggtaataagtatgaatgaagtacagaattttagtttttaataatacatgctatataacgcaaattgtgaaacaagtttcattatggaagagcttagtacattattttacctgtcttgaaaacatgtaaaattaactttaattctacttgtacaacattagaacatataataaataacaaggtcaaaagaatataattacattggcagaaattctggggaaaacagttcaagggaattagaagctaaatgttaagaatatagctgaagcagacagatcaagtttttaattgtggcaaggctcacctttcagagggccaatgtaaagaacatcggtgcctataggaaaggaaagacaggaattcagaaggtaaaggaaaggtaacaacagaagacagaaacgaaatgaaaaggaaaaggaaatggaaaaaagaaaaacagattttcctaatgtgaattataaaccgaagtaaatattttagatgaatttaagagtaaagaatcttaaaaactgtaacataagtttttttgtccaattcaaaaaaatgaagtgctctagtcaagcatccagtgacaaacatatccacgtttatcactctttgaaatccacaccctgttttaagacagcttgatgtaactgaataaatgcacataaactaagaacaattttatgttaacattttctcagttaatagctgaactggttccaacagctttacaaataaactagtaaagcaaacgggaagataaagttttgcaaacaaagatacattttataattaagccccaaaggcaggggtattttatcttccaattcctcagtgttcaacagggacatacatgtagtagaggctacattaattaaaacttgttgacttagtcaactgacaatatatcctccatcattttaaattacaaaaattaaggagactggattaaattaagacttcaaagttcagaataatgttaagtaaaagaaccttccctcgaagtcctaacccttttatgtttgttttcagtcataatttttaaaaagaaaatgtgtaaatggaggatgcaaagagaatgactgttttcccttatctaatttaggaatatgcttaggaatttcccttccactctaacaacccctccatgcaatgataaaaacaattactccatgcaatgacagaaacaattccctatgaaacagaggtagtcatgctagagatttttatagttgtcatgacctagtctaggaagagcacacaaagtaaaaaaaaaaaaatctttctagccacatggtatctcatttgatgtccctatgtgttctcccaatgttattagtcagtaaagcaatttgcagtacctaaacattattaaataagcaacaaagaaagctgtcaattctttattagctttaaagaacattgcgatagtcagtgatatccttaaatgcttgaactttaaaactacaaaggcattttgtgaaagggttacttgggcagcccatactaattaaaagggctgaaaacattactccagcttaagtgggcaaaaaataatcttgctatagtgagtatatatataaataaggaatagaaaaacactatcttccaggcaaaatcttctcattgtatatttcaaagatatagcaaataaatcttttactaggaatgtcagaatactgaaaattcattcctaatttgatggactattcagaattaaaggtagaattgacaattttataaagattctaaaacaaaatatattcccctaaattatacaatatttaatagaatcagccaccccatcaattctctgccttctcaatttcctcgactttgtatattctacacttcacatgtgatcacctcactgctcttattcttaccctgttaggcactccacgataataattcagttagtttttccaacaatcctattattctcattttagaggagcaaactgaggcacagagaggttaaataagttgtccaatgtcaaaagctattaagtttcagagccaagctataaatcagccagtctgattgaagcgatacacaccacctcctgggtaccataacttatttaagccatttccaattggtgtgatttgtttagaattttgtcagctacaccattgctactgcaaatgtgccttccaacaggtatgtttgtacttatttcccaattcaatgctgggacagagggttaatgcattttatattccttctaagtctcagttcagtgacaatcccaactgccttgtgtttctgatcgctcaatttaaaacatatttgaagtagaaagttattaaggataagatgaactaagatacttagttaacaacaaataggagcttgctcaactatatggaaggataacccaaactgcgaggaggggagagtgagttcaacaaagcactacagtcttgggccacctactacaaatcttaaaaaccccatgtaactttagaatctgcctcataacttggttactatggttactaattacattcttattcttttttaaaacagagtgtgaaagtatttaatacattttagaaaatttccatcaaaatatcaatctcctaccatacttaggaaacaaactgcaggtgaattgaaaataacaaatgttgacattacagatgaattaaaacacataaatatgaaataattatataaaagtatataaaaaggaaatatagaagaatttttgtaatagttgtgattttcttaaccaagggtgaaagcccaaaactataaagcaaattacaaatctgactacataaaaaatgtaaaactttagtacagtaaaaatatcacaaaattaaaaactataatatatattactcaactattattcatactagtgtttatcagggcaactaaaaatgtaattctgagatatttttattgacatactggcaaaaatcagtagtgatttacaacatgtattatcagtcagaaggtaggaaaaggggcattttcatgtactgttgatgggagtgtaaaactatcacttttacacttttatggtgtatatttgaacttctgggagactttctggagtatatttgatagaataattaaatactatctaggtaggaaaacagttaaatatacatttcctaaacggaaattttgacactatttatattgaactagggagaccttttattccaacacagaaagatcaccaaaatctactgttcaacggaaaaactcaaattgcagaatatacagtatttactaaactctcattcatgtcataaaaaacataattagacacaaatataaacatatagaaaaggtactcgcaagttgtactccaactgtttacaacagagtttcacagcagcaagggagtaagttgaagtggaatattcacattcagtttagtaggttttctatactattggaattttttataatcagactgtatgaatgtaggacttctataattaaaggattataagatccattaatgttattccaagtgcaaaaacataaattacaaatgtataacagtcctttttttttcaaaaattaaaaaaaaaatttttttaagattttatttatttattcatgagagaaacagagagagagagagagaggcagagacacaagcagagggagaagctggctccgtgcagggagctcgacgtgggactcgatcctggccgggcctccaggatcacgccatgggccgctaaaccactgagccacccaggctgcccattaatttttaaatttatttttatttattgatttttttaagtagggatggaacccaatatggggcttgaactcacaaccctgagagtaagacctgagctgagatcaagagttggacgcttaacccactaagccacccaggagccccaaaaccacgctttcatgaaagacaaaaatgaatgcataattctgtaatatttgaatttttactgtgagcatacttttataattaaagaacagtttacaaaaatgttttcagggagcctggaatgaactacaggaggatcccaactgtaaacgtggggtggagtcagtcaagaggcaaggagaggccagagctaccctgtgcagcccatgcaaagatgtctcccagcctccgggaaggtgcgtggcttggggaaagcaaatcctcaccctgctccttttcaattgagagcattttaggacaagaccagaagaaagcctgtgttccatcaatgaaacaggccctagacagacagacacctgtagttccttagcaaaagatgttaacctatgtctacatatcctgagccttcccaatgggatctcattcccttgtactatgcatcacccagtaccagaaaaagatatttgaaatatgaaaattactcagcctcagaaagactgtctttctgaaaagagggctgagttgtatagaggccgaagaccaagaactgcttttagtcaaaaccagactgaagtgttggaaaatgtctttacagtaaatgctatgagtaatgctggtattaatactggagaagacttcgctcaaaactgaatctagaacaagacagaatccaaatctgtttccaaaatcagcatgcacagctgaaaaaatcccatagagaatcgctgttttcaatggtgaaaacaaatttcaatacaaatctcctggaatagacagaaaactaaacacatgaaatcttacaattacagaatatgaagaagcaatatcaagtgttaaaaatatgttttcttttacgtatataacctgttatcttttttctaaaaatatattgtcaatattataacatggtccctattatatttgggcacttttagttaaaggcctttgccacgtattttaatgaatattttcagaaaaaaagccagctgttttaaagtgagcaaatttaataatttagtttgcttaaaaattttttttaaatgtttttgctgcttaaaaatggcaaactccaaataggaaaaatggcgtcttgcataaatgattttcctgacaatgccaaacaagcaaagtattcattactttctgtattatcttagaacccagaatttttctttgtctaaactgcctttaagatttttaagaaaaatttctaatgagataattttctaattctacttatatagtaaatcctgaaactagtaattcttaagtcagtactatactacaaagttaattgtttcttggaaaaactctttccccagctgatcaggctcatttccctccctcataggtaattagagatttggtattttcctcagtaaagtggtgaagcactcaagggcataccacctgagcacagttgtgaaagcaaggtatttaagaactcctagaatatgtcatattctatgtaagaatttgactaaagtctgagaatcaaaaaaaaaaaaaaaagtctgagaatcaattcattcatgatggttcttgaaagattacattttaaaaaaaaattaaactttgttaaagtataatttatatgctaatattttatcaaatgttccaacgactattcacacagtatttactttaaatataactggagaaatgatattatgtaatggttagtaacaggagtgtgagccagatagacctggatttgaattctagctctgccctctattataaaccttgggcaaattactttttttttttttttttttttttttagagattttacttctttatttgatagaaagagaatgtgggcacatggggaagggctgatggagagggagaagcagactctctgccgagcacagagcctgacttggggctcagtcccaagactctgaaatcatgaacccagctaaaggcagacacttaaccgactgagccacccaggcaccccataaatttcatacttcttgtaaggttctttgcttttaataccaccaaaatcacagggaaaaatgaaaaataaagtatacattaaataacagttatcacttactgagtataactggccatgctcacactgagatgctcacaattcaaaaaggaggaactaacggaaaccaagcctgaagagtatatatttaatcctcaccacacctgcagtagaggaacatttacatttgcgaagcaaggcatctgaaatcatgaaggtatcacatactgagatacctggacctgtatttagggaaacagtatgcatctgatcatgtttttcaatatttggttcaaatattgacttaaggtgctgacaagtcatggaagcatacaaactagatggagtatacatctgtaaatattcaactataatttaaaatttgtccactttactgtatataacacctcaaaaaacaaaaacaaaaacccaccctgcagttacttagtcccatttacactataaactaagtgaaaaagggatggtgtcccctatcagatgccttcagtaacataaatcttcatgtattaattgaatttttaaattaaccctactctatattaaaggcacattgttttattctcctttatcctccgtgtaatcctgaagttccttgaggtctccccccagtcagttggctcaaccggtttattaacatcttgtaactattctttgaccaaaatgttcactgtcaagatcagtctgtctggattgccttttcttaccatcagagtcctagccactgcaactttttaaaagcttaattcacaaactcagttcctcaacctataaagtaaatataccctgtttggaattgttttgtcttccaaattcctgcaatcctactttctgtattttcatttagcacttatatattaccttcttaagtacagtaactgtttttcaattagcctaaaaacttacgaataaggatgtccagtccctgtatatgcccaggactaaagaaccatgtactttaattagtcatctagctacccaaaagacactgcctatgctcctcctggatgccatatgctgagttgggttctgataacaaaaatgtgaaagttctatcatgccgagagctcacaatttattaggtgagaacatgcagtatgatactaaacacagaaaagtctggtcttagaagagaaggatacttaattcaggttgggaaagtaatagaaggaaatctaaggaagcttcttaaaggggcaaagtcttaaaggaaaaaggtggaaagccaaagggaccaacacatgcaaagcatagaggttttaaataacccagagtagtaataatgtcttaaataagtaattgtggttttcacagaatacagaaaaaagaactaaatataaaacactgtccaattttttgcaatacaaagttattgccccccttttaattattcttgagcagagaaccagccttcctttttattgatgcagctattaacagacacttgacatgatgatttgcacacgacagtgcctggtggtgatttcatgattgcaggggaaaaatgctgacggaaagtttttaaaaaatgatcactctcttaaacctatgtaaatcatttgtcaaaaaaacacaatcatatggatatatgcatggttctcacagtatcctttagttagtctaacaaagtctcacctgatccaggagtaataagaggcccctctaattcaagtgcctcatcttcagactggtcatctagctttttcttttttttctttgttggatctctgggttttttcaagagagaaagttcttcagggtgtctgatatctattaaaataaagaagaaagattattttagtagtgtaatggaaaatttaaacactttacacctggcaaatccatccaatataagaattaataatttccttctgtgtatgtttatgttttgccaaatattaatgttactcaaaagactgaagtatggtacttctaaaaataatctaccaaagcgttcaattcatagctttgtagtaagtgtagtaaccgtaaagtagagaaataaccatctgctgggggtactgagaaaatatactagaattcttatatatgtatttgtttttctaaaaccataaaaaattaagatttatatcctagccacagcaactaggcaagaaaaaaataaaaacataccaattggaaaggaagaagtaaaactgctatttacagatgacacaatactatatatagaaaaccttaactactccaataaaaactgttagaactaatcagttaataaaattcaatgaagttgtagaataaaataaattaatatacaaaaacctgttgtgttttattgggggcacttgggtggctcagtctgttaagtgtctgactcttgattttggctcaggtcatgatctcggggtcttgggattgagccccatgtggggctctacagagtctgcttgggattctctcttccctctctttctgctcatgctctaaaataaatataatcttaaaaaaaatactcaacaatattgatcagggaaataaatgcaagttaaaactatgagaaagcattaggtacctgtcagagtagccaacattaataagattgataatagccagtgttggtgaggatgtagaggaactggaactttcatacccagccagtgggaatgggaaatgagacaaattttttaaagtttcacaggttcttataaagttaaacatatacaactcagccatatcacttctacttacttactcaagaaaataaaagcacattatgtaatagatttactcataaaagccaaaactagggaattactcataaaagccaaaacagggcagcctggctcagtggtttagcgccgccttcagcccagggcgtgatcctggagacctgggatcaagtcccacatcgggcttcctgcatggagcctgcttctccctctgcctgtgtctctgcctctccctctctctgtgtctctcatgaataaataatctttaaaaaaaaaaaagccaaaactagaaataacccaagggtacctgggtggctcagtcaatgaagtgtctgtctttggttcagatcatgatcccagagtcctgtgactgaatcccgcatcaggctccttgctcaatatgaggtctccttctccctctgcccttccgccctgctcatgatctctctctttctctcaagtaaatatataaaatctatatctgagttttttcatctgttaaatgagaatattagtacttcaggaggttgttgtgaaaattaaatgattaatatgggtaacgttccttgaacaaggtctggcataacaagtacttcattaagcgctaagtattaatttttttctaattaaaaaattgcaattatggtagaaatttggaaattatgaaagtataaataattgagtcatttaaaacacattcttgaaaaatggaatatggctatgtaagtaagagattacgttaacagatgtataaaattgcactgcgtaaatgtagcataattcaaccattcttctaatactgagcccattataaataatgattttacaaacatatatctgtgtacatatctctccacattttatttcttcaagaattcattggagtggaattaccagatcaaaagtttataataattttaaggcaaaagtggagcaagatggacatgttttttaaagcttagcttatttgaaaaatagtatatttccttgttttaatttacatttccttatttactagtgatgttgtacatcaagagtttttagccatttatatttccttcactaatttttctattaggtttcttcattttttttcctcttaggtttcttcaagtcagagttaattttcatgtaaattgtatagtagcaaatcacactggatttctattttaaaaaatactattataggagcacctgggtagctcaggcggttaagtgtctgcccctccccctgcttatgctctctccctccctctctctctcccaggttttaaaaataagttcaaaaaaccttttaataactatatggctttttctgtttctctgttggttatttgaattttactattaggaacactcaggtacaggtcaggtttttgttttgtctcattattgcacctattttctgggcaatgtttttctgaaatataaaaacagaattaccagaaaaactgtcctgaacaaacaggttaccagagaacaggtgaacattactgtcctttaattattaataaattttaggtaagtacattttaagtactaagcagcagaaccatgttagaattaaatgcctgctccttaaattctgtccctttctttataaaagcttccaggcatatttgatttcctttttcaaaaaataatttttaaaagattcatttattttagagagagaaaaaaacgagtgggggtggggggaggcagagggagatggggagagaatcccaaacagaatctataaggagggctgagcctcacatggggctcaatcccaggaccctgaaatcctgacctaagccaaaatcaagagtaatctacttaaccaactgagccaacccttgatttctttttaaagttaaaaatagtatagcatattctttatagctaaggttacctaattaaaaatccaagattctcttcattcttttttttttttttaagttttatttatttatttatttgacagagagatcacaagcagggggagcagcaggcagagggagggagaggaagaagtctctctgttcaggggggacctgatgtggagcttaatcccagggtcctgggattgtgacctgagccaaaggcagaggcttaactgaatgaggcacccaggtgcccgattctcttcattcttgtatattccaggtaaaaagaggttaatttacctcaaatgtaatttttgagatttaatgcattagcattaattgctttatgtagattcacaaactcaggagatgtttcaagtatcaagtatatcttttgagccatatttaattaatagaattgaatcatttcctagagtacttttaattttaatttctttaaaatgtttttatttatgagagacacagagagagagagagagagagagaggcaggccgagacacaggcagagggagacacaggctccacgcagggagccctacatgggactcaatcccgggtctccaggatcacgccccgggctaaaggaggcgctaaaccgctgagccacctgggctgccctcctagagtacttttaaaataagatttaacattctaagagacttaatcactgatgagtttcactttcaattctcagtgtaccctcggctttaaatgccatcactaccatgttaggagataagaaaggcattatacaatcccaagcttttgaataatcacaacttcagtatcaagtggtggtagtaacctatctgtccatcccattcatctcctcaaagtaattcatgtgaaaaaatctaaaaaaagtataaagggacatataatgagtcatgcctgagatatggacatgcttttaccacagttcaccacagtcaggtttagtgggagaggggaaagcaagcatgtttcatctgaaaaggcatcccaaatgattctggcatgtcccttctgcttgagaatcactataccacatgattcatcctttgagattttcgttcctaggtcatttcctgtccagctattaatattattagaaggatgaatactgttaagtgtaactagcttttgggtcagtcataagaatgtaaaaaagttcttaaccatatgtgtccatgagaattgcttgtgaagttaaaaataatactaaaaatatatgtttcagtcatacccccatatactctgagtgacttagggcttctaacagcttgttttataaaagctctagtgatggacgacattaagtagatttactgtggggatcatttcacaatgtatacaagtatcaaatcattatttcatatatttgaaactaatatgtcaattatatctcaaaaaaaaaaagctccataggtaattttgattccaacttcttgacaaccagtagcttaatgaaggggtaagtggaggaagaatgacatcttatttctcaaatgataggcacatctacattggaacaaggtagccactctctatacatgaagtctgaataggttttcattataacaaaaaggtaaagtaaatctacacttccacataagacactaattatttcattcataccggaatttaggactgattcactgtgttttgtttcaagaaagaattaaactagtgaatttagaaatgtgaatcgcatgtaaaagtaggtctggtgaagaaaataagtaatttaaactaagtttatatttaacgaaaatacacctggaggactattttaaaatgggtataccaaaataccgtgccttcattcatgctcaattttatacttcaataatataaactagtattatgagtcactacacaaagtaatgatccaggacttctttataacacaaagatatactacatagcaatgaaatgtaatgttcaaaatcagtatgttatcaagtagaagacaaatctagtggaagatggactacataaatgctatatatatatatatatatgtatcaaactatggggagtgaagaaatggggaacagagaagcacagaagggttttcaggtaagataatcagattttatcttgttttttaatttaaattcaattaattaatatatgatttattaagttgcagaagttggagtcagtgattcaccagtctcatataacacccagtgctcatgacatcacatgccctccttaatatccattacccagttacctcatcccctcaccccctcccctctagcaaccctaaatttgtttcctatgattaagagtctctaatggtttgcctccctctctgattttatcttgttttattttttcctcttttctcttctgatcctctgttttgtttcttaaattccacatgagtgagatcgtatgataatggtctttctctgattgaaggataatcagattttagtttaaaaatattttgttaaagattttatttttattttttacacagagagtgcgtgccagagagcacaagcagggggaacagcagaggaagagggagaagcaggctccttgttgagcaaggagcccaacgtggggcttgatcctaagactctgggattaagacctaagccaaaggcagatgcttaactgactgagccacccaggtgccgctaaaaataaattttgtcgtgagaatttctcattaaacatgtatattgaccatgagagactcctaactctggaaaacaaacagagggttgcacaaggggggaggatgggggaatggggtaactgggtgacagatactaaggcccttgatgggatgagcactgggtgttataccatatgctgtcaaatggaatttaaataaaatattttttaaaattaaaggaatctgaaaatctcaaaaaaatgtatattgagcttgtgcatttattttcaatcctctctaaaatcatactaaataaattaataaataaaacatgcacttataaggacaaaaagaatagtaaaaaacatcacataaaaaaaagtcaggggcatctaggtgcctcagttggtttaagtgtctcccttcggctcaggtcatgatcccacagtcctgggattgggctccctgttcagaggggagcatgcttttccctctccccttgtcttccattctgcctacttgtgctttgtcatatagataaataaaaccttaaaaaaaagaaaagaaaagaaaagaaaaattctgggagacaaaagccagagtgggagagtagtaaatgacttaacaaaaggagaaaaataaaatcaagatgtttgcaaaaggaaataccaataggaaacacaatgactcatagtgccaaatatcaagcatgaccaagcactaaaaacagacaaaaatccaaatcctgtcccatattggattaaacctaccccttagatacatgccttttaggatctcttagaggagaatctaagccctacggaacaatcttttagatactgacatttgataaagcttgctcagtgtctaaataccccagagaggggtgacaagctaaacctcattccatgcagaacttcctattgatatttgtagtgctctattattaaatgtatgaatggacaatgattgagagacatctgagaaagggctctgtggtaggtttcacagttctagaggttaactcctttaaatttctgtccccgattatacaatcatacactaatttaggactgctgtgaagagactttgcaaatggaattaaggctactaatcaactgatttaagggagattatcctggatttctccatgggtccaatgtaatcatatgaggtctgccaaacagaagaggaaggcagaagaggtaagcacaagaaagatgagacagaaggagaggtcagatagatgtgaagggagtaataaaaactggacttgctattgctgtttttgaagacggaggaaagaagtcatatgtcaaggaatttgggaggcttctacaaactgagaatgccagaggtctctggcagacaaggtaggagaaactctggccccacagccacatggaaccaaattctacggtgaataattctttctcagacccttcaggaggaacacggttttgctgacaccttactttcagctctataagactaactagagggatccctgggtggcgcagcggtttggcgcctgcctttggcccagggcgcgatcctggagacccgggatcgaatcccacgtcgggctcccggtgcatggagcctgcttctctctctgcctgtgtctctgcctctctctctctctgtgactatcacaaataaataaaaattaaaaaaaaaaaaaaaaagactaactagaacaccaatctgagccacactgtacccagatttttaaactacaggaacagtgagataacgaatttgtattgttttaagctgctaagtttattttattttgtttttttaaagattttattgatttattcatgagacagagagagagagggaggcagagacacaggaagagggagaagcaggctccctgcagggagcccaatgtgggactcgatcctggttctccaagatcaggccctgggctgaaggcagagctaaaccgctgagccatctgggctgcccttaagctgctaagtttatgataaaatttgctatggtagcaatggaatggatgtactgagcttctaacatgaaaaacaccaaatgaaaaggaaaacaacttgggagaaccagagatactgctggaaacagaaaaacaaaacaaaaccttcttaaatacaattctcagaaagtaagatgacatctatgacagacaaataggatgttgtaaacaataactagcaattaacaaagagatatttgaagatacagtgaaaacagttctaaggagtgcctggctcagttggtagagaatgcaactcttgattcagggttataaatttgagcctcagatttggtacggagattacttagaaaaacaaaataaaatcttaaaaaaaacacagttctttttttgtttaagattttatttatctgacagagagagaaagagagcacaaggagggggagcagcaggcagaatgagagggaaaagcagactcccctcggagcagggagcctgatgcagggctcaatccaggactctgagatcataaactaggccgaaggcagatgcttaaccaactgagccacccaggcacccccaaaaaaagttttaagagggaatatatagtattacaaaggcctactcaagaaacaaaaaagaaagtcaaataaaccatctaatcttacacatgaaggaaacagaaaaagaagaataaaccccaaggtgagtagaaggaagaaaataataaagatcagagcagaaataaatgacatagagacaaaaaaaaacacccaaaacataacaaaaatcaatgaaattatgagataaaattgataaacccttagacttaccaaggaaaaaaagagaaaggacccaaataaataaaaccagaaaagaaagtcttgaagtaaaaactggccccacagaaatataaacgactgtaagagaatggcatatgaaaaattatatgccaacaaatagaacccagaaaaaaatagactaatttccagaaaaatactatcttctaaaactgaatcacaaagaaatagaagatctgaacagactactcataattaaattgaataaaaaacctaccaaagtccaggaccagatggattcatgagtaaattctaccatttaaagaagagttaatacctattctcctcaaagtattccaaaaatagaggaggaaagaaaggttccaaatatattctatgagaccagcattacccagataccaaaaccggaaaaagaaaagaagaaaagaaagaaaaaagaaaagaaaagaaaagaaaagaaaaaagaaaagaaaagaaaagagaaaagaaagaaaagaaaagaaaagaaaaaagaaaagaaaagagaaaagagagaaaagaaacgaactacaagccaacatccttgaagaacacagatggaaaaatcctcaacaaaatcttagcaaaccactttcaacaatacattaaaaagatcattcaccagaatcaagtgggatttattctggagatgcaaggatggcttaatattcataaatcaattaacatgatacaccacatcaacaaatggaaggatagagattatataatctcaatcaataccaaaaaagcatttgacaaaattcaacatccattcaggataaaattctctgtaaagtgggtttagagagaacatacctcaacataataaaggccatctatgaaaaacccataactaacaatatactcagtgctaaaaacaaaaaacaaaacaactttacctcttaagaacaagacaccactttatttattttttaagattttatttatttattcatgagagacacagagagaggcagagacacagacagagggagaagcaggctccatgcagggagcccaatgtgggacttgatcccaggactccaagatcatgccctgagccaaaggcagacgcttaaccgctgagctacccagtgtcccaaagacactactttcaatcaacatagtactgaaagtactggaaacagcaatcagaaataagaggcatccatactggtacaaaagaagttaaactgtcactatttgcagatgacatgatactatacattgaaaatcctaatgacttcaccaaatagctactagaagtaatcagtaaaattgtaggatacaaaacacccagaagtcagtagcatttctatatactactaatgaagtagcagcaagagaaacaatgggacagttgttaagaaacaactctgcttataattgcaccaaaaagaataaaatatctaagaacaagcttaatgaaagaattgaaagactgtacaataaaacagataaagaaactgaagatgacacaaatggaaagatattccatgtttagggattaaaagaattaatattgctaaaatgtccatacaacccaaagcaatctacaggttcaatgtaatctctatcaaaataccaaaatcatttttgttttttgttttttttttttaatttttatttatttacttatgatagtcacagagagagagagaggcagagacacaggcagagggagaagcaggctccatgcatcgggagcctgatatgggattcgatcccgggtctccaggatcgcgccctgggccaaaggcaggcgccaaaccgctgcgccacccagggatcccgcaaaatcattttttttaagatttttatttatttattcatgagagacatagaggcagagacacaggcagagggagggagaagcgggctccatgcagggagcccgacgtgggacttgatcctgggcctccaggatcctgccgtgggttgctggcagagctatactgctgagccaccagggctgcccccgacatcattttcacaattactactaaataggacaattactactaaaatttttatgtaactacaaaagaccctgaatagccaaagcagtctttagaaagaaaacaaagctgagggtatcacaattctcaatttcaagatatactacacaaagctgtagtaaataaaacagtatggtactggcataaaaacagatgtactgatcaatggattagaacagagcccagaaataaacccatgcttatatggtgaattaatatgtgacaaaggaagcgaggtaaaacaaaacaaaacaaaacaaaacacacaggaaagacagtctctttaataaatggtgccaggggatgctcagtggttgagcatgatcactggggtcctgagatcaagagtttccccatgggaagcctgcttccccctctgcctgtgtctctgcctctctgtgtctctcgtgaataagtaaataaaatcttttttaaaaaatggtgctggaaaaactggacaaaatattagcaaatcgcataaaaataatgaaaatggattactttctaacaccgtacacacacacaaaaaaaacctcaaaatggattaaagacctaaacatgagacctgaaaccataaaaatcctagaagagaacacagacattctctgagagtgaccacagcagaatttttctaggtatgtctcctgaggcaagggagacaaagcaaaaattaaactgagactacaccaacataaaaagctgttgcacagcaaaggaaaccattaacaaagcaaaaaggcaacctactgaatgggagaagatatttgcaaattatttatcacataaggggttaatatctaaactacataaagagcttatacaactcaacaccaaaaacacaattcaatttaaaaatagattaataggaacacctgggtggctcagtggttaagcgtctgccttcagctcagggcatggtcctggagtccagggattgagtcccacatcgggctccctgcatggagcctgcttctccctctgcctgtgtctctgtctgtctctctctctgtgtttctcatgaataaataaaaccttttaaaaaatagattaatagacattttctcaaagacatataggtggccaaaagacacacagaaagatgctcaaaccactaatcttcaggaaaatcaaaatcaaaatctcaatgaggtatcacctaacacttgggatagaatggctaaaatcaaaaaggcaagtaataagtgttattattagcaaggctgcggagaacaaggaaccctcatgcacttttggtgggaatgtacactggtatacttactgtggaaataaaaatggagttttctcaaaaaaaaaagaaaacaaaactataatatgatccaataattctgctactgggtatttatccaaagaaaatgacaacactaattcaaaaagatacatgcacccttgttaatttgcagcattatttacaatagccaagatatggaagcaacctatgcccagtgacagatgaatatcggatagggaagatatggagtgcatatatataaacatacacatacacaatggaatatatgcagccataaaaaggatgaaatcttccattttcaacaacatgggtagacctacatggtattatgctaagtaaaataggtgagactgagaaagacaaatactgtatgatttcactcatatgtggaatcttaaaagaagaaaaacaaaaagcagaactagatctataaatatttacaaatcatataactaagaagtgattaatatctaaattatagaaagatctcatacaactcaataacaaaagcaaaaacatccaattaaaaatgggtaaaggaatgggatgcctgagtggctcagtggttgagcgtctgcctttggctcagaggtccagggatcaagtcctgcatcgatcctgtgaggaacctgcttctccctctgcctatttctctgcctctctctgtgtgtctgtcatgaataaataaataaaatcttaaaaaaaatgggtaaaggacctgaatagacattttcccaaagaagatacacaaatggtagacagatacatgaaaaagtgttcaacatcactaatcattagagaaatacaaaccaaaaccacaatgcaatgtcacttcatacctgttagaatggctattgtcaaaaagattagtactggcaaggatatggagtaaagggaatccagccacaatggaaaatagaatggaagttcctcagaaaattaaaaatagaactactgtataacccagcaattctacttctggtaatataactgaaggaaatgaaaccactatcatgaagagatatctgcgcctccatgttcttagcattgtttgcaatggctaagaaaaggaagcaacataagtattcactgacagatgaatggataaaaaagttgtgatacacaaacacagatattattcagccataaaaagaaggaaatcctgccatttgtgacaacactgatggaccttgaaggcattatgctaaatgaaataaagtcagagaaagatagatactgtataatctcgcttatatgtggaacacaaaacaaaacaaaaccaaaaaagtaaattcatagaaagagagagcatatttgtggttaccagaggcaggaggtgaggagtggggggaactggatgaaagtggtcaaaggtacacacttaagttataagtaagtactagggatgtgatgtatgacatgaagactatagttaatgctggtatggtatatttgaaagttgttaagagttacaattgcaaggattttgagtgcacgtgtgtgtgtgtgtgtgtgtgtgtgtgtgtgtgtacctatatgagataatggatgttaactttggtgatcattttacagtattacttaagttattatgctgtacaccttaaatgtacaccatgatctcagtacaactagaaaaaaagtgtttggtagaattcaccagtaaaccagtctggccttagtgctgttttggaaggttattaatttattgattcaatttctttaacagatacaggtttactcaggttgtctatttcttatgtgagtttttagaagattggctgtcaggttttttatttagtaaaaattatgttggctcaggtcatgatctgggggccctgggatagaaccccacactaggatccgtactcagtggggaatccccttgtccctccctctcacccctgcttgtgccctctcagaacaaatcaaatctattttaaaaaagagcttatgacatagggcaggggggtaggttaaatagataatgggtattaaggaaaacacttgtgatgagcactatgtgttgtatttaagtgacaaatgactaaattctacacctgaaactaataagtacactttgttaactagaatttaaaacttgaaaaaaaaaaaaaagggcttaaaacataaaaccattttattttatgaataccaacaaactaattctaaggtttttttttttttaatttttatttatttatgatagtcacacagagagagagagagagaggcagagacacaggcagagggagaagcaggctccatgcaccgggagcctgacgtgggattcgatcctgggtctccaggatcgcgccctgcgccaaaggcaggcgccaaaccgctgcgccacccagggatccctaattctaaggtttatatggaaaggcaatacacctagaatagccaacaccatattgaaggagaaaaacaaagttgaaggactgatgctacatgacctcgagacttaatataaagctatcataatcaagacagggtgctgtctagcaaatagatcaatggaacagaatgtagcatccaaaaatagatcaatataattataggcaactgatctttttttttttaagattttatttatttattcatatgagagagagagagagagagagagagagagacgcagagacataggcagagggagaagcaggctccatgcagtgagcccgacatgggatttgattctgggtctccaggatcatgccctgggctgaaggcaggcacttaaccgctgagccacccagaaatcccggcaactgatctttgaccagagagcaaaggcaatacataggagaaaagatactttttcgatacattatgctcgaacaactggacatccccatgtaaaaaaaaagaatctagacccagactttatactcttcacaaaaattaactcaaaaggatcacagtccaaaatgtaaaatgcaaaactataaaacctctagataacacaggaacaaaatctagataatcttgagtttagtgatgagtttttagatatgacaaaaaagacatgatcgataaaagaaataactgataagctagatttcattaaaattaaaatttccgggatccctgggtggcgcagcggtttggcgcctgcctttggcccaggacgcgatcctggagacctgggatcgaatcccacgtcgggctcccggtgcatggagcctgcttctccctctgcctgtctctctgcctctctctctctctgtgactatcataaataaataaaaattttaaaaaaaaaattaaaatttcctgctctctgaaagaaaccgtcagagaatgaaaaaacaagccagagactggaataaaatatttgctaaaggaatatctaataaagtaccattttccaaaatatatactaaaaacttaagaactcttgaaattcaacagtaagaaaacaaactgattaaaaaataggtcaaaagggatgcctggatggctgaaccagttaagcatctaactcttgatctcagctctggtctcaatctcattgtcatgagagcctagttggggggaggggggggggtggttaaggtccaaagaccttaacactctcctcgacaaagatgatgtacccatggcaaatgaacatacaaaaagatgctccacatcctatgttatgaaggaaatacaaattaaaataacaatgaggggcagcccgggtggcgcatcggtttagggccgccttcggcccggggcgtgaccctggggtccagggatagagtcccactccctgtgtcgagcctgcttctccctctgcctctctctctctctctgggtctctcacgaataaataaataaataaaatcttaaaaaaaaaataacaatgaaatgtcactgcacattagaatggccacaaaccaaacactgacaccaccaaatgctggtgaggattcagagcaaaaaagaattctcattcattaccagtatgaatacaaaatggtgcagctactttggaagaccgtttggtggtttcttaaacaactaaatatttttaccatatgatccaacaatcacattccttagtatttacccaaaggagttgaaaacatacccatacaaaaccctccacacagatatttatagtagctttacttatactgcatatcttagaaaaaactacaatacccttggtattggtaggtacataggataaataatctgtggtacatccagacaatgggatattattcagtgctaaagtgaaatgagctatcaagccataagacatgaaggaaactcagatgcatataactatgcaaaagaaacaatctgaagaaactacatactgtatgactccaactgtatgatatcctagaaaaggcaaaactatggagacagtaaagagattaatggttgccaggggttagggaagaaggaaggatgaaaaggcaaagcacagaagatttttagggcagtgaaactgctctatatgatactataatgatggatacatgtcattatgcatttgcccaaacctacagactgtataataccaagagcgaatccaaatgtaagccacggactctagatgatgtgttggtgtcgatttaccaagtgtaccactctagtgtgggatgttgatagtggggaggttgtacatgtgcaaggatagggaataaatgggaactctgtactttctgcttaattttgttgtgaacctaaaactgctctaaaaaaataaagtttatgaactaaaaaaaaaaaaaaagataaatcatataaatgggtaagtcaaaaaagaaccttagatggctaataaagatatagaaacattcttaactttatcagctttgaatgagaaaatatagtatttcattttagaagtaaacactaaaaactgacaacattcaagtgtttgtgatgatttgggacaatggatttttatacattgctggttgtaatgtaaattggtaaagcagtcctcccttatccacgatttccattaattgtagtctggaagcagatgatccttcttttgatgtatcatcagaaggtcagcttaatgctgtgtcacagtgcctatatccttcaccggacttcatctcatgtaggcattttatcatcacacattatcacaagaaggataagtatagtacaataggatattttgagggaaagaccacattcacaagacttttactatagtatattgttataatggacttattttattattgttaatctcttattgtacctgatttataaattaaactttatcacacacacatatatatatatatatgtagaggataaaatacagtacatttactatctgtggtttcaagaatctactgggggtctttgaacatacccctcacatatagcaggggactactgtatagccacttgagaaactcctacatacaaatacaaaactgaaaacaaaaccccacaaagtaatggcactaacataatgtttatggatctaaacagatatggaaaaatgaatgtgcatgttggtgtgttactaatgtatttttaaaagtactagaaggttatatactaacttatgacagtggttgctttgtgaagacaaattataagaatgtgactcaagaactttacctctattattgtgacttaaaaagttttgcaaaatggcagttattaattctaaaataacaggaattaggtaagtttcatataattccttatacttttctgtattttaattttttttcctaaaaattccatcaagcataaaaaaaacactgtaatttcagtcattagatcaaaatagtaatgtcctgcatctcctctaaatctatggaataatagagttatgttctagtaataatgacaatagttcacattctctctgatggccgaatacttcctgtcacatgacataactgggtcagccaaaagtaacccacatttcatttcagaaagcataaacagaattactacaagagtgttcaagttgtagactgcttaaggaaggtaacactcatggtcatttcctttagagctgtgtcaggcctttagtgaaggaagtgacacaatgtgctcaatcactaaagtcaaatagtgacttacctgaaggaaacattacaaaagctacatcctgaaaataatgctttttccttctccttcccgagaaataaattaagtcatcagaatgaagtattatataataatacatacctgatacatttctagcaagaaaagaatctatgttagactcctcctgttccatcttactttaatatttatcttgaagtgatataaaacttccaagaataaagtgaaaaactgacatacacatacatacatagctcaccccagcctactctttgaaataagctcagtgttaatcatcagtcatacatatttcacataactcatagnnnnnnnnnnnnnnnnnnnacagatgtcagaaacagctttgaagactctatcagagaaattcactttcaccttcacatacttcatgttgggaagctgtaggcgaagcagtttgtgctggggggtgaactgaagcttagcatctgcctgaatgccatacttatccaaggtccaatgtgttttaagaagccaagttctcttcttttcccaccagagagcatgatcagaccaatctttttttacatctataaaaacacaagcaatacacaaaacatttaaaaacacttaaaaatcactaagattacttcgaaagaaattatatgataactaaattggatatttaatataagcaactaattaaatattgtcttttatgtgatgagtataaaagaaatactaaagagcagagaaaacattctgtgcccttgaaagcccatacatgaggtagctgacgcagaattattagaacactaataatgcttataccaggtacaatatgggacacagggatgaagagggtcctgagactgagcctgggactccaaggattcccttttccttggttcctccacccccgccctacccgctcctgtgcacattctgtctcaaataaacaaatttttaaaacaaaaacaaaaaaagaaacaaagccttccagggaaagaaaaaaaaaaaaaaaaaaccctggaaaataacatttttggaaacaaaaactactctcatgattctgataaaaagatcattttaatataagttttaaaagccttggtcaactttaaaaaaaaaagagcttaaaagcatatactttttttttttttaacacaacttgtatacctgaaagcctcacacagtaaaaaataaaatttccacatcatgtgcctagaaacaccttcttcaatggtgaaacttaaatcacatgactgaatttctcattgtggaagaaacacaaatggaaaaagtcttcaattaaatccccagacattaaaaaaaattaatcagtaagtaatgggagaattgtagttacttctgactacattgccactttgaaattttaatatttgttttggaaaaacccagtcaattatgtcaattgaagtttaattgtattaatatatataattcctattttataactactcacttaattgtgagacacactgtatgtagtaccctgcatcttttttttttttttttaaagatttcatttatttattcatgagagacccacagagagagagagagaggcagagacacaggcagagggagaagcaggccccacgcagcagggaacctgatgtgggactcgatcccaggtctctagaatcacacctggggctgaaggcggcgccaaaccgctgagccacctgggctgcccagtaccctgcatcttaaattattttccagcacagaatttgtcaattaactttaaatactgaaaatcttatctaacattaaaaaccaccaaggttggaaccttttcatttattgaggtaaatggtcacacacattatataaagggtttacttttcacgaagagagaacccaaaacaggaaaagataactgcaaagaatgaaccaatttgagtaagtctgagctgaactgaattaatggtaggtaggcatatattactttcctccccatacctcagtccattcactcttctgtcctctgtgccaatgtcaaccactaaggaagacctatctccccagtggggggaaaagggaagaaaaagctgtatcctcctcctcctctgtaaacactgatatatcatttggattcccccaaaaggcaaacctgagatgagaactttgaagggaagcacactttgaagggaataggaagtgagacggttacagagaagtgtattaagggttcactgactactgtgtataactgggagttcagtcctgctaaagaccccctgaggaattatgtagaagatgcctaagacttgtcccacctaaggaaacataaggtgaggtatctatctacttccttggttgctcccaaggccattaaattcctactactttctggctgtcaatgcatatagctggccacccttcactcaggcagacccacaaagccccaaatatttgtatcaggacttttacagaaaaacttcatgggtctctgatgaatgaaaatctcaactttccatcaattaggttttgaactctaaactcagaaacagctaactctcctgatcttcctctaaaaatctgaccctccctatcaattccacctcccttcctcacaacaaaggagcagcccacctgcatccagcaagaataaacaagggaatgttatgtttcaaaatcatcactgataattctgaagaactacaggaaacagagtgaaaatgagagatacataaattaatgtgggagtggaaataaaagtccgagtagcaatggttaggcagtgaggaagtagtgataaggaatacagagaacttttcctgagtactttgttacaggaggagcacaataataggatggcagatggacagaaagtggaaagcaaatccaaggagtatttttagggtttttttttccatttttttaaaagattttatttatttattcatgagagacagagagagagacagagacacaggcagagggagaagcaggctcctgcagggagcctgatgggggacttgaccctgggtctccaggatcaggccctgggctgaaggcggcgctaaaccgctgagccaccagcgctgccctaggtttgttttaaagaagagaaagttgaggcagcctgatggctcagaggtttagcgccgccttcagtccacggcctgattacgagacctgggattgagtcccaggtcaggccccccagagggagcccgcttttccctctgcctgtgtctctgcctctctctgtgtgtctctcatgaagaagaagaaagaagaagaaaacaaagaagttattacaagatcattttttaaaagaattacattttttaaaaagatttattttagagagacagcataagtaggggggagaggcaagaggggagtagccaaggaggagagaggggaaatagactcctcactgagtggggcaccccatgcagaaatcagagctcgtgacctgagccaaaaccaagagttggacgcttaaccgactgagcctcccaggtgcccctacaatgtcattttttttttaataggctccatgcccagcctgaactctccaacctgagatcaagagcctagctgagatcaaatccaatgcctaaccaatcgagccacccaagtgctcctttaaaaagtgattggaatgataatataaaactcaaaacgcatttacaattaccatttcttaatttgctcttcagcacagtcattgtgtctgtttcacctcaaaactttttagaaacttgattaagctctcttaaatacacaaaataatgttttctcaccttctagaaaatcttcctttgctgctggctttgtataacactatgtatcctacttcaaaactagtaataccttcacctcaagtaccataactggcttcacccagaatatcacaagaatatagctgttctattcagaagcagcaaaaatgaattttatacactgataaaaatcctgagaaaaacgatgatctaccaattgagaatcactcaacaaggcaagtgtaagagccaattgtacatcaaaaatacttaacaaattttgtatgtatgtgtaaagcagtatatcttaatgcagtaactcttgaaagtacttaggttatctagtatgctacagcacagcttgtctccacagtaataagttaaactatactatgtcaactgtaactgatataaacacaatgtgcacaggagatttcaaatatcaagatatatatttatatattcctccaatcaaagactgagtagaagcataaaaactttgattttaaaagtaaaatggtcatctataaaatcactacaaataaataatgaaaagcaaatgaaaatgctggtgattcataaaataatggcttattttccttatgtggcattacaatttataaagaaagttattgaagttccctacatgtacataatgaaactttagaacaactttccatgtattttactcccacatcaaaatctgaaacccgcacctgttctaataaacatttctaattttttagaatggcagccttagtgtttcaaacatagcattagacaactaaatgcaacacacacactcacacataagaataatcagcctggggcacctgggtgactcagtcaattaagtgactgactcttgattttggctcaggtcatgacttcacggttgtgagatggagccccacgccaggctctcacgggttgtggaggctgcttaagattgcttaagattctctccataccctcactctcaaaacaaaaacaaaaacaaacaacaacaacaacaacaacaaaaccatcagcctggcacttgccatggtaggagttagcaagcatcaccataagggggacttgtttcatcagcattataaaaccattcaaggggtagatcatgctcaacaatatgttctagtagtcaatttttccaaagttaattttcagttatgctccaggtatagtgtaaccaccttcttttatttggtatattgtgactttaaaatattttatctagattttaagaggcaacacactataaatacaaacctcagaaagaaaatctaaggggggaatactataaagtcattttctctcttgcagtagaaaagacatttctttctttattcataaatctagcctttttcagaagtcaagaactatttagattatggttccataaaccaataaaggtcatctataatacttttagtaatatacgtcaatttttcaaaaacactttgccagcactgagtaatgtatagaattattgaatcactatattatatgcctaaaactaccactgtttgttaattatactagaatttataaacttttaaaattaacttaaaaaaattttgctagaattctggaaagaattattgctgtgttcctcccttatttaatagatccaatcatgctgtgctctgttccacataaaagtaacactatctgacactcaaatttacatcattaaaattgcaaatggctaaaacattaactgaatcaataaaaatctctcttgactaacagaatgctcttcaaattcaagaagtagttgagtatttaacctacaaagacaccatttgtgtattctaaggaacaaaacttaagggtttcattattgtgaggctgagtatacaaacattgcttattctaccaaatggcctttggagcattcacctgctccatgactccaggagtcacaaaaaaaaaatcaagtatttcaaaaagctttctgctagggaaaatactatgtccctctttttgcaatgatagcttccttacactctagaaaatataagcacagagaaaggggatacactattaatactctatttaatcttttcctattagggccacaattccttcttaactattttattatgcaattctaaaatgtaattatttactttcattttttaaaaaattttaattgttgggaaaccccggtggcgcagtggtttagcactgcctgcagcccggggtgtgatcctggagacccaggatcgagtcccacatcgggcttcctgcatggagcctgcttctctctctgcctgtgtctctgcctctctttcgctctctctgaataaataaataaatcttaaaaaaatttttttaattgtttaaaaagtaaaaaaatgacaaatagaaagttaaccaaattaacttatttttaagtaccacatttcaaaaataagtaacttattagtaacaatttgaaacaaataggaaacaaaatgttacttttaagtggcttagatttctgttgcatatttaagaaataatattcaggaaggaaggaaatacaaaatttgtttagcattctcataacttcataaaccagaagcaaagtttacattagataatctctggtaagtcaacattttgtattaaattataagtacacagatgctttctgggcacatgccttattttttagtaatatttttctgttgtgctaatatacagtttgtcctgttccgttttattttagcatcctcttaaaactccaaattaggtagtgttaactattgcatgtcaagaattcaccctgtctttaatgatggcaaaaactcttcaatcctagtaagctattaacaaagctactaagcaactggttctgacaccactgcgaactagccatgcaaactgaccagaccagatatcataggccagtgtcctcttgacctccaaaataagactttagaactccatcacaccatttacttattccacctagttactcatctaccaaactcagattttccctcattcatttatttcacaactagattgaaacaatcacaggcacacttccttttatcatgctttgcagatactctgtttttttgttgtaacaaactaaaggttgtggcagcctttgtacctgcatgggtctctgcctttgtcttataataaaagaagtatctatttatctcaaaccaatcctgttaactatgctctgctgccctactcaccttctaggaaccatacacttcttacactggctccctaggtatctcatccattaccgcggctttaaatgtcatctatacattttatctacagtccaaacttctgcttagagtaccagcttatacatcctactgcctatctcatttctccatctagatgtctcacaggcatctcaaacttcatatatccaaaacttaacccaattttctcttatctctactattactaaatagcactaaccatcaacccagttgctcaaaccagattctagaagtaatagatccttcttttcccaccattccccacatttatcagcaatcctttcagtttaacttccaaaaatctccaatttccactagcatgaacccattttgtttaggtcactagcatctcttccactgattactgcaatagcctgactagcctcctgattccattcagcaccttccacacaacatccaaggtgatccacttaacactcatgtcattctcctgatgaaaataacagcttctaaatgcactcaaaatccaaataccttatcgtagtctacaaaggcccacacactatggcccatctactcctctgaatttattttatgctactcttccgtctgcttcaaccacactttccttcttttctccaagaactaataagtaagctctatcttgcctcagtggctttgcacacactattccattctgaatgcaaattctcttatctttctcaaattttagtttaaatttcatattcccagagaagtcgtttttagccaccctaagataaaccttccaattgacctatgtccctctgttattctctatttcagtacactgtgatattgatgatcaaaatttgcattcattgtttgttgttcatgggaggagtgtctttcttcccaattagactatatactctaaaacaaaaacactgtctatttcagtcaccactatattactacacctagcacgatgcctggcatacaatacctgaaaaatgaataaatcctcatattgaaaaatttaacgatccttcattactaccccaagaatgtattgccccaacaggcaaagtatccttaaaacatcaagaaaaataatatgtaaattaattttaaaaatccactttgtcttcaacttcagaagtaaaacatgcttctataacaaccagaagcacaacagagatttcccctagatgtggagaaatcaaactgaattgacttcctcttcttgctcacatcttctaaaaaggatgaattactttgtcgaaggcaatcccttttatgcaaaatgattatattccaaaaattcattttttggtttgaaagttcagatttgccacaaagaaatatcataaacaacagttaggttccaaatcagactgctgcccaaatctaaaatgacccaaagcatattactaacaatattatatcacactaaacaggtatcacaaggttttttggaaaatatatggtcagtgcttcaacacaagatgtaaggaaaactgctagcaatagcacctgcagagtgtgggttagagagggaagaacgagaacacggttattaagttgtaagggagacaagggcttccgtctaactaacggcactgggcatctccctagtcctctttccgcaactccaggaactaacctaccttcttcctctttcccagctgtaatttactgtgttaaggcaaggtttcttacatttactaagctaccgacagtagaagcttttgtttctgctttcctctctatttgctaaaacaaatacacaactcttctaatgtttctaatgagatgtcattgccaataatgtgtaaagacaagatctacaagtaaaattaatgcttaaataggtttattggtttaaaaatgatatctatgatgttatctctaatatttattgaaatttaaggacagcagatcttttttttttttttttttaaggatagcagatcttaatttcaccattcaatcacatattcttttgtcctgaagaactccttactctcacccctttaggtctccttcctctcaaacttttaatttcagaggtaaggatgctgaagatcctcttcccttaattttaggtgtgccttcttgttctggtctctttaattactcagatcttcaaaaagggaaaggggaagtaaaatgaagactgttattcttcaggtacacaatcaataaattaatccataaacattttccaagtacctaccatttgccacactacacttggccactggaatataaaattagcaagtaagaactcccatccaagagacatacatagtccaagtaagggacacagacaagtaaaatgagctaaaaagataaaagaacaaaatgctacagaagcaaccaactttaatgtcaaagaggaatgaggttctaaagatgatgttctacccatcttatgagatgtgggacttccaacatgtgctaagaggaacaaccctataaacaatggagtctccaaatcagattgtgatggaattatggagaatgaattaggaagagtctggcaacaagacatttactgcaatactctggaagcaggacctgacctcaggaagaagctaaagaaaaagagccaaatatgagaaacatgtctaagaatcacaggtcttaacaagattgactatcgatgagaaaagatagctggctgcttctccccctgcctatgtctccgcctctctctctgtgtgtctctcatgaataaataaataaaatttaaaaaaaagaaagaaagaaaagacagctggaaggcgaagagaaaagctagaaagctcctagcttgagaattaaacggacagtgacaaaagcactaagatttgtttatttaacattaaatatatgccaggagcacttaatacactatcatttaattctcccaaaaatcccaagtagagaggtagttccggttccggtgcggggactttcgttcctggtgttcagttgtcgcagttggtgggtagtaactgagccaagatgctgcggaatctgctgactcttcgccagattgcccagacgaccataagtactgtttcacgcaggcagtttgaaaataaagttccagagaaacaaaagctatttcaggaggataatggaataccagtgcatctaaaggatggagtagctgatgccctcctgtatagagccactatgatgcttacagttggtggaacagcatatgccattattagctagctgtggcttcttttcccaagaagcaagattgacttcagttcatctcagcaggcagttggttcagtttcattcagctctctatggaccagtaattgataaactcaatatttattgacttatactaactgccaccaataaagcagtctttaccatgaaaaaaaaaaatcccaagtaataaatactgtttaatccttgtttcgggagatgagaaaaccaaaggacagaggaattatataacctggcccaaggtaaaaaaaaaaaacaaaaaaaaaaaaggctagcatatacagaagtgagactttgaatccagattagtgtgacttccaaactggcatttttgggatacctggatggctcagcagatgagcttctgcctccagctcagggtgtgatcctgatgtctgggatcaagtcccagatttaaactctcctgtttcaacaatctccaagaaatactaatttaaaaacgcaagacacagaatgttgtacatcatgagctcccatcccaattgtgggggaaaaaaggggaggataacacactaaaacctatgctcatatgtgcataaaatatctttgtaaggaaatataagaaacctgtagcagggttgcctctgggagagaagatcaggtgtctggggttgggaggtttacctctttttctactctaagccctttgatattgttctaatttctaccatgcactccatgacttttttttttttttttttaaggctggaaacaaaataagacaaaatggtaatggttgctagtttggggtggaaggaatgtggttttattgtattggttgcaattttctgtagttttaaaaatgaaagttgcaggggcagcccaggtggctcagtggtttagcatggtattcagcccagggcatgatcctggagatccggaatcaagtcttgcatcaggctccatgcctgcttctccctctgcctatgcctctgcctttctatgtgtctctcatgaataaataaataaaatcttaaaaaaaaaaaaaagaattagcatttttttttattttaaagattttattttttatttgagagagcacaagtgatgggaagggcagagagagagagagaaagagaagcagattccctgttgagcatggagaccaacatgtggctcgatatgaggaccccgagatcatgaccagagccaaaggcagatgcttaactgattgagccacccaggcacccttgaagtgacattcttttttttttttttttaagtttttattttaaacacctagtgctcatcacaaatgtactccttaatcctctttacctatttcacccactccacacccacctcccctctggcaaccatcagtttgttccctagagttaagtctgtttcttgaattgtctttcttttcccccattgctcatttgttttgtttcttaaattccacatgaatgaaattatatggtatttgtctttctctgacttatttcactcagcattatagtctctagatccatctatgttgttgcaaatgtcaagattttttatgcttttttacagctgaatattattacattgtgtgtaatatatacacacatatatatatctcacatcttctttatacatccatcaatccatcaattgatagacacttgggctgcttccatatcctggctcttgtaaatagtactgctataaacacagggatgcatacatccctctgaattcatgtttttgtattctttgggtaaatagtgacattcttaaataccactccattaaccaagataaagttattcagaagagaagcaggtttggatatgttaaattgaggacaaaggactaatgttaagattcattcacatttcacagtaaaatcctgatgaccatcctacacattttatataagaaatatgtattaggagtaagatagagtagacatctacagggagataaagaaattattacatacagtgcaggggtgcctaggtggcagagttgcttaagcagccaactcttagtatcagctcaggttgtgatctcagggtcttgagacccatgttggctctgcactcagtgcagagtctgcttaagactctttctccctctccctttgcccctccttctgcatgctcgctctctcttaaaaaatattgataaataaataaacacacacacacaaccaaaacaagaacgggatacctgagtggctcagtcagctaagcatctgacttcagctcatgccatgatttccaggtcctgggatctagcctgtgctcagcagggagtctgcttctccctctgctcctcccacctactcattctctctctctctctcaaataaatagtttaaattaaaaacccttacagtggaaacaccaggtcttgccagagcgaacaatgagaagtgaagtatgcttcacttgatgattttatttcctcccttcccttccttagcacctgcctttcctgcctcagagataagtgacctgtactggtaagagcactattatgtggtagatctcaaaaaatttttgttgttgttaaggaatgttttaaaagactttatttgagacagagagagtgtgcacacacaagccacggaagaggcagagagaagagaaaaagaagcagattccctgctgaggaaggagcccaatgtggagctcaatcccaggaccctgagatcatgacccgagctgaaggcagatacttaaccgaatgagccacccaggcacctcgatttttttaaggtaggttctatgccaaatgtgaggcttgaactcacaaccctgagatcaagagttataagctccatgaattaagccagccagggtgccctgattcaagaaatatcaacggcaaagggctgcagcagagagtaatatactggttagagtttcaacaaattttccattaagtctgacttcaccagatcttactgcaacatgtttaatctgttcctttcccccaccagtatcacagtatcacagggatgctatcaagcttctataaagtaggacctgaaaatgttcttagaaatcaaccccatctaggaactcctgggtggctcagtgtttgagtatctgccttcagctcagggtgtgatcccggggttctgggatcaagtcccacattgggtccccacagggagcctgcttctcctctgcgtctctgtgtgtctgtcgagagagagagagagagagagagaaagagagagagagagagaaagagagagagagagagagagagagaaggagggaaagggaaagaaagagaaagagagaaaaagaaaaagaaaaataaagagaagaaacgaaactcagtctaaattcttcctatagataaggaaatcaggtccattggggttagtggtttgcttgagccccaacaattcctcagtggcagagctaagattaaaattcagttctcacggacacctgaaatgttaactgaatcgatagtcagcatgaaaaaaacgggttcacagactaaatttatgttcattcagctctgcccaaagtaaacatgcttcgcaggcacagaaaaaccttgtccaccaaagagactgctatttcattaggatctccaagagctacactgaaatactcaaacgattccatttctttgttttaatactatccatatactggaatagcaatttattgatatataatggacctcatccctaccatacacttaccagttcattaccaagaagctaatcaattcaagatctatactaagggagacacctgggtggctcagtggttgagcttctgcctgcggttcagggtgtgatcccagactccaggattcataaggagtcccccactgggctccttacagcctgcttctccctctgcctgtgtctctgcctctctctctgtgtttctcatgaataaataaatctttttaaaaaaatatatatatatacacacactaaggaagctaagaaattattccagaaatttatgaactagaccatggaaactgtaattcaagtggtcttaggaggtcctgcctagaaccagccaaaactacacaagtctttcatcatcaagtcattctcccaacaacaaatgtgaatgaagaaatatttaaacaatgcatgtctttaactgataatagcaactacaagcatacctcatttcattgtgcttcgctttactgcattttttataaattgaaagtttatggtaatcttgtgccaagcaagtctatctgtgtcattttccaacagcatttgctcactttcttcctctgtgtcacattttggaaatttttgcattatttcaaaccttctcagtatatttgttatggtgatcagtgagtgacctttgatgttactattgtataattattttggataccacaaaccacacccatatgatggcaaacttaattgataaatatggctggcgtgtgttctaactgctgcctgggcattaccccatctctctcccatttcttagcctccctattccttcagacaaaataatattaaaattaggccaattaataactctattatggcttctacatgttcaagtgaaaggaaaagttgcacatctctcactttaaatcaaaagcctagtgttgaaaactgagataggctgaaagctaggcctcttacaccaacttgtaacgcagaggaaaagttcttgaaaggaaagggctagtccagtgaacacaggaatgatgagacaacaaaacagctttactgctaatatgaagaaagttttaatggtctggacagaagatcaaaccaaccacaacattcccttaagccaaaacctaatccagagcaagaccctaactcttctattctaagaaggttgagagaggtgaggaagctgctgaaaagtctgaagccagcagaggctggttcatgaggtttaggaaagaagctatttccacagcataaagtacaaagtgaagcagcaagtgctgatgtagaagctgtagcaaattacgcaggagatctagccaagatcattaatgaaggtagctacactaaacaaatgtagccaaaacagcctttgtattaaaagatgccttctacaactgccatagctagagagaagccaatgcctggattcaaagcttcacaggagggatctctgggtggctcagcggtttagcccctgcctttggcccagggcgctatcctggagtcccgggatcgagtcccacatcgggctccctgcatggagcctgcttcaccctctgcctgtgtctctgcctctctccctctctgtgtctttcatgaataaataaataaaatcttaaaaacaaaacaaagcttcaaaggacaggcagtctgtcttgttaggggctaatgcagctggtgacttgaagctgaagccaatgcttacttgattactctaaaaaatcctagggcccttaagaattactctactctgcctgtgttctataaatggaaaaacagagcctggaggatagctctctatttacaatgtggtttaatgaatattttaagcccactgtccttctgagtttgggcagactcccattttagcctttgaacttccagtgtcatgaaatatctctgagagttcctttaaaacaattttttttgctggtgttactttctatgagaatcttcatcctttttgtcacatcactttcctcacgtatgtcaataaatctgcctttcactaaatcctttaggctgcatatatattctctccaacggcaacaagtacccactgtcccatggtgagctattttctttaactgttcatctatgtttgattcacttcgggtattttatctttttgtttctttgttgcatatttatctttgttgtccaatttcttctttcaatgatccatttttataaaacagctcatgagtttatcagtgggagacaaagaggcaacacagctacacattttgctacctatgcatgaagtgtgaaacaaatacacaagtaacaaatcacggacagactctgaaataagtgacatgactagtcatgatgcacatctgttatttacataatgagctggggactgaaaaatgagaagttttcacttcatgcaattattcataaagtatggtggtaactaaaatgtaaatcctattgtcggatgctacttaactaaactgtgataactgaaatgtgtatactcaaaaagtgtgcaaagcacacttttggtttccaaaaatctgtcttttattttttaagtcttttattttttttatttttttcttaagattttatttatttattcatagagatgcagagagagagagaggcagagacacaggcagagggagaagcaggctccatgcagagagcccgacgtgggactcgatccagggtctccagatcacgccctgggctgcaggcggcgctaaaccgctgcgccaccagggctgccctgttacagtcttttaaaaatgcttttaatctgtaagcaaatgctgtgtactgcttcaaagtttacatatcattcaaactgccaatatatttcaattaaagtaccccattcagttttaaatttaaaaaattattattttacattaagacttcaatgactgactaaagcagatagaccaaccaattaaagaaaacatttagaacctaaactgataaaagtaacaaattggtgtatctttgatatagctgtagtgactgaaaatttaggaattcactcatcaaaacagtattggggcacctgggtagctcagttgagagtcccaactcttgatttcaccaagtcatgattcagggtaatgagatcaagcccgggacaggctccatgctcactggggagtctgcctgagtttctctctctccctctccttgtgcccctccccctgcttgcactaactctttctaaaaaataaatcttaaataaatcttaaaaaaaaaacccagaatcaattaaacttacaaattgcctcttgaagttatttacaagcccaagagaataatgtttacaatttcaatttgttactttatactgaaaaatatattaacccaaagtagctgagaaattttaccagataacatgcatgcaattacagaatgcccacaaataaaagatataccaattattcatttccagaaggtggataactttctatccaatctggaaggcttactattggttcaacttggcttatttcctacgagatttgactggggagtccatgaaataccaacatctgacaaattctgagagtaacaccagggttgaaatcaccagttagtatctgactctcagaaatactaattggatttgtcttttaaaggtgatgagaggcacctgggtgatgcaatcagttcagtgtccaactcttggttccagcttaggtctaatctcagggtggtgagattgagccccatgttgggctccacagttagcagggagcctgcttcagattctctctctcttactctgcccctccacactgcacacacattgtctttctctctctaaaataaataaatcttaaaaaaaaaaaagagcgggggaagggtgatggggaacctggtggctcagtcagttcagtgtctgccttctgctcaagtcatgatcctggggtcctgagatccagccctgcaccgggctccctgctgagtagactgtctgcttctctttctccctctgccccctccctcgcttgtgctctctctccccccatctcaaataaataaataaaatcttaaaaaaaaaaaaagtaacttagaatatcttattggctttggcattttattttttttatttaagattttatgtatttatttcagagagagagagagagagagagcgcgcgcacgagagagggtaaggtctgagggagaagtagactctccactgagtggggaaccccactcggggctggacctcaggactccaggatcatgaccggaatcgaaagatgaagcccagttgactgagccacccaggtaacctggtttggcattttaaatttatctcagaaagtactgataaatctttttttttttttttttaaagatttataggggatccctgggtggcgcagcagtttggcgcctgcctttggcccagggcgctatcctggagacccgggatcggatcccacatcgggctcccggtgcatggaacctgcttctccctctgcctatgtctctgcctctctctctctctgtgtgtgtgtgtgtgactatcattaaaaaaaaaaaaaaaaaattaaagatttatttatttatttatgatagacatagagagcctgcatgggcaggctccatgcaaggagcccgacgcgggacttgatcccaggtctctaaattcacatcctggactgaaggcggcgctaaaccgctgagccaccggggctgccctcagcacttatttcttaagcctgtcatgtcactggcttccccaagactgctcttccatcatcattagacttctttcagttcctcaaatggccaccctctctcctccacttctcatcctctcctaacctgttgttctttcatcccatgcctttaggctaacatcctctaccactactggttaactcccactccaccttcaactctcagcttaaaagttatttcctccaaaaatccttccctatataccaggtgacattgcccagcaaatactccagtagctatttcaatcatcataacactcatcacactatagcaattacttacttaaagattgtcttgtccctatgactgtaagatgagaataaggaatgagctaattttgtcacttcctgtctctcccattcatagtatactgtctagcattcaggaggttctcatttacaatattaagtgggtgagtgaaggaataatagagaatatcatctcctcactgactgaacttttatctttcctctctataatcttactttctacttctccaagctgttatccaatacatcatgaacagtgcaatcacaatctagaatgcctttcttcctaacttttcactctggccctcttcaaataagactagtcattgctcattcttctaaatttccgtcatcttcctataccacttttttttggcacttcacaaccagactatcaactcaaagcaatcttctgttttcatcttggtatgagaaagctgctcacactttaagcagagactatgcccccattacctaatataaagcttggccctccctaaatgtttgctactgctactcctaatgtggtcaagttcatgaactacttctatccccaaagaagtctcctgctatatacctctataacctatcaaaaatagggcttgagtatatagaattatttttatacaggaatgtttacacacaaatgtcccatctcactctaaagcctttctttcatagtctgagttaaggcatttatttatgcctcaaacccatgagctaaaatacttagtagtgagatattccagaggtccattaggatcctcaatgaaacaattattataactagtacttagtaggtgccaagaactaagtactttacatatacacaatcatttagtcctcacgacaaacctataaagtaaatatattattacccccattttacttgtaaggaaaccaagtcacagcagtgttacataatttggtacaaggtgacaaagcttatagagagtgaagccagtattcaaacccaggcagtctggcttcaggtaatatactcagagagtttggaaccattcaacaaaacttacaaaagcaaaaaaataagaggtttctggttaaatactacataagcacaatgaaaaaaaattagactacttcaatctacaattcaagtttacattttaggtttacacaatatttgaagtataacttaagatagcatttactgagctcttactaagcattctactaattaccagggattctgttaatcgttttaataccatacttagttctcatattaactccaagaaacgggtaagtaaactaaggttaagagagattaaataatcaagttaaataagatgccacagtcacatataactataagtagccatgtcttagactaagttcttaaacactaacaaagtttaccttttaaaggcatttgcctaaaccagaatttttattcattggacataccttcacactagcatagtttatctataattctgtatatattggagcataaaacctattgcttctaaaacattcttgtcatttttcttatagtattaccagtagtgatgcaaggtagcgcaataaagttaaaaaattcattcctaatatggtaagagaacattactatctggcttctttataaaagaaacttcctcaatcttttataaaataccattatttctctagctcagtaaaagggaaaaacttacataccactgaaacagtctggactacaatcatcatcattactacattgacttcatatgtattaagtaatttaattctttaataatatgataaagttactattattatcctcattttacagctgagcaatcagaggcacagacagttaagtcacccagcacaaggttgtatagctagaatatggtaaagtcaggactgtcacaccagtaggctaccccccaccctagtctatgcttcacaagagcattctatcacagcaatagaatgccaatactgtgcataaaactgtaacctgataacagcaatcatttgcttttttccaagttatttttaatttcaaaagttataaaattcaagaattatactaaggaatattaagctgggaggcacttatccaatagacatcttcatctaccatcaataatactggcactttattagatgctttattcacaattctgagtgttccattaagaaaaagatgtctaaatcatcattacatggatactttaaaattataatcaacctttaaaatatctgatacagtttttagttacagcataatataaaaataagataaatatctgagaaatgattcactataaattctaaagcagatttcatctctgagctggaggttgtcagtttcctaaccttgaaaattgtatacaggttgcccaaggaaacacggaaggtagctgctggtccttatacaactagatagtagataatcgagtccaaaaacatgaatcataataagaaaaaatcatgaatcatgaagaaaatccaaatgttaaccttacattttactcattcactgcttatcatcttcttttatatatactaattcacttagaagaattattgaaaagcagaagatatagttttcaaaacagtttaccaggtcactctaggagagtcactacgaataaatagtattcttagtgaagtacaccaggatttgaatgatcctcctatccacaacaagccttcggtagatatatcatctagtttaacgagttaccacatttgaggggcacctgggtacctcagtggttgagtgtctacctttggctcaggtcgtgatcccagggtcctgggatcgagttcctcatcaggctctctgcagggagcctgcttctccctctgcctatgtctctgcctctctctgagtgtctctctgaataaataaacaacatctttaaagcgaaaaagaaaaaaagaaaagaatgataagccatagactagaaggaaatactgcaaaacacgtatctgataaaggacttatatctaaaatatataaagaatacctaaaactcagtaagaaatacaattaaaaaaaaaacaggcagaagatatgaagacatttcagtaaaatgatacacagatggcatacacacatgtgaaaagctccccatcattagtcattaagaaaatgtgaattatagggcgcctgggctcagttggtcaaatgtctgccttcggctcaggtcaggatcccaggctccctgctcagtagggagtttgctcctcccctctccctctgacactcccaccctcccttgtgttcttgcaagcactctttctcaaataaataaatttttttaaaaaaaaatgtgaattaaagccacaatgatacccctacatacttattagactgactaaaattaaaaatataaacaaaaagacctgacaataccaatgctggggaaggacccagagcaactggaactctcaaacttttttttttttcagttctggtacaatactgacaggcatgcaaaataccgtggcccttggaaaagttgacagttttttaataaattttaagcatatacttaggattctatccaggaatcccactcctcaatagttactcaagagaaatgaaaatatatgttcgtgcaaatgttctacagcagccctataaataatctctccaagctggaaacaatacaaatgcccttcaactggtgaatggataatcttggtacacatccatacaatgactacacagcaatagaaaaaactacttttacactcatgatacatagatctgaatgtattatgctaaaaaaattttttttagtcaaatgtactatgctaagtgaaagaaacagacttaaagctacatgctctgtggttccatttataggacattctagtaaaggcaaactaacagtgtttttcaggatctgggattaaagggatgacttattacaaaggaacacaaggaaacttcccagaatgatggacatctatatcttaattatagtagtttaacatgatgatataaatttgttaaaactcagtacactataccaagagaatgaatgttaatgtatgtaaattatgtctcagaaagctagacattaagaaaaaactaataaaaaatgcaattatgcaaataacttgttacaaaggaattataatgaatatgaatttgtaaacacaaatccaactgtagaacatcacaactcaattaaaaaattattgggatgcctgggtggctcaacgtttgagtatctgacttctgctcagggaatgatctcagagttccaggatcaagtcctacactgggctccctgcatgcagcttgcttctccctctgcctgtgtctctgcctctgtctctcatgaataaataaaatcttttaaaaaattatttaaaaatattcctttagaatattcatttaactcccactgggcatatgcatcattttgtaacacaccatggcattagcattaatatttatttcagtaaagtaattatttaaataaaaacactgcatacattaactttttcctgaaaccacttagtttctaaatgggctcaacgttttcatgtgccaagaaacaattttgtatcattcctttgtaataactgaataagacacatcactcctataaaaggaattaatttactactaatgccttcatggttataaatttttcaaacctctgtaataccatcatccacctattggtccattcaacttcagaaacctcatgaaaacagcagttaaacagcttttgttatattaaagaggtaggtgtgtgtttggaagtgagaggaagggtgaaatgatagctatttttattattattggtagtgagaacacaaaacagtcccaaactaaactccttctgagtacaattctctactttcaaagctggaacccattaaatagtttagattatattttaactccttttaaaagcagttctttttttccccccagttcagtatcacaataccactgaaaaaactgccactctcatgtgtatagtactaaaagtttataaatgcatttcacacatattatctcttaatcctcaccaaaacctatgagatagtgtgttaattttctttttgtaaatgtcaaaacccacttagaagattagattagttgtcgaaagattacacaaatgatttaagtgtcagggccagaacgctgttttgtattactctgtgtatacattagcaagaacaatctgaagacagagaacattataggaaagcttatacctaacaatgtctaaaaatattagcaatacttggtagtcactgcatatatacccctaacaatgtctaaaaatattaccaatacttgggagccactgcatatattaaaggagactgagtaaagaatagtttagtgacaactaaatgtggaatggaatcctggatggaaaaaaacaaaggccattacttgaacaagtggcagggatgcctgggtggctcagtggttgggcatctgcctttggctcagggcatgatcctggggtctggggatggagtcccacattgggcttcctacagaagcctgcttctctctctgcctatgtctctgcctcctctgtctctcatgaataaataaataaaattgtttttaaaaaacaatcaagtggcaaatacaagtgaacatggatgcatattagacaatactactgaattaatgtttaatttcctaaatttcttaaaaaagattttatttattcatgagagacacaaagagagagaggcagagacacaggcagagggagaagcaggctccatgcacggagcccaatgtgggactcgatcccaggactcctggaccacgccctgagccaaaggcagccgctcaactgctgagccacccaggtgtccctgatttcctaaatttgataactaatgtaatatgtaagagaaagtccttgttcttaggtaatacatattttaaatattcagggatgaaaggttatgatgcctgcaacttactgaaagtgattcaaaagaatatgtgtacagagaaatcaaatggcaaaaatgctaactggtgacctaaataaagattatacagtgctcaggggttttttttttgttgtttttttttagattttattttttattttaggcagagagcgagagagatcacatgggggagggaggctctctgctaagtaagctgagagcctgatgtggggcttgatcccaagatcctgagatcatgagctgagatgaaggcagccacttagctgactgagccaccctgtgtcccactcacagttacttttattactgaacttataagactgaaatttcaaaaaatagagatgaaaataaaaaaataaaacattaattttctttcaattttctttaatagctattagacatctctaaggggatcttttgttaaataactgaataaataaagatacattctcgcaggtgcctgggtggttcagtcagttaaacatctgccttcagctcaggtcatggtgataccagggttctggtattgagtcccagggacaggctctgtgctcagcagggagcctgcttctccctctccctctgccatttcccctgctgcgctctttcaaataaataaataaaatcttaaaaaaaaaaagaaagatactttctttttagtgcctgtataaacaagttaactctagttggaatcaaacagtatttgttgatttttaaaaaatagggtataaaacatgacagcaagcaatacataatacatctgaggaatagctcatacttttttgtggtatgagaattttagtaaaatttttctcccatcccattccaaaatatttaaatatgtttttataatcttcatacatttcaaaataagtactgtgaatctgcaccacatagatatttccattaattcaaccataagtcctccaggggaaaaaaacaacaacaggatttcaatagcatagacaccatttcactaaataaacatgccttccccaaggagcactaagcacaagtaggagaagggagctgtccagttacacatgcttttctccttgtattcatcttgccaagcttcattcctagtgtttaaagtatttttttgcaacaaatcccctaatgcaagccaacctcttcatctgatgctcaactaaagaaatttatttttaaagtttctgaaggaaaaaaaaaaaaaaaaagtttctgaaggaaaaattagctattttttgcacatctgggagatggaataaatgtataatataattcatgaacactttaagggagttttaggagtattttaacatcgattttttttgttatatgtgccaacttcacagcctaactccgtctgaacatgcaattccaacataaatgtactctatttcattatttatagcaagaacataacacttcaatgcaaagaggacttctttatacaggctacaattcagaaacagtcctctaactttctaggtcaactcatcttttttttagttactcctgagtcccccaaattgtacttttttctctggattattatttaacttgatttaacccaacttctacattcttcctactcacagaattaagagtgaaaagaaactcagaaatcagtccattattcctccctccaagctcacagagttgccggctagacaccggtaagttccatagaagaataaattccttatcctctaactaatacgaatttttacagaaaggtaatattaaattgtacatagaagctcagaaaagaaaaaagaaaaaaaaagttcagaagacacttataaagtgttctgaaaacgcagtgaaacaaagcacctcttcacttcgaatcctccatactaagttttgactactagtgagtagacagttttaatatttcttgatctctagaggaacataaggaaaatcccataaaattggggctcttccttacaatttattttttgtacaattagtttatttgctgtcatctcattctttgtccctaatgttttattaactctacttttaaataaaaacagacacaaaataaactatacagatttgaaaattattttttaaaaaactacaataaatttttcaagttctatttcaaactgtcaacctggatttttaaaaaatagagggcagaaaacaatttttcatttcagaatgaggtataaacatagaagggaccaatcttgcgattgtctgtctagtatcatcctaaattaagtcaaagatgcaaaacattttctgtgacatcaggatataattccctaaagcccacttcttcatagcatacactctttatgtttcttttaaaaggttactgcataatgacatgaggtttacactaaaatttaaaggaggcctttcagatctttgaatcaaagtcatgaatcaaagaatcatgatttaatgaccttaactgaagtgcaaaagctctttataaaatactaactaaataatgatgctgacacatactaaggaagcatttatttacttttttagcttgctcaattaagtgactaagtctgggctgaatgcaataaggctgacctgcaggggtcaaacccaggagttgtgttacaatcttttttccttaatcacagacttctttgataatctaataaatgctaaaaagcctcttctcagaaaattccctacatggacagagatacaaaattttgtttttttatttttcaagtatttttttatttaaataatctctacacccaatgtgggacttgaactcatgaccgtgagatgaagagtcacacacacttctgactcagccagccaggtgccccacttacaaaattttaatacaaccttgaagggaggtgtcattacacaatctattaatcccagggaaacaattatcattgattacatagaaagaaagagttaaaacttaatgctcttggtattcatacagattctgatcagaacaaggggaccagacaggcatctggagtcaaaggttggtgaaagctgtgataaccttccgttccaccgtaccaaaactattcaaaggccacagcagccaggttctgccaactgtccatccctgctctgtgatcccaagacacaaggccctgtgccatctctacctctaatcatctagattctgcaagctgctttgatctactgcagttgctgacaagtaactacccagtccaccctttaatacctttggtgacacaactcagcgtttcaaaagacaagccattgcagttttaggcaatgccgaaaaattatgaagttcctttctaatctgactaaaggggtttgtaaactttaaatgctgccctactgaatttcttctcttttcacttaccaataggtaacaaaatagcttatcattcagtatttgatactaatcctaaaaccagaagcaaaaaatcatagttctacttgcaccaaacagataagtcagaataatgatgaaaagcactttctacttgcaaatcaaaatggaagatcagtactggttcagttcgagaaaaatgcaaggtttccacctacacagcatctcctacttttcagggcttcttttcactgcataaaaaattttaaatgtatcaacattaaaagattcagagtacagtcaccaacattaaaagattcagagtacagtcacttaaattaacatcagttctgtctgcaaatagtattctctatatttctatttatacctgtgattctgtaataaacagttctaatcaatacaatataaatatagaagtcattacttatttatcagataaagcctggctttcaagaactttaagttgtctcagtcaccttcaatggctcctttttcacactaagaaatatctcatattgaaaccaatgtatcagtaaggtccagttatcatatatataagcaacctctgatgcaaatgcttgtttccttcaaaaagaaaggaaatattaaaaattatactttctattttcttccttaaataatcccacgctaatgctggaaaaaaaaaaaagattcacagatattacgaaaagtgatttatacagtcaaatcagataagaacaacgttaaccaacagttaattggattaccaatatagtaaaatctcatttacaaaggactacccgaggggggcttgctttcctgggccaagtctcagaaagccaaacaatgcacagccctaagaagagtctatcttgtaaggagcttctttttggtccttcaataattacaccacctatagagatacaaagatgatccacctaaatgaattctacactattctgcaaataccattatagggcaccagttccataaatttatatggtaggtttgcaacaatctcttggtaaagaaatacatttcctgataaataagcacttctctaattttccagagtggcttgaagaatgaaagccgtgttttaaaaaggcaataaataaataaatagatagatagataaataaataaataaatggcagtgccacacttcaccttaccacaactgcatgacctgcaaaaggcatgttaagctcatgaagacagacctctgagcctttctcttgtgataaactcatatttagaattattttagttgattcttaaatttgaaaatttcatgcatcacgagcaaaatattgtactacagaattttcttacagtccctattgttggataccctattatttaaatggattcagttttaaatcaatgcaatatatacttgtacccaagcaaatactatgaatctcgaattagtttaattatgcctgtttttttagcataaaattatttcatgagcttaatatacaattgaacactcgaaatagcttttttaaagcacagacttcagatagtccaaacactgccccacccctggtaagagtggttgactggaacattttaatacactccatcacgtatagtacggctatagaaccttcattattggcgcaagaagttgcacattttccagtacagtttattctttaaaaaaaatgtttgcatcatcctcaataccagatgtcaccaacactcaggtgcgctgaagatacgtgataaccacaagccctgtaatatcccccctctcaacataaatgcgcacttttgtcatttcttctaacgtgaagtcgctgaatgtaaaataataataataataataataataataataataataataataaggcgttctcgccagtaaccacacagttaggtctattaattgggaggcaggaatcacattaagaaaatttcaaacagtaacaacgcaaaacacaacacaaaggtgaaaggtcttttttgcttaattattgaaagatcttaccattttcaaaagtgtctgcgggatgccgagcaagagttccaaaacccacaccaatatttttccccatagcatctctctcagcatttttatcctgagaacccacgttaaaaactctttgtgaaggcatcttcacgcaaggtgctcgcaggtcatgaagactctaagaaatacattaaagccccgttcaggcttgtcaggcttgcttgttatctccatctgtccccaccacagagctcgcccgcgcaccgggcggaggagtgggatgtcccgtgtagatggtgtgtcacctaccactccgggacgggacatcattgtgtatagaagtcaggtgttcgacggcaggttctctgacttgctctcctgcttttatggacttgatgctccaaatacaagtcaacctctcaaatatgagcttttgctaattttcttttaatttactatgatgtcctcttttccctgagtagaaagatcttcctgacgttacaggcccagcttaaattatactccttctgtaaagatttctctaccactcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgccgccctcgctccccctcaggtcccggctcggtcccggcccctcaccgcgcgctcctcgcgctcccggccgggggctcgcgcagcaacaagcacggcggcggcggcggctcgcggggcggcggcgcgcggtccccccgtcggccggcaaagcgctgcctcccggcgggagcgactaatggagtcccgtcgtcgcggcccctcgcccgtctgccggcgctccacccctccctccccgcctcctccgtccgagtccggccgcggctgggcgcgcctgctccctcctcccccgccccccgagccgcccggagcggtcgggccgcctcacccgagtccctcacggtcccccgcggccgcgctgcgggcaggggggggcaggggggcctcgcgcactcccgagctgggggcggggcgggcggggcggcgcgctccgaggtgccgggcgcggcgagggggaggcgaggggcgcccgcggcgcagcaatctcagccccgccgagccgctgcccttttatggaaatgaaggaccgggcgtagggattgaatccaacatccgggctctcggccgcgggacctgaggagggggagcgaggcgagcgggggcggcctcccgcgaggggaggggggcgcggcgcggcggggcggggcggggctgcggctttgcgggagcgcgtggcggtgggcgtccgtccttccagcgggagaaggggcttgtccgtgagaaacggtcacaggaaattcccagggcaaggtcgctttcagggaaccaagtccccccgccccccccccccccacgcctggagcgagtcccgaagactcggggcgggagtaggtgcggcgctccgggacctggagaggagggtctgggacgtggaaactggagaaagtgagtgcccaggccagctccacgaacatcccacaaaagaatgagaaaacccagagggaggtggaccgcaaaaatcgcctcgtaagcaacgtccggcacaaccagcaactcctaccggactcccaagagttcgcttgcgcttttaacccgttcggaggctccaagcagaagcgggtcagatacgccccccgacgctccgtgtttgcggggcgcagcacagccagtttgactcagaaacgttctccggccgctccagctctttgcatttgtgtatttttgtatgcaacttagaactaacagtcgactggggcttgtaggtggctaagcatcctctaccccaccctcagccacaccttgaaagaattttaatagctctgggatggtgccagcaggtagggagaaccacagggctctacctgttgagaccgaccagggatagaaaatggtcctcccgcttcccactttacttccacttcccccgtttactgtcgcactcgattcagaaagggccccccagagaacccgcctcgcagacgggcgggcagacgcagggctcaaaaaacttaggtccgcaagacagctaatcccaggtcccgcgaaagccccgggttttaaagtctccgtgttcttgagctgtgccaattactctgaaaaggaacttacgaggcaaataaccctccgttcctcaacgcagttgggaaacgaggttagaggcctcgagaaagggatgggacccataaaggagcgaaaggaaagcagcgaaattcagatgccagaggtttggcaccaaaaatagggaaaaccactaccgtacttggagctagtcatcatggagaaactgatgcctcggatctggcgtctgtccgctctccaattatttctactcatggaggtttcagagggttctcttggaagtggtatgaatgtcccagagaggagggaatatttgtgtaaattatggtgttgaaaatatacaggaaaacgttcttacaaaaatagggaattgcttgttagggtaaaaagctgtacaaaactgtgtatgtggctgtaacatcacaagcttatcctcaactattcagaggaagaaaaaaaaaaagactggaaggaaatacaccaaatgataagaagctgtgtgggtgttgagatcatgggagatttttcttcttcttcttcattttctacaaactccaaagctttgcattcaggacttctctgtcaccaccttaaattttattcaacatctcaatttctctgtgcatgccgttacattcacaatgatggacacagcgggtagagaagctactgaactactcggcaaagtgtccctttgtgttttttaatatccccccccctcccaattaaaacatgagctctttcaaagcagggacttaaatctttgtttttcccacaaatttataaatagcttgaaacaaaatggaaaacatgctgataccaaatcaatacaaatgtcaaagaaacagtaagtcacggagaaatctcattactagggaaatcctggcttttaaattttatgtgttatttccacatcttatctcaaaaagatttgtggcaatgtataagtattcatgggctatgagatagcatacattaggggtatagcacaaaattagggttagtggggagaggtgggaaatggaaggacagagatttaaaatggagccagaaatgaggctaaacattgtaccttaatgaactttgcaagtgtcccagtaaattccgagtaactattgcttctgaatatgcctccatagaaccaaaaatatccgtgttctttctgaatatgctgtccttcatacaaatttgtcaaagctgttttgtctcagaaacccttttagcacccagtttccacattctagttcttttctcactttccagtgagtactttctgaacagcctctcaccacagtgcctactgctttgactaatgcgcacttctgtgaatgttctttacatttagtgacagagggagatggttaataatgtaaataacagccccatttcttaacatttgaaatagcttagttatagcataataagagactttcctatcttgagaaaataagcagtttatatttgagcagtatagagcacaggaaggcagtgaccctctgttaagtaccattggaggaatagattaggatgggtgcagctggttccttcgggccttctttttgagtatttcaagctggtgcttgttttgaagatgaaagaggactctgactccaatcattgaaaccgggattttttttcccccggtttatcaagtgaggctttcaaatgcatttcttaaatgtttacttctacctaatgttttccagtgtattcagatgtggaatcttatctggaatcccccactagaacctctaagacaatgcaatacttgtggtactgacatcatgctgaaaagtagccgagaactccagtgtttggaagaacagcccaagcactgaaagcagcaatatccaaataaggtaccaagcactggtcttagatttagaccaaatgatacctcacagatctgccgtcaaatgcagcccttgggctgggtaatccacaggttgacttcggctttttctctgaccctacctaagctgtgcttttatatttctaaaaggttaatacaaaataaacccaccaggtttgaaagagagagatgttgggtgataggaaaaaataagagaaaaaaaaaaaaaggaaaaaataagagaaggtctgtgtgagtgcgaaagtgtaagggtaactaaaaatgcacttcaaaccaccatatgaggccagcaagatgaaatgtaatgaattattcctgtcaaataccaggtgaacagaattctttgtcccagggattgccaaaaatggaacatactggtaaagctactaaggaggtagaagtcaaaggacatggagtgtaaactaagaatgggaaggaaggctgcaggggccacagtttttatagaaacggtagtcactgcaaacagcaagaaaaggagtagcaaacctagggacaaagatgatttgctgggggtggggatgtttcgacatggacctaaaggagaactcttaaatagcaatgaaatctacttcaaggagaaagaaatgcactgctcaaatgtaccgctccagagtatagaaaatttttcgtaagaaaccatgctgggtgatacgtgaaaaaaactttttttctttgatttaattttgaacatcatgtcatcttgtaaacattctgtcctcgacaaaaatatggaggattcacacataggatcatacaaacaaggtagctaattgtgtgccttagaacagtacaaggcactgagacagatatgtagacatataacatatcacaaagtcttaaaggaacatctgatgtaggagacttatatttaaaatatcataaaggatatccacatgcaaaaaaattaggcccctacttacactatatataaaaattaactcaaaatgaatcacagacctaagtttaagatctaaacatagcattctcagaagaaaacataggagtaaacctttgtaaccatggattaggcaatagcttcttagataagacatcaaagccaaagcaacaaaagaaaaacaaaattgaattttctcaaaataaaaaatacctaaatttcaaaagagcatgaaaaatgtgaaaaaataacccacagaatgggaaaaatatttgtaaatcatatatttttaaggaacttatatctagaatatataaagagctactataaatcaacaataagacaactcaattaaaatgagcaaataggggtaccagggtggctcagtggttgagcagctgcctttggctcagggtgtgatcccagggttctgggatgagttccacatcaggcttcccacagggagcctgcttctccctctgcctatgtctctgcctctctgtatctcataaataaaatcctttaaaaaataataaataaaatgaacaaataatctgattagtcagttctccaaaaaggatacacaaatgatcaatgagcaatggaaaaatgctcaacaccattaggcatcaaggaattgcaaatcaaaatcacaatgagataacacttcatacccagcagaatgatataattagaaaaagacaataacaagtgctagctaggatatggagaaattgcagccctcatacattgctggtgggaatgtaaaatggtcaactattttgatatacaatttggcaattcctcagaaaattatagagctaccatataacccagcagttgtactcttagatatataccaagaaaattgaaaatatatgtccagacaaatacttgcacacaaatattaatacttagccaaaagatggaaacaacccaaatgttcatttatcacttgaaaaacatttgggatgtttccatcttttgtctagtactaatatttgtgtacaagtatttaaataaatgattcatttaaaaaatcagaagggggatgcctgggtggctcagtggttaagtgtctgtcttcagctcagggcatgatcctatggtcccgggattgagtctcgcagtggtctccctgcgaggagtctgcttctcctctacctgtgtctctgcctctctctctgtctctcatgaataaataaattaaatattttttagggcagacccggtggctcagtggtttagcgccacagtccctgcatggggcctgcttttccctgtgcctgtgtctctgcctctccctctctctgtgtctctcatgaataaataaattaaataaataaaattttaaaaaaataaaatattttttaaaaaattcagaaggtagagaaactataactctaacatctaaatcataaagtacaaacccactatgaagactatgataatctaacctctgaaagaaggtcatcagtgaagtcatggaatgtctttatgaagaagacaaatctaactggatctgaaggatggagttaggcctatcgggaggagtagtgtgtgaaatcacgaggcaaaagtaagcatggcatgcccaccgccatggagaagaaaggaagaaatgccaaggagatgctctggagaagagtgggggtagagtgaggccagagtaggtaggatagaagtttagattcggagaaaggaaatggtaagtcattaaaaagttgttacgtggtagtaatatcatgaaagcaatattcaaataagattaatccagtaaaaatatgcatgttggattgcaagagctagggactagaattcagaaggttggtttggaatctgctcatgacttacatgtaagaaaagtagggattgggggatggaggggatttcaaaagaattattatcaaaagcttttgagcatttttgatgttttaagagctgtttagtgcacttgaaacgttcctcacaacaaccctgagtttttatgattatccttctttaatgtgagttacctgatggctagagaactgggattaaaacctaggtctgaaaaaaagaaggtcataaatgctgcaaagttttcatgtttgggtgaccaagcaagacgaacaatggggttactgaactggagaatggagctagggaggaggtgatttcagggagcaaagggaagacaacatgttttaaaaaagaaatattcaacttagggtgaaagctgtataccccagtggaaacatttcaagggcaattaggtaaataaacctggccattttgtgagagtatcagatcacagagagaaatcatgaacagagaggcaagcctgaagagatggcttcactcccaaaggagcctaaccttggggtaactaactgttccccaaaggcagaagcaggaaggagaatcctctaaggcaacagaggtgaaaaaaagatcaggttagtccagagtcaggcaagccaaaaaaaaaggaaagaagtaaaaaaaaaaaaaaaaaaaagggaaaggaaagatgaaagaaccatttcaagaaggaaaagatggtcaacagtatcaaatgatgcagaggagttcaggagaataaagagtgattgaagaacacaaagcctggccaaaatcattgctcaccttgcagaggacaattttataactagttgagacaggtttcaaagagttgaagaagaaaaaggaagtttctcagtgaaaggaaagcaggaacgagtatagtagtatggaggtgccacaggagcaaaggtgctttttcaaaacaaaggacacaggagcgtgcataaagacttacggaaaagtcaagggggaaatagtttgcttaaacttaaaaccaagatctctctgggttttggggggataattgcccagattcaggagaaataggagcagcccttgccaccacagaagaaatacacaccagtttgctaggctattggtttactggaaggatctaactattttataaaagtggaaacacacagcaggatacagcaaattgtgtataaacatatttaaataaatactgttaatattagccaacgagagggtggggctggctgggttattgtgctgttcaacagaggccctcccaggaggtcagattggggccgggatgtaagaaaggaaggatgtgattaagagattatttcagtacaactagggcagagattccaaagcccatagggagaaccaatggggacagcacaaatgccaacgtgcccagcacagaggtgctgctgggggtccactggcctgagacagtgtagccaccattcgcaggtcactccaaaggacacaggccacgaggccatttccgacagctgccttcacgcagtcagttcctacaacataccagaaactctgacctgctcaactgtttgcctgttaatgaatacattagtcttcttcctgatttccaatgttattcagtgtccagcaggttcttcccaatttttagtaactaggtaaaccactgactcccaacccccatgctgtgaaaagatccctgttctctttgtgctttgtatcacaatgtcctcttcacatgcataaaccttctattcttcccaaaacaggatttgcagttccactaaaacagccaaaccagaaagtcacctacaactccaattgccctagggccaacccagtccaatttagaaggacaaaagtaccttttatctacttgctcctaagaaggtgctcaggtgacagagaattgacagcagctgaacatcaccatctggtgcctgggaggtgtcactgcaaatcttttctctcctttgaactgcatgcaacaaatatatatattttttaatactttatttatccattcatgagaaacacagagagagaggcagagacataggcagaaggagaagcaggttccatgcagggaatccgatgcaggactcgatccccagaccccaggatcatgacctgagccaaaggagaagctcaaacttctgagccacccaggcgtcctgcaacaaataattcattaagaacttaacaaatggagaaagcatccctgcacctattgaaagataaacttttggggcccctgggtggcccagttggttgagcgcctgcctttggctcaggtcatgatcctaggacattaggctcctggctcagcgagaggcccgcttctccctctgcctgctgctccccctacgtatgctctgtttctctctaataaatggataaaatctcaaaaaaaaaaaaaaaaaagtcagtaaaaataaaagataaactcttcatttttggaccccatcccctctttcaaggggtgcttttggaggtatccgctatattcccagtttttcctgcttcatctaattctccccttccttccatatcactgccattgctctataaacagactccagcacctccacttaaagaaaggaagatgagacgcctaggtggctcagaggttgggcgcctgtcttcggctcaggttgtgattctgagatctggcagcgagtccacatcaggctccttgcagggagcttctccctctgcctatgtctctgtctctgtctctgtctctgcctctctctgtctctcatgaataaataaataaatcttaaaaaaaaaaaaataaagagggcagcctgggtagctcagtggtttagcgctgccttcggcccagggcgtgatcctggagacccaggatcaagtcccacattgggctccctgcgtgggtcctgcttctccctctgcctgtgtctctacttctctctctctgtttctcattaataaataacatcttttaaaaaaataaagaaaggaagaaaaaggtctctcttgattacatgtatccctctgctaccccttcactgctatggtcccttagaatacaaaaccactcagatgagatatctgtatgtaacatctctacttcctcagccctatactactttttaacttacccccaaattggtctctgtttccaccactcccctgaaactgttcttaaagtcactaatgacctctgtgttgcaaaacacatagtgttgtctttctaaatgcttgctcctcttggagtttggaaattgccacatcctcattctttttttttttttaagattttatttatttattcataaaagacacacacagagagaggcagagacacaggcagagggagaagcaggaacaacaccactctctagccattcactcagcctgaaaaaaacaaaacaaaaacgaggcctcagcttaacgcccgcccccacctcactgtgactaatttaatgcctcctccagtgactaatttaatgtggaatccatctctgaaattgatccggcattgatccacttctctgcatctccaccatcaccaccctagtcctagccgctgtcttctcatttggattatttattcagcagccttctaagtggcctctctgctctctccctgtccagtccacttcctatacagtggctggagtgatcctttaaatgtataaatcacaacatttacttctctcttagaaacatcaagcgttttccatcaagcttaggataaaacccaaactccttacaatggctcaagaggcagcacaggatccgggccaacctacctggctgagcttctcctcactgtcttcagtcctagaagcttcctcccgcttgtgccttagcacttgcctttcccccctaccaccaagccctccccctggctcttcccaagaccctgtctttctctgacccaacatcatctcttcagaaaggccacatagcttataataacttttgtccccatcctcaagttactttctatttcatctgatcttttttcttccacaaaacttattaaaaatgtgaaattatcttatttgtttgtttgcttgtctccaccccacccagctgtcctctctgccattagaatctaaagctcctgcaagggagggaacttccaattgcattgtgatatgtctagctttggaacaccatcagtgttgcagtccatgtgagtggaggtccttgtagcagcctgccctcctctgccttgttcatagacatatcccccagcacctagtacagtgcctgccacatggcaagtgctcactagttgtgaaatgaatgaaagaataaaatgtagcttgccagatgatcctaggcacatatcccagatcagtgcctctaagaaacttaaactctagaaggtcattagaaccaagagtataaacatcacatataaatatttacatgtttcttagggccacatgcatatttagtagcatggtgcttctgatctccaagctgtaaacaagtgtatctgttcataggtactgcccttatcatcacacgaaaacagcccatttgagaaaatcatttgaatacaaggcatgaggtatttttccctcccaggattaaaaaaaaaaaaaaaatcaagggcacctgggtggctcagtctgttaagcatctgactcctagtttcagctcaggtcatgatctcagcatcatgagattgagctcctgtgttgggctctgtactgggcatggagcctgcttaggattctttttccctctaccccttaccaccctaaaaaaaaaaaaaaaaaatcattcttcaatcttctccactgtctttgaatagtcaaccctagccctttccaaactatactcactcctccctctcccatgacttcatctcctgcttccattgaacattgtagccatggggggtagaaactccttgacttatgctactgaacttttaatcctcctgcatctacacaaggtgccctctcctcctttgctgccattaggcagaagagatatctatgtttttatcaaaggttaatccacctgtgccttgctttccatttcttcctactctcaattaataaattctcaattatccatctccagggtcttcagactctctcaatccagagacttactgtcagcatttaaatatgctcaagtcttccccaacatttgaaaggctacatggaggacaggccatgaagtccaccccagacttcactggctccctagttgctgtcctccccttcatagatatcaaaacttctcaaaagcagattaagcattgtctttatactcactgtctccatttccatcccactctctcattattgaaccaatctcatccttgtttctgcctcctgttcaactgcagtgcctcttgttgggctcatgaattacctccatctcactaaatctgaaaggtgttttaaaccctcaccttaaacaaacaaaccaaccctcacctgatttgatttcttggcgattcataactccttcatccttgtctcctgtcacaccatattgtcttggtcttgcttcttctcacacccttttgctggcttatgttcctcatcttaaccatgatttttgaagtccttgaagttaagtctgaaccccttttgttcttattccacgaactctttttagggggcttacccacctgcatggctcgaacaccagctacatgtgaataattcccaaatttatcacaaacccaggactatctgactgttgtcaaaaactgacctctgtatgttggagcaaccacaagagactcttaatcatgggaaacaaactgagggttgcaggagaggggggtaggggggtggggtaactgggtgatggtcattaaggagggtgcatgatatcatgagcctgggtattatataagactgatgaatcacaaaaaaaaaaaaaataaaaataaaaataaaataaaataaaataaaataaaaataaaaaaaagtgatgaatcactaaactgtacctctgaaactaataatacattatatattaattaattgcatttaaacaaaatatatatttgttatttatttatttatttatttatttatttatgtcatgaagacagagtttgggataaagaggaacaatagctttattgcttcgctgggcaatggaggctgcagcaggctatggccttcaaaaaaactgcaagcccacccagaggaaggggtttggggatcttacagggaaatacaggatctagctggatttgacaagaattgtatacttgctgtcagcctcctttgtcaagtctttagggtggtactgggttcctgaagcaacaggctactgagggaggaggggaggtttgtgaaagagaggaagaggttactttaaaattgagcttcactgaagtattagtgcagccattctgacttttgttcaacattacacctttaagtggtttcatgagctctagggttgtatacctaattgctcattccaagtctccacctagatgtcctacatgaacctcaaactcaacctgcacataattgaactctgggtctttccttgtaggatggttctcaatccacctgcacagaccagacacttaacagtcatccgtgacacagtcttcacttctttcctcttcttaatccatcatcaaatcttattgattctttctcctacatatttatgagatccatctacttctctccacctctcctgccaccacttcagtgcaagccatcatggtctcccatctggctttgcaagagaaaccttataagggatctccatacctgtctttgcccctcctaatgttctcaatgctgtagcaggaatgaacatttaatgcaaatctgatcagtcactgtcccgttgaaagccattcaatacctttgcctttctcttagggaaaagacttaattccttaccatgcctccaaggctctgattgatctcttccccacacactttgcctgcctcatcttgttttactctctccctttcggcactaccttgcagttcctctaaccacacagactccatccagcctcaggggctttgtagaggatttcctttacctagacagttctactctctctctgaccctttgtctacttaccgactattatcctttagatattagtgtgtaacagatactgttgtgctctgccccagagctggtgtagagcagtagttttcaaagtgtggtccctgaaccaacagtatcagcatcacagggtaatctgttagaaatgcattctccagggcagccccggtggtgcagcggtttagcgccgcctgaagcctggggcgtgatcctggggaccccggatcgagtcccacgtcgggctccctgcatggagcctgcttctccctctgcctgtgtctctgcctctctctctctctctcaatctgtgcgtctctcatgaataaataaacaaaatctttaaaaaaaaaaaaaaaagaaagaaagaaatgcattctccagccccaccctagaatcaggaactctggagtggggtcctgcaatctgggttttatcaagtcctccaggtgatttggagatttgggaacccctgtcttatagtgtttatataagcttcctttgtctctctgcctgaggggaggctacaagtgctgagaattgaacacccctggggtgacccttacctagggagggatgggagttgctgggtaaatggcctagcctcataccccttagtaagacattcttaggaagattccacaaagtctctcagagagtcccctgtaggactgagccccaattccccacaggtgtaagttgctcattagtaattttcattccttcctttctttgtcccacttccttattcattcacagagctttctggaaccaacccttcaataggttgcttgtgcccaaatccttatcttaaggtctacttatggggcaaccagactaagacatgcaataaggataccccatgcgaaggaagatttaccccacccccgggctagaccagctcattctgttacctgtcctactgcacctgttttatctgcaatgcctaccagtgcctggcacaaacacagagaggcagtgagtgtttgttgaatgaatgacaatacatgaatagtaagaatcctttcatacataatttgccaaagggctatctgagaaattcttaggttttctgttatctacatttctttctttctttctttctttctttctttctttctttctttctttctttctttttttttttttttttgttatctacatttcaacatatttttctttgacatttcttctaggcttctcctctttcctatcataaatttccatttttttccatttcaagttcaggacaatagtcttttccacataatactacttgctgaaaaaaatactactactactttccattaattttgttggaatttatcttttaaagtatttcctttccaaccaaaacatttatccttctattcttcttctttttaagatctatctatctgtctatctatctgacagagagagcaagcaagcgaacacaagcagagggagagggagaaacagaatccccactgagcagggagcctgacatgggactcaatcccaggaccctaggatcatgacctcagcccaaggcagacacttaagtgattgagccagcgaggtgccccttgtccttctattctaactatagaattatatatagaattatatatacaattatattcttctgtaataggattttaaattttcaaatcataatattccttgacatccatccttaaaacctataaaggcttttcactgcgggctttccttggccttctcacttctaaaagaggtgaacatatgaacacatattgaataattttgcatctctgagatttaatcagccctcataaataatttagttttgtctgggagaaaatgtggatgagggcatctccccgtttttaccacacctgtaagtctttgcccatctctgttgcctgcaatgcctcaagagaggagtttgtagtttagagcccagattattcttttagactcttttgttaacaggtaagtttactgtacattaaagtttgcaccttggggtgcctgggtggcttagtcggttaagcatctgacttcagctcaggtcatgatcctggggtcaaacccagagttgggctgtctgctcagtggggagtctgcttttccctttccctctgcctctccccctgcttgtgctcttgctccttgctctctctctaataaataaataaaatcttaaaaaaaaaaaagtttgcacctatattcacttttgtgtgtgtgtgtgtgtgtgtggtaggtatatcacacctggggcaaactgactactttcctctctttcattccacatggcttccagagactcaggcctctcttacttgggggaaagaaatggcatctcacctagaccttcagcacaagctacattcttcaatccagccagagaccccttccctctttgtgggaagatgaagtgcttactctgctattaaagtagaactctgttctgcatttggctctttcttttcatgtggttaacccaactgagtatgcaggatggttggcggtgtgggatctgggcagtctgggtctctagttttatacacccaaaataggacccaaaccttatttcaaatctctaatcaaacacttgtttcttcaggaagtctgaataacaatttcaagcttatccctgaaactgagcatatgggttctgctttttggcagaatctttaaaataaataatagaaaagccccaataagccttctagtctgcctccccaaaaccagaccaggatcatttcctacattagacctgcctaatgtttcatctgatttaatttttaatattttggatgatgactttcacaatttccctgaggagaccatttcataatttaatatttatctctcagacagggagtgtttccagtaatcaacccaaattttaaaatctcatcttgttctcttagagattatttcctctctgtgaaaagttaaaaatttcaaatatggtattaatatacccataatttcccagtaggcaatctttagttccttcaaagaaattaatacccataaccatttgttcttattgtttttcagaacacctatatttttttcctatcattttattttctgtttgaccttatcttccacctgtggtctcattctggttttttagttgaaaattttttacagtgattcttttgtggtaaaatatatatacataacccaaaatttaacattttagctatttttaagtacagtgtagtagcattagatacattcacattgttgtgcaacccccatcccaccatctatctctagaactttttcatcttcccaaactgaaactctgtctccattaaacacgaactccccctttccccaaaacacagtccctggtaaccactcttttactttctgcctctacaaatttgactattctaggcactttataaatgttgattcttgtttttcaaaggaggtgacacatctctaatacgttgtggttttaaatgatcacaaaaacaacaataaccttattacagctatattaattcaaggatgatattcaaaatcttaatggctggttggcaatagcaggtgaagctgaggagattacgtggcgagcggtgcccatggagcggttctcatggtcaccggattcctcctctgccctgtgtctcatggaagatagaagtgtacgagaagtactacaaaagcatttcaatgtcaacaaaagcctgtggtcattacacatgctattggtctttcagttttggaaatctgtcttataattgcaatgaaacatttaaatgacacctatgaagaggaaccctttaattttcaaatggtctataacgaatttcagaagtttattcaaaggaaggcccattctgtttataattttgagaaacctgttgtcatgaaggcttttgaacacttacaacaattagaattaataaagcccatggaaaggacttcggtaaatacgcagagagagtaccagctgatgaaactacttttggataatactcaaattatgaatgctttgcagaaataccccaactgtcctacagatgttaggcagtgggcaacatcctcactaaactggttatgaatataatcagttcttcggttatagtttcgggcaatacttttctaaggaacccaaagctattgtcctttaacaagatatgttattacattttcttttttttttttttaagattccattcatttattcatgagaggcacagagagagagagagagagagagagagagagagagagaggcagagacataggcagagggagaagcaggctccctgcagggaacccgatacaggacttaatcccaggaccctgctatcatgacctgagccaaaggcagacgctcaaccactaagccacccaggcatctcatgttatttatttttagagagagagaaagagatagcccacgagcgacaagtgggaggggcagagagagagagaatcttaagcagggtccatgcttaagaccctgagatcatgatctgagccgaggtcaagagtcaggtgcttaaccgactgaaccacccaggtgacgtgaggttatcttattgaccagacagaaatcactatcaattttcaataaggcactatttaactttcttgaatctaggctctaatcaacaggaaatagtaaatcaaacattatatttcctagagaatcagacttattaggtagtcttgttagataatgctctaatattgaaagaacacatggtactttctacttcatttgtagattttggatactttttctttacagtgatgtgcagagagcatggcttctcaaatctcttcactatccttttgaagacatgtttgggatgatggaaaattcttcctgcccagaatgaggttcaacaggttgggagaaaaccttggtggggggctcactgagtttttttatatacccaatcatgtcaccctgaaactctggtataatggccttagatagttacaaagtctgcctttaacaagtcacaacattgagttctaacatttgggttccaggtacaatttcttacttgtcaccagtgccttaggaaaattccaagaacaatactgtgaatacccgtatttcctttgcgtagactcactaattgttagtatttgtaagtttgctttatctctttctctttctcacactcccacaaatggattttcttgaaccacttgaaagttaaatatagagcagcccgggtggctcagcggtttagtgctgccttcagcctaggcctaatcctggggacctgggatcgagtcccatgtcaggtccctgcatggagcctgcttctccctctgcctgtgtctctgccgctctctttctttccctctctctgtatctctcattaataaataaaaaaaaatcttaaaaaaaaagaaagttaaatatatatataattcattatgtataatatataatttatatgtatttatttaaattatatttaatttatatacttaatatataatttaatataaatatatttaaaataatttaaattatgtatataatatatatctatttatataatgaaattcagtcctaaatatagtcctaaaaacaagaactttttttttttttttgagcagatactgcaatgctttatctagatccccttcagggatgaagaacttactcctccatactttggtaggccactggcatagagctcttagctgttggtctcttctggaaattgtcctggttgaagagactgtgtaccccaaggccacatctgccgaacgccatctgcatctcataattgattgatgtggaggctctttcttttttttttttttttttttcggaggctctttcttgactcaggataagtcagaagggccttgctagctttagctccccaagggtttatgttgtggagactgcattgcagcctaaactttctctgcccatttctgctttttatttttctccttctattttcctctataggtattgatcccaacaacactacctaataaaattcctgcatactaatctccatttcagtcggcttcctaggaacctcaacctgttcaatgacagaagtggcttaagagaactaaaactaatatcaattttagtgacttatttcagaattttgtcatcatgaccactaaaaagtactttattctgtcagatttaaactctcctgtttcaacaatctccaagaaatactaatttaaaaaagcaagacacagaatgttgtacatcatgagctcccatcccaactgtgggggaaaaaagggtgggataacacacttatacctatgctcatatgtgcatagaatatctttgtaaggaaatataagaaacctgtagtagggttgcctctgggagagatcaagtgtctggggttgggaggcttacctctttttttactataagccctttgatattgttctaatttctaccatgcactctatgactttttttttttttttttttttttaaagctggaaacaaaataagacaaaatggtaatggttgctagtttggggtggaaggaatgtggttttattgtattggttgcaattttctgtagttttaaaaatgaaagttgcaggggcagcccaggttgctcagtgatttagcatggtgttcagcccagggcgtgatcctggagatccgggatcaagtcttgtgtcaggctccatgcctgcttctccctctgcctgtgtctatgcctctctctctgtgtctctcatgaataaataaataaaatctttaaaaaaaaattaaaattgctaaaaccagactcatctgttttaccgattttttttcttgtggacatagggaccatcctacttactgtaacacttcacttgggcagcccttatggctcagcgatttagcgccaccttcggcccagggcatgatcctggagacccaggatggagtcccacgtcaggcttcccgcatggagtttgcttttccctctgcctgtgtctcttcctatctctctctctgtgtctctcatgaataaataaataaaatcttaaaacaacaacaacaacaaacaaacaaacaaacaaaaaacacttcacttacttgtaaggggtaatcaaagaattcgttaaccttttcttctatgagttaacaacctgaattaatttaaattttcattgcagtaatttattatctgttgatttgatgatcatctttgtcacttttcttagaaccttaagcacattcgctacattgttttcaaagtataattatcgaaaccagatataatgctgtttaccaaagatctaaataatgcagatgatggagctgattttttattaatggcctaaccttacagaatcatgttcaactaatgctcagtgagatttttttattcaatgtgagcataatctgaaattttgattaatctattgggatttttttttttttagttttatttatttaagtaatctctacatctcaggtggaatttgaactcattaccctgagatcaagagttgcatgctctcctgactgagccagccggcacccctaatctgttgggttttttttttagtaagaaagcaaatgaggtccccagaactgtaggcccatactatcaagcttatcacacaaggcagtgcatatgagaatatattctttctgcgggcaggcagagacaaaagaagagagaagttgctgaggcaagtgtgcacgattctttcaaaactcatcatcgcactggtcagaccttgtcctatggtgcagaaagatgagggtagggaggataacaatttctacctcagagagttgctatggggtttaaatgtattaatacattgcaaatattaatgcatgttaaaatatttttatattcaacatatattctctaattataaaacataacatgtaataataagtatgttaagttatactaaaatgagataaattctattaaataaaattaaataggttaaattaaattaaatcaatactataaatatataaatattaatacatttaatattaattaaataaactgatatagacaaaacaaaagagagctaggcatatagtagatggtccataaatgttaggtatctttatttatttttccatctccagtacttattagatgtgtagtcaatgtttattcactcattcattcagtcatatgtccaagtatttattgacctgttagaggaatattgcttctgatccactcctctggtttctatagggaaagatctttccagcacacttggcctcttctcctacccctcattctgatcctggaggcagagtggcttacctggatggcaagtttgggaaaggctcttgagggtagtggtgggccatagtctggcctctttctcctttcctctcttggatacatattctgtccttcctctaggagatgagttctgtgagggtcttgttctatgggcatgtgcatacagcaaagactaggggagtgaggctacctgatttttttttaagactttatttatttattcatgagagacacacagagagaagcaaagatataggcagagggaggagaaacaggctctatgccgggagaccgatgtgggactcgatccgggactctgggatcatgccttgagccaaaggcagatgctcaacagctgagccaccccaggcgtccctggtttggggttttgtactggggataccaattttgctgtacacctaaacctcatttgtcaaccactttattgatcataaaactgatatattgatctccatctgattgtttcctccgtatcttctctctcagttggctctaaacctaggtagggaaaagagaagtctcacttatgaatgccccccttcaagctccaatattatttaacaaatatttttatggtaagtgctggggaagagatagtcaagatctgaagcatgaatcagagtaaactccaagaagatatggtcaagattcccaggttgaaggacaaaggccctgtggtaggggagacatacaaagaagagaactggaaagaaggctggggacctggctggagagaatgaggggaatatagatcaaatgagggctgagtcagcagggacacatatatcctcagagcagtggaaccatttgaaagccatttgagaactttgcattctgaatgattttttttggctgctctgtggaaaatggattgtaggaaacaaaaatggatgtgggttgatcagcaggagtcaaatccagaggatttttgctctctgcagggattgaaatgatgggagtagaaaacaagagaacagatttgaatgatatttaaaaggcaaacttgtcaaaacttggtactggattggatgtgggcaataagagagatggaagtgtcaaaataactcctgaattttcagcttgcataaccaaatgaatgaatgggaagtaccgttcaaaggcatcaggaacaaagaaagattaggttttgaaagagaatatgaattcagttttgacatgttgagtctgtggtgcctttgaaccatccaggaagagatgttaaggcattcaatatatggatctagagttcagaggagagagctgggctgaaaccatgtaatcatcagtcactgtgctatatatatatgccttctctcttccttgtccctctctctcctcaacccatctctcactttctctatgtagtaattagagtaatatatatacagtaattaaatggacttttcctctctccctctttccctccctcctgcctttcctcctgtatatgtagtaattaataggtgtacaaagtaattgaattaaaattgtgtgtagcaattaaagacagggagagacagatgagatcacctagggagaaagtgtagctggatggagaagagaagattgctcaacactgagccatgacctccaacaaatagaggtcaaatggagggggagcaacccacaaaacagactgagaagaagccacaaaatggaagaaaagtgggagagtgtggagtcaaggaaagaaaatgtccaaagagaatgcttggacacttcaaacattgaaatgtttgtgtagatcttcaattcagtgcagaagtgaagatctacaacaaatggctatgcatgatttatcctgatttttatcgctttttatcaagattttcagaggttgctttattcttaactcatacctatgctggaaaataccttacctctcacattctgtgtactcaacattcactgaacaccaactctatcaaaataccccagggtgaaagcctgaggctagtaggcagggcttcacaggggcaaataatagatggaaaacatgcagctaaaaaaaaaaaaattaaaaaaagaaaaaggaaaacatgaagctacaaagctggaaatctaataggctaccccagatgaacaggacgggaatggtgagagaaaatggtttacaagtattttctgttttacatgtaaacgtttgaattttctggggtgatgttgccccaaatgcttcaatacttatagcacttgagcatatatcctaggacagcagagtgacttcattaggggaagacatgaaacaagaaggcaatgttatggtgtgacagggacctgaagtgaagtaggcaggtggaaattcatcatcatccacctcttctgaatgtcatgatgacattttctaggaatatgagtaagaattgggcaccttgtttctcccttttgcttgtttttttggcccaaagttttttgctttttttaggggataatgagtgtctgccatcaacattctcttctgtatctatttgcagtcattaaaacaggaattctaaaaatcgatggtacagctagtcatatacttcctgaaagctgaaactttgttttgttcactgttataaccacaatgcgtggtgcaaagtaggggcttagtgagtatattgtctgtgaatgagtagatggatggatggacagatggatgaaaaagcaagtggagatcatctttactagttattatacaaacaggaaaatacattatcatctgaaacaagccacagaaactggcactctgccagcgacacaaatgtgaaatggcatgaagcacctgttaaagcctgccggatcccctcccttctgccttctgtttgcccaagctgtgcaaatggcagagcttgattaactcctccaccgatgtcacattggctaatgagaaggaagttcaccaaaccacagaaagggaagattcaatacaaaccttgcattcagtagattcttggtaaactttttgactcattcatgactatctgaacactatcaatgtgttcaaatctacagggcctgatgttttgcctttgggatatatcatggatcagtttaggtcactgtcatgctgctttgctcatggcagcttctaaggactaatgcattcctgaaaactggaaaaagtccaacttcatgtctttctgaatgaaggatgaaagggatgaccttgaaaattattaagctagcagcaataccctgaaaagtagtacaataaatcagcaaaatatcaatttagaaatgctgagaagagactaaaacataaggtatggttttacaataaatgatcctgtctgactcacctcatttccttctaggcagggggataagcctggttaaaggaaagagagcaataaattaaacaattttttaacctatcaaaaattttcatttgtcttacacaacaatttaaaatgaggaaaccatattgtggggagatatattggtaggaagattaaattctaagaagaatcattgtcaaccatataaaaaatgtatttcaaagggacttcaaagggttgatactggctctacattatcgaagatgtatttattgaacatttactatttttaaggcattgttctagatgctggagatgcaacactgaacaaaacaggctaaaatccttgccccatagaatagaaagtgtgggattagacgttacaattttagataaaatggctattggaagacttgaataaggtgtgagagaaagtcatgcaggtatttggggatgagcatttcatatgtgaaaattgcatacaataaggcccggaagcaaaagcatacttagctggtattttacattgaggcaacagtgggggtgaataggagttgaggtcagagaggtagcaggggccagatcaggacaatttactacttttagcaatgactactggttgtttggtgctgggtagctctttgtatttgtggggaacactccatcgtgtaagtctaggtagggagcagaacactctcatttccaacctttaaagtgggagggaccctctcctcactttctgatcaaagatggaactagtagagttggacaaatggttgttcttattcaggacttagaacaataagggaaagaattaaagcctcaggcccaagcccagtagcattgacagccccacagcctagtgtgtatagtgctagcaacagtgccctgagcagagcatccctgtggtgccactgtggatatgccttcccaccagccttccttagttttttgtccctgttctgtgtctagttctctgaactttctgtcttctgtaaacaacttgataagccaatgaaaattccctttctgctcaagagagccagaattgcttcttgtgccttggaactgaacatactgactgatacacatggaactcaggatataattcaaaacatccattcaagctaaagtgctgattaatcaaaagcaggcagacatacagggaaaaaacaaactaatactactaatactagattcattactcctgctcagaactgggatttatagaggataatcagctaacacataacaggtctatagagtgtggtagctcatgtttccaagggtgctgcagtggtatctcccatcctacatgctcttttgcattgtgaccttaccactcccctagtaactgggggatgtggaatatgtttcctctcctctttgttttggcaaatattttatttatcattttagagaaagatagacagcatgagtgagggggatagcatggagcccaacacaggcttgatctcatgaccctgagatcaggacctgagctgaaatcaagagtcagatgttcaactggctgagccacccaggtgcccctgtttcctctcctctttaatctgtgctgattctgggacctgttttgactaataaaatgtgacagaagtgatgcctaattcccaaggctgtgtcttcatcttggaagccatgtgagaagtctcatcactgctagacagaaaccagtggacagacacctgaaaacaacttgagcaatccagctccagtcaaactcccagctgaatggagccatatcagtgagcccaagcactgtcatctgaaacagaaggaccacccagctaatcccagttcaaattgttgacccacagaatcatgagcaaataaaatggctattgttttaaacagctaagttttggggctgcttgtcacacagcgttagatgacagaaacatataaatattgtcataaaataaatttttaattaagcaccaaattgcatgtggtttcagtcaagaggtacacaaagacaggtgtgtgtgtgtgtgtgcgtgtgcgtgcatgtgtatgtgtgtgtgtgtgtgtgtgagagagagagagagagctctgcccactgggcctaactctgtaatagatataactctcccaaacgaaagtaagaaattcagactgtgcaagaaaactgtggaagcaacatgtgaagatgtgaaaagttattactgtgtttagattagatataggatataacaagaatgtgtgtgtgtgtgtgtgtgtgtgtgtgcatgctcatacactagcatgggttgagggaagatcaaggaaatgtctgagaaaattgaagaagaaagaagaaaagggaaaacagtcaacagaaggactcatttttctcgtgggaccatatttgaacctaagacccactggaagtaaatttattaaactgacccctgttcaactattgatcacacaaactcttcatctaccatttcatccttcagtgtagagacatgattttactagtttggcttgctgatacatccccaaaggactggaactggacttgcctaataaatgcttattggaaatttgtggtaggaaataaacaaacacacatggaaatagcaatatcattttaaaattttacctaataaatatcagaaatgtaatagagtagttcatccatattagggtttccaaacagatgactagtgagatgggaagaggtagagtgagttggaaagagttccataaatctgcaaaatagatatgataccattaccagaaactcagaaagcgttataaaggctaaagttcaaaataaagccaaggtttgtgaaaactttccataacaaggctgtaaacctatatccttcagcaatggttccctctaatttaggtctctaattttatcttttcctttgggtttattttcttaaatcagaagatcttaaaactggaaagtataaaatatacgtgtaaagagataaagaaaataaagcattttgctccttctaaatgagtttagatcattaggctctacaaacacggtctggcagaggttggcctgacttcacggagtgtcctcagttggttctgcctcagagggcctggagacccatccttcctggatggagatgcatctggtcttacagatttattcttaagtctggacattatttaggctgagcagcttcataaaacaccacccacagtgccccccacacaccaccaccttgaggaaattagctcttacaagcctttggtaggtaggtctagtggtattcagtcggctctttgcaacccatcactgccctccagcagatgcagcaccagccatgcctgagggctctcctcacaggcaaccttgacaaccaggcacctaagaagggcagctggatgaaatcttcctttggccaaatggaacaccagcctctacagcagcaggtatgtacaggattaccatacagggaagcccacacaaaattcttttctgtaccagagtgcagtcagaaaaccccaactgacttctcagtctctggaatgagcaggatcttgacaccaatgcattatgccttctttcagcggactttggtgctcgggatacagatacacatgctgagtcctcccttgttttataaacctctgctgatacaatgcattagaataccaaataatattaaagtattactgatcatggggcacccgggtggctcagttggttaagtgtctgccttgagcttgggtcatgatttctgggtcctgggatcaagccctgcattggaaccccccactcagcagagaatctgcttctccctctccctctgactctcctctccacttgtgctctctctctatctcaaatgaataaataaaatctgaaaaaaataaagatcatcaaaagtaccaaaatgattgagctttttccccaggggaaccctgaatgctgctttgtccaaatgaccttggcaaaatctgcaaagtttacacatacactgcctggtctattgaaatgaactcatactgtgctatatcgtccaacattcttatggttaaatgcccagaagtgaactcataaagttaaataactttttcaggtcactgatctatggtctaaccttaatttatcctttagcaaatgtcatatgttagctggcccacagattaaatgttttttgaagtaaaatacaaagttaaaatgttaaaggaattatacataaatcatatggcatcaagattaaatgtacatcatttcaagcattatttgcaaaaaagattagaagtaactcaaaagtctatcaatgaaggtttagttaaagatactgtgatacatccaaatgtaggaatactatgcacctgtccaaaagaatgaggaggcaaggattgaacaggaagggaaaggtttccaaaacatggtaagttaaaaactgccaaaaaacaaaaagcaaaaaacctaagttcaaaaaagtatgtcatgctttggtaaagaagggcaaaatataaaaatatatatttgctatttgcttgtagatgtactgaacaactctggaactaagtatatgttaagaagagggacatatatggagtgtaggaactaattaatggagacgtgggttgagatgaagggagacattttactgtgtaactttttgtgtgttttggttttggcccatggcaatgtattacctattcagaaaaccaaattaaaaaaaaataaaattaaatatgtgcaacagcaaaacttcagtaattcaggtctatatattgggaatttgtggtgagttgaacatgttaaaggcaggggtgatgaaattatctcttcattccatgaggaagcgaggatacagacactctggaagggaaacaaggtttttcccccccaaatctccagctcttgtaaaagagtgatgggaacagaagagtagcatgcccctatcctcattccagctttatccaggtcccccacaggaatttcagtgcacatgcaagtgtttaacaaaagcctaaaactattagagccttatgcattcaacaaacatatattaaggacgtactgtggggatacagatgttaataattgtcaatccctgtctttaaaagaatcccaatccagcagccaggggttagatagtaaagtggtgtgatacaggtaggtagacacaatgtgatatgggcatagaggagggcctgatccaggccaggaaggtgtgtatgtgcgtgggtgggggtaggggtggggtaggggttggttgtagatgtcagggcaaaatgccccagcaggacaaaggtgaaagactaccaggagttaaatgaagaggaagatgggaggcgatccagagagagggcttgttatgtgtagagtcagaatccagattcttccagcttgaagggtaggaaaggaagatgggggaggaaatggcaatgatgatactggagaggagagagagaccagattatgaaagcctttgaatgtcgagctaaggattcaaattttgacctaaagtttaaggatacttacatcttaggtttgggttgtggacagaggtgaatctggagatgccatgaagctcaaggtacgactgaggagagagatgtaataatttgcatgggaattagtgcttgtggttgatattgaatgcccactcatttcagccaatgtgtataaaatttgttactattacttttgagagtgaagacagagcaaggttgtctcaatcagagtgttaacagcaaacagaaggcccactcaaagtgggatgattgttgaagggtttatttacagacagacaacacaaaggtgtgggcctggagtcactgcaaagaattctggagtaccatgggtcttatagcagcgtggctgacgatgtgtgcctaggtctgttatagacagaatgtctgcatcgcagcccccctaaattcacgtgtgaagctctaatccctaatgtgatggtattaggacatagagcctttgggaggtaatcgggcttatttatttattttatttaaatattttatttatttattcatgagagacacagacagagagaggcagagacataggcagagggagaagcaggttccatgcagggagcccgatgtgggactcgatcctggaccccgagatcacacccgaaagcagatgctcagctgctgagccaccaggcatcccggtaattgggtttagataaggtcatgcaggggtcatcatgatgaaatcagtgtgcttatgagaagggaccaaagaacattctctctctcattctctctgaggacacagcaggaaggcagccatctgcaagccaggaagagggatctcactggaacctgaccatgccagcagcctgatctcagacttcccagtctctagcactgtgagaaataaacttctgctgtttaggcacccaatctgtgggttttttttgtttttgtttttgttttttttggcagccaagctaagacaaagccaagcaggcaagggcaggaaactgctctttgaatctggaaggagtgagaccatcatgtaaactggcgattgagaagagcagtggactctggtcaggacctcacagggagcaaagcagcacaagaaatatcctgacctcccatttctccttccttctcttctccagatcctcagagggctgagaggcccagaatgtaggtcagtcttcagggactaaaagcaggacacagagaatagagcatgagtctaaaagggcaaatgacagaggcctggcacaaacatgataattaaatttccctccatttatcctgtcttgtgtgctcctcccaccccaaaaaagtaaaagagagtttttctatgagttaaaaaaggatgggatccctgggtggtgcagcggtttggccgcctgcctttggcccagggcgcgatcctggagacctgggatcgaatcccacgtcgggctccctgcatggagcctgcttctccctctgcctgtgtctctgcccccctctctctctctgtatgactatcataaataaaaaataaaaaaaataaaaggataactactctaaaaaatgtataatggctcaaatatcttacagcttgtttcttgttcacacagtggtgccaggtaaaccccactggtcggtggggtgcctcctcttgcagtcttttgagcaccagagctgatggagtctctgctgtctttagctggtagcttccaaggtagccctggtggtagtctgtgttccagccagctgcgaggggcaaagggcaagacagatcaaatgtgggaagttttagtgggccaggcctggcagtggcacaggagacttcagctgggactcagtcacagggctgttcctatctgcaaggaaggcggggacagtggtacagccatgcgcccaagaagaggagagcacggcaagaagcagctagcacccctgccatagtacagaaataatgtcctttagcaaaaattggtttgtactaataagctaacctctagatagaaccacactactcttaagagatttatgaagtttattgccccactcttcacagtgaaattttgcaaagagtgcaaatcactaaagacctgaattagccaagaatgtcacattttaatttcaaaatttatagctcctttattttacgttccttacaggaaagcctctctctacttccaatttatacctcttttttgatgatgatgtcatcctcccataatataggtgaatgagcccaaccagggtttcagttttgttctgttttgtttttaatattttatttacttatttgagagagagagagccaagcggagaggcagagggagagggagaagcagactccccattgagcagagagcctaatgtgggctcaatcctaggatcctgggatcgtgacctaagccaaagacagatgcctaacctactgagccacccaggcacccccagtcaggtttttgaaagttgctaaaagcacatcagaaatatacactgccaagaatcacagaagttgatcacatgagagggaagaatgattctgttcagatggcttggtatcattgtcatgctattgtaatatagtccatcatggatcccttaacaaaatggatcatctgtaagacttctgaactgtcctcttgaacctcccctatgtttccctgcatggtaattcactcctttcttgtgggctactgtgtgctattttttgtgtccatcacagggaattatacatcctcagtttcaagtctgtaaccatcttgagagcagattccctgccttgttgcttttatcctcagcttttcacacatcatggtgcttgtgcaggcaatacattggaatgaaagaaagaataaatgaatatcagtgagtataattttattttgggctgctgaaaatactttttgttttttgttccccgcccaaaaatacgttcttattgatggatgtaataatcgctatccttaaacttaacatttgtacatatgtctgtctcacatttctacctagaaaaaaaaataaccaaaatatggccagtgttctgggatcatttcctctctctctttttttttttaaagatttatttccctattttttacatttttaaaaagattttatttgggaaaaagagagagcaagagaaagtgaaagagagctacagagagtgagaaagagcacacgcagggggctgagaaggggagaagcagactccccactgagcagggagcctgatgcgggtctcgatcccaggaccctgggatcatgacctgagccaaaggcagatgcttaaccaactgagccacccagacaccgcaagatttattcccttcttttaaaagatgcaaatgtatcctaacaatccaaagttataaaaaaaaattaaataggtagaggaagacaagtctgatttgcaaaaagatttcaagcaccaaaatttcacaactgtttgccaaactgttattagtaatactgctattcttttctttaaatatattattttttaaatattttatttatttatttgagagtgggagaaagaacaagttggggggaaggggcagagggagagggagaagcagactccccactgggcagggaccccaatgcaggactcaatcctaggatcccgagatcatgacctgagccaaaggcaggtgcttaatccactgagccacccaggtgcctcttaaaatatccttaattgaggtatgattggcatacacaaaaagctggatatggttaatatatacatctttatgagtttgaaggtaagcactcacccctgaaaatgtcactataataaacaatgcataaacttaaccatcgcccctaaaagtttcctccctccctccttttctttttctttttttgtgataagaacatttaatttaagatctacctcttaacaagcttcaaatatacagtatactgttgtcaactatctgcattatactgtatactctaggactttttcatcttggaaaattgaaactatatatcctttgaccaataattgcccaattccccctcctccagcacctggtaatcatcactccactctgcttccatcagtgttctttatataaacaaattaatagtttcatagatatttaattttgattaagtaattgctggctaaactggagggtattatgctgagtgaaataagtcaattggagaaatcaattatcatatggtttctactcatgtgtggaatataaaaaatagtgaaagggaccctagggaaaggagggaaactgagtggggaaaaattggagaggaagacaaaccatgagagactcctgactcttggaaacaaacaaagggttgcagaaggggaagagcataggaaggaggggatagggtaactgggtgatgggcattaagaagggcacatgatgggatgagcagtgggtgttatactatatgttggaaaattgaatttaaataaaaaaaaaagtaatctttggctaaaagatacttttaactctgtggaaactacatcacagtttatagaagcaataggaatgccatgctattcttttttatatatatattttatttattcattcatgagagacatagagaggcagagagagaagtaggctccctaaggggagcccaatgtgagactcgatcccaggaccccaggatcaggccctgagcagaaggtagatgctcaaccgcttagccacccaggcgttgtgccatgctattgcttgtgccatgctttttgcttacgtacgtgttcaagaaagcaatgacacaagataaaacttcgaatagcacaaaggggtatatacttaaaaatatctctctactacctttgttctctcatcctagtggtaggcaccagagacatcaagtgaggctgtttcctgtatattctgagtttagacagaattctaatcatatgtaagttgtttttgaaaaattacacatgcaattacacaatatgattttaaagggcttttatttggcatgtaggattatgaaaaactctctgagttgttatttttatgtaagtcatagagatgatcctttttttttaagagagggagggggaggggcagaagaagagggaagagcctgactgagggcttaatctcacaatcctgaggttatgacctgagcagaaatcaagagtcagacccccagccaactgagcccccccaccacacccaggggccccacaatgacccttttaatagcatctataaggacctcatttgaaaaagggatagagagtgatgctatttcaggtaggaagatcacaagaagcctctctgatgagtagagacccgaatgagagaaggaggtggtcatgagaaaacaagtgcaaggttcttgcgattgttgtaaaaaaagatgtccatgaatgctcgatgctcttcaagaggtggaacttaactcccgtgcccttgggtgtgggctaaatttgaaataaatagatatggaagaagtggtggcatgttacttctgcaattaggttttaaggagattgcagcttctattctgggtgcccattttctcccatatcactctccccagtggaaggctctggccaggagagcggcttcaggctctgcagaaaggcctgtgtggtaaggagcagaggaactggccagtacctggccagcaaccaggaaagaactgaggtcctcagtccaaaaatccatggggctctgtggcctgccaacaaccttatgagtgagcttaggagattctcccctagttgagtcttcagatgagactgcagccacagccgtaagcttcactcttcccagaccttgatcagaaccacccagctaagccacgcccagtgttctaccctcaaaaaccacgagatataataaaaatttgttattttaagctgctaagttgttttatgaagcaacgtataattatttatgccccgaggctgcagctggcttgccaagttggagaaatagcaaggggcctaacgtggtgaaacaaagtgagcaggaatgggcacagtccatggtgaggtcagagaacaaacagagagtcctgtgagcagcgccaacagctctggctgctaatctgaaggaggtgagggtctagattgcagagttttgagtagaggagtgacatgataaaggatggacctgatgggacagatacttgggcagtggggagtgtgggagaccagtggggaggctgctgtcccaggaggctgcctacagtaatgagggtgtggtgatagtgctgagcactgactgggctccagtaggctttgctgttggagccagtcacagaggaaagaatggcacatttctgaagaggctggcctgtgccagaattaggataattccatgaaacttcaggggaaaagatgaagtgataaaattggtttccaaaatacctacctggcagctctcttctccggcctttgggctggctccttaaagtctcttgtcctcacacatgtttcttcatgttctttttcctcttctcctctctacctattaaaatctcctcccagggaagaatctatgaatttgttcccagtgaggtataaataattgatgagataaaaatcaatagcatttgtttatactagcaataagcaactggaaaatatgtaatagaataagatactttcacactagcaacaaaaactacaagatatctaggaattaaagaatatacttgagctgtagaaggaataattttaaactgtattaaaggacataaaagggaaggcctaagctggcttagataatggaaaatgtgactcttgatctcagggttgtgagttcgagctccacaactgggtgtagagattacttaaaagtaaaatctttttttaaaaaaaaggacacaggggatgcctgggtggctcagtggttgagcctctgccttcggcttggcgtgatctcagagtcccaggatcgagtcccacattgggctccctgcatggagtctgcttctccctctgactatgtctctgcctctctctctctctctctgtgtgtgtgtctctaatgaataaataaaaccctttaaaaaataagataaaaaataaaaataaacaaaggacacaaaagatctgaataaatgggaagatattccatgctcataaattgaataacttaaaaaaaaacttaaaaaaaataaattgaataacttaatattatgaaaatgaaggtctctccaaattaatctatagattgaatcttatcaaaatgccagggtttttgtttgtttgtttgttttttgagaaacactgaaaacttatttttaaacttatttggaaaaacaagtccatgatttagctaagtttcctttgaaaaagaaatacatagaggtgatatttaagacatactactaagctacgattgtacaaacatgaaacctattcaaggacaaaatggataatggaacggaataatagatggcttagggacagagctgtatttagattagaacttggtccccacatacaatgtaggaaatgatgcagctagagggaaaacagtaggaaaagatgtttactgaatgggaaaactggctcactacattgagaaaaataaaaccaaatccctaccaactgcatcaacaaatgttggctcccaaaggggtaaagatccattttcaagactatcatgaagttcctagaaaatatagaaatcattgtgatctatgtgtgaagaagggcttctgaaaatgcaaaaggcataaaccaagagaggaaaccaaatttgcttgacgttgttgaggttgcccttcctgctcctgctgtagccatggagtgcggaacctccaggtgacttgttttgatagtttaatctgggccaacacagcagctcttcagagggatccactctgctgacaggtaaatccacccccagagactaaggcatcactttccaacctctcatctgagatgtgcaaatgggatcccatctttgtcacttccagaaaatctataaatactaccccttcccagctacccaggcttggggaaatgcttagctccaagctcagccttgaaccaatggacttatttaaatcagtcctccatactaggtcccaagtgcaaaaactttttttcattgggagaaaaataataaggaccgcccccagatctttagagtcagcacacaacacattaagcatgaataatacaatgagtaattgaggagaaaaagagccctgatgtaacatttcctcttgccctccatcatagaaatgggttttgaaaatttagagaaatctttattccatccaggaccccgcttatttattcaaggtgccattctgatttcactttttatacttagtgcctcctaagggcctttggaattactctgagatctgtaaatgagtactggagtgtttcaattttggtactctcgagttgcagggatacatatattaagttgttggacaaggagaacccagctcctgcctcaagcatcccacaactctcagtggtggctgactgacaaagagacaaatgtggcaggaggtggtaagtctaaggaggtatgtgcaaatgtgatgttgtgggatgccacctgcttccttgagcatgacaattattacaaagctgagctttccctggatattgctgttgttctgtgttttgaagctgatcatacttttagatagtttaaaaccttagtttaactattataaccattagagcttactaaagtaattagcactagtcagttttgaacatcctcaaaaacaaatgattgtaatcaacctaacgtagatgttacaaaaaaaaaaaaagtgcccaaataataaaaagatgtgactttgaccaaattaggcaccatctttaattctgtactaattaggaaacttttgattgcaagcaacagcaagtccgactcagactggctttagaaataaggaagtgtgctaattcatgtaataggaactccaaagctatgacaggctcaacaatatcatcaaccacccagattttttctgcgtctcatcactgctatccacaggattcatctgaagcctggttccccttgtgtctctaatatggctgcccacaccaattttagctatgtgattccttgttcttatccactagatgagaaagcaagtaaaagtcctgatggaccaacttaattaatatgtcccctgctcccctggttcaggagctgtcaccaaagggattgctgtgtgctgtttggctcaaaccttgcttaccaaaccaaactctgccaaagtggggagaaggaattactgaaactggtttaggttaatcagagcacattccttgagcaggaatagaggggacagagtcattttccttcaaatcccatgggctgcatgagagagtattggatacctcaagaaagtctggattctcttgggaaggagagaaaggcaaatggatgtgaagtgggcaccccaaagtgacaacttcaaggcttgatctacagtatagaggaagggctgctggatgcagtatggatcagtgagggttggcaaagacatcagaagggatgtctgtggtgtgggcctcagacatattccccccacatggtgtgccatgagggagacttcaacatttccttgtaggaaattatgggaacaggggtgcctggtggctcagtcagttgagcatctgactcttggttttggctcaggtcatgatctcagggttgtgagactgagccctgtgtagagctccacggtcagcacagagtctacttgagattctatccctctgcccccaccccctgcttgtgtgtgcatatacacacatgtgctctccctctcaaataaataaatcttaaaaaaaaaaagaaagaaggaaatgatagcttaggctgggagtgcctgggtggctcagtgttaagtgtctgccttcagctcaggtcatgatcccagggtcctgaaatccagccctacattgggctctctgcttcctctccctctgcctgcttttccgtctacttgtgctctctctgtgtcaaataaataaaatctaaaaaaaaaaaaaaaaaaaaaaggatgcttagactggctgcagaaattttcaggtggctctgaggagcagcaggagaggtggagtttaatgaagacactcttgacgtatttgtaggaagcaatctgtcagtgaagttggtagggtaggggaaaaatacctgtgaattgtgaatagccccacatttgttgattgctgggaactgagtagtagagagggctaaagcatcacacacacacacacacacacacacacacacatatacatacacacacactattttttttaaagattttatttatttattcatgagagagagagagagaggcagagacataggcagagggagaagcaggctccacgcaaggagcctgatgtaggactcgatctggggactccaggatcacgccctgagccaaaggcaaatgcttaactgctgagccacccagacatccctacaattttgtgttacaaggaaccaggaagaatttttgccagctgagaacaaatattgctccttcagctaaacctcctacaaattgctcttcgaggaatacttcccttgtgtctggctctgccacttattagctgtataaccttggggacttgttgaacctctctgtacttcattttgctcttatgtaaaattaggataataatagtacataccttcctggggctgttgtgagtgctaagtaaattaatacatataaatcatttagaaaagtccttggaatttagtaagcacaatgtaccattatatatatgccaatatatgttatggacattttgaacagacttaaacctgtgaattgctgtggacagtgactttcgtacctcccaccatcttcctttttgaatgggagtgtttgttatcctttgcctctgttaggtgcatgggcaagtgacaggtcacattagtttcacaggtctgcagatggggagaattgcgctccaggaactggacctaatgagctatgtctgaggtacctgagccacacctggcctggtttagatgatgacattccagacttcaaagtgatgctgtaaggggatgagacttttggagaacattttgcttgtgaaagggacatgaatcactggccagagagcagacagactctaggatgaccccccagtgaatacccatatcatagtattcactcccttgtgtaattccctccctttgagtgtgcgtgggacctgtgactcaattctaaccaatagatggtggaatgtcacttctatctattagataagactggataagatggtaacttaaatcttgccagcagactccctcattgactctctcccttcctggctttgatgaagtgagctgtcatatagccaggaacttagagtggccttcagcagatagccagcaagaagttaggccctcagcctgacaacctacaaggaactgaatccttccaacagccatgtgatcttgccagcatgtccttctccagtcaagcctcagatgagaccccagcctcagctgacactttgactgcagctttgtgaaaggtcctcatgcagagaacccaactaacctgagtcccacagaaactgcaagggaataaaggtgtgttatttttgtcgctaaatttatggtgacttgttatgcagcaataaattactatataaacacatctgaaaacttaagtttccgataaaggtagcatttcagtttagttgggggggattgggtttttcagtaggtggttttggaacagctggatagccatctgaagaaagatatagatcataccagtacaataaattctgctggatcacagatttaactgctaaatgcaaaataatacatcttatatagaaaatatggggccaagttatcataatttcaggggaaatactattaaatgctaaactttctagatgctagaagttaaaaggtaacttcaacagcagaaaactaagaagagttctgtatgaaataaacactgtacttatagggagaagaaaaacaaattggaaaacaattttctctatatatacgttgacaaagggctattttccttaatacatagagttcaatgaatcagaaccatcagtacattagagaatgggcagagaacatagatcacagaatagtaaataccagtgcatcgcaaacataggtaaagatgctcagcctcacttgtaaaagagaccaaattagaattatgagatactatattttaactcctcaattggcaaagaaagttggataatcctgtgctgaggaataagggaaatagacacattcatgcatttgaatataaactggtataatatctcagaaggacaattaacaacatttcaaaatgtcaaaatacatggcacctgtattttgtctgtggagcatatgactctttttttctgttaaagattttatctattcatgaacgatatagagaaaggtagagacacaggcagagggagaagcagactccctatgggtagcccaaagcggaactcgatcccaggaccccgggatcataccctgagccaccaaaagcagatgctcaaccactgagccacccagatgctctggagtatgggactcttgatctaagttgtaaattggagacccacgttgggtatagagattacttaaaaataaaatcttgaaaaacaagtaacaaaatatcaaaacataacacagcaattctgcgtctagaaatttgatctgtatagagacctgcacatatattcaaagatactcactaaagcacagtttgtcttgggcaaggattgaagataactgtcatgtgtattaacagggtactgctaaatatctagggtactgttaaatgaacaaataaacaagggagttctgtttgtactgatatgaaacggcttccaaggttgttaaaaacaaagaatgaaacactgtgtaacatatgctatttgtacagaaatttacatatatcagacatgtttgtgcatgtaaagaacacttgtggaaaaatacacaagactcaagtaaacagtgcttgcttccactatgaagaaggaggtggccagggtgggccaagtaagagaggcatatagtcctcatccacaattttttgaatattttggatgaatatatgaatgtatcctctattcacagttattcataaaatagtataaaagaggcaatgttttgacaccaaggactctgatcaggatttaaaagacagtcatactttccggcagagagagcccgtgaatgccctctctgttggcaaaaaggagagaacgcccactacgtttttaaagtgcatcttaaaatagtgtattgcaaagctcactgggctcagccctttatgattgttggttagaggactgtcggggatcattttccaaaaaccaacttgcggccctctctattccagaagttgttttttttttttttctctttttttttctgtgaaaatgttcaagacttggagaatgtggctagaaaagctgggaactacccgtaaagcaggtggggaagcttcagagcagtggtcccatgcaccctgttcctggttgttgactttcctcattccagccagtgctgactttcctcattccagccagtgctgacgctcctctttcctgggtccagcctttgacatgagctctgcagctgcttccactgacccctcctcgctccctctccaagtctggaacagccctagctggcaccatggcagctgtgactcattgcaaatgctttgcattccgggatggtctgcagggtttgggtctcccctgtggctccaagcattaggcaagttgaaagggaggagaacaaggggccccacagctgccaaaacattgcaaggaagagggaggaattgttaggaaaattggaaaggtttttgtcccggcaggaccccagccagctgctccttggcttgggcctgcggtagcttgagccgggctgggggacatggtggaggcctacccaggggctcattgaagccccggtgaggcccattcacacatccagaagctctacccaccatctggagacatctctatctgtctgggaaggactgggttgaagccactttagaaagcagacatgggtctcattcagaagtgttttttttgtttcaaatattagtttacctttaattcactgggattattttgttagcttatttctcctcccctcctcctataactgtacacaatttattattttagctgtacacatttatattcaagtcaattgacatccttttttttttttttaaaagatcatttatttattcatgagacacacacatacaaaggcagagacataggcagagggagaaggaggctccatgcagagaacccggtgagggactggatcccaggaccctgggatcatgacctgagccaaaggcagatgctcaacccctgagccaccgaggtgccatgacatctattcttaaaatgttcgtgtttggatccctgggtggctcagcggttgagcatctgcctttggcccagggtgtgatcccggggtcccaggatcaagtcccacatcaggctacctgcatggagcctgcttctccctctgcctgtgtctctgcctctctctcactctgtcatgaataaaaaagtaaaatcttaaaaaaaaaaaaaaaaaagttagtgttcttttcctcaaagctttggaactctatgctgaaggctttctgtaaaaaagaaaaaaaaaaaaaaaaagccaagctacccaggttaatttaacagatgggtaggagttagggtaggtgagagccctgcccacacaccttcacctcatttcttccctgcttttctctctgcagactccaatgcaccataattaaaaaaaaaaaacaaacaaacaactttataacttaatcaactttattgaggcatatttacttataataaaatgtacccattttaagtatacagtttgatgaattttggcaatatccatggaaggcataatttgaaaacagtgggttagtagatataatgaaataaatgtacattttttaagggggagatcaacagtatttaatattcactatattatcctaactgcatgcatttacatcatcacatattaagcttcctttgctatcaaacaaataatgatagtcaatttagttttacttgtatttcatagaaggaaacaacttggatttaacacaaaacaaaattgaagtaaaagaattgctaaattctcgataaagttttcttctctatgagaaatattagcttctaaaatctctttttaggattcaggaggaattttgaaagtcacgtttttttttaaccttgacctcttctatatataagacaaagataacagacgataacgttctcacacctactcccatctgcatatccccttcctcttttatagtatttttatacagacatgtttggggcatcggcattctcacaacagtacaatagtttgtactggtctatattgaaatggttttggtattcacccagagcctcttatatggcttctccatcccccttctgtttttcttctaattttaattcttaatttccagcctatcattatgaagtttttttttttttttttttttttttttgagagatgctcatgggtgctgggtttcctttcattttcatgttttggaaagtctatctcctgaagtggcaacttcttttgttaagatattcttgagttaggagttagtcactgctccagtccagtcttttgccactgaattctgaggtcagtatgttctctgcagattatctgatactgtcaatctgaaagtgtgaataattccttacttttgagcttcagtaggtaggccaagatgggcctcagggttgggcagtccatgtggaatttttctggaatgcagtatgctctttaattcagcagatctgcttttgtttcagggacattctcttgggtagttttcatttgagtggtttactacttcagacaccacttgtcattacatgaggtcgcatttatctgatccccactatctacctcctttctactaactttagtctttagttctttttttttaatttgtattttatttttttgcaagatttattatgagaggcacaaagagaggcagagacataggcagaggtagaagcagactccctgtggggagccggatgcagggcttgatcccaggatcctgggatcataacctgagccaaaggcagagctcaaccagtgagccacccaggtgtccctagttcctttcttttttaaaacctgtgtttactgtggttatatctaacctctgctctatgttgtaattcaagttttagctgtttctctgttctttgctgtttttttccctagttttgtaattatgttgttttgtactcattttttttcaactcattctacttttttcttcttttatcacagggtatttgagctcatgttctatttaattcatgtccttaaaatgttttgtggaatcaagctgttgtaggcaattcccttgtttctagggtttttgaattggaccatttatctattaggtttgtgactgtttccctttctttgaattgttaaaaagccagtatgtttgtaaaatacctttgtaatttttttctcactctgctcacattctatctaaatttcctactttctatttgctttgagtcaggattctttttcctctataaatatatgaaactggtttgttccagtttgttttcctttctataccacggtctgagggctggaaatttggggtctttacatgttctgtaacttgaagtgatgacaagggatggaagagatatatatcagctaggcaatatgcagtcttacaagacttgtgctctgcttttctgaaatttggttaaatatcccttatcagttcttttttaccctgttggagtttgtatcctcttcttgggagtggtgggaggaatacctttaggattatttaacaatcagaattaaccatctaaactgggattaaataattagtaatgtggatagctcaagagcgttacttgacaattagttattgaaattcatggcatttggtgaagcacctccttgtttgattattgtaggtatttgtgttactcttttaaaaaagattttattttacagagagagagagagagaggacaagcagtgggagtggcagagggaggagcagattcccaatgagtagggagctcgaccctgtgatcatgacctaagctgaaggcagatgagtaactgagtcacccaagtgctggttttactttttttaaaaaactatatgttcatttcattgggcactgaggtattattttttacctggatttctctaatagcttgttttttaaaaattctaatgataattttcatattaaatactttcaaatttacagaactattataagaatagtcctctaagccatgtgggagggaactgccctagagcttacttccctcctgggataataaagagtctccttaaacacaatcatgtccaatgagataggaaaactgatttcttctttaatcatatttggtctattgagaatagtaataaaaattaaaaaaaaactagaaaaaataatactgtgaagttcaacagtttattctttaatgcgtattatcttcaagacatgaagaacgaaaactatgttttaaatctttgttgtctgactttactgtctccatacctctggtggctgctggacagaacacattaattaacagaactgaggggatccctgggtggctcagcagtttggcgcctgcctttggcccagggtatgatcctggagtcccgggatcaagtcccacgtcgggctccctgcatggagcctgcttctccctctgcctgtgtctcaacctctctctgtgtgtctcatgaataaataaataaaatctttaaaacaaaacaaaacaaaacaaaaaaacccaaaattgataggtttagtagattggtagataagggtacttactggtagagatctagtgtgtctagatttgtgcaaggcatctgataaaaccttccttaatacctgttatttaagggatgcctagatggctcagtggttgattgtctgcctttggctcaggttgtggtcctgggatcctgggattgagtcctgcatcgggttcctcacaaggagtctgcttatccctctgcctatgtctctgtctctctctgtgtgtctctcacaaataaataaaatcttaaaaaataaataacaaaaagcccgttatttaagtggcaggatagaggtgtgtgtaccgggtgatcagattaggcaagtaggaggaccacagctggttagacaaccatttcctggagatcaatgtgtggtcctccaaccacagggaagcctggtcacaatgcttccttctgacactctcctgtgtaatcctttgagtgtggagaaacacaaaaactagcttacaaagtctgtagcagcagcaacctgggaatgaaaactgactagatgacagaatcattctttgaaggttattatttgcaagtaatgaacccaagttaatgaaatgaaaatgtatgcataatagatatttataatttgggttgcctagcatctaaaagcttttcctatttgggaggaatcctaagataatgataaggaagcagctacctctttgactacagaaactaaaagggcagctatccccctgggagcacaagcaaggacaagacctaagacacctaatcaaatgctgccacgtgggactttgtatcctgaagggtaatgacacggctcaggtcaattaggtgtgctcagggtggctctgcaggggaaaagttaggggtgtgtgtggtctagaagaatgaggtgcatgtctagacagcagaatgcagcacaggagtggtaggtgtccagtggtggtgaggccagtcttggggcagtgactacctactggcaagtggcacattctgagcagcctgctcctgtggtgaaaactcagctgggccttacttcccttggctcctcctgtctttctcggagccacaggaatcaaaatacatcccattgctgcttaaggaatcatagttgtcttctgttttataatcaaaaaccttgttgagtataacatatctgagctcaggatccaaaaatcaactaagaagagctggatacttggcagttcatgtgacaaagacatagtgaactgtgacataataggtatcaatcaatcaatcaatcaatcaatcaaaataaaaaataaaaaataaaatagcgtggctgccagagtgctacaatggacagggcaaagacaatcagagatcatattactcaatattctgcttttgttaactatcactagagtgtattttgctgttccaactattttcttttaaggccaatggggacagactgaaatatgtatggtagaagagtgaccaggaggttgatgagtctttgtatgaggagctggagaaatttaacttagaaaagccacagggaggggcagcctgggtggctcagcagttttagtgccctcttcagcccagggcatgatcctagagacctgggatcgagtctcacgtcaggttccctgcatggagcctgcttctccctctgcctgtgtctctgcccttctctctctctctctctctgtctctctcatgaataaataagtaaaatcttatatatataaaaaaagccacagggaagacattctgggattctttccaattatgttgctgagataattttataaaaatctaatgataaagacagatgcaaaatgaactaaaaaataaaaatgttccccaaccagcattaagctctgtgtatatatcacaaaaggtgagagaaagtaagggctgagaattttcagatgggacaaggataagaagtgaatgttgtttcttcttctatcactagtagaatgagcattggagggaccattttccaggctccagttagactaacacctttctcctgggcacttccccctttttaaaaagattttattcatttgatagagagagaggagagagagagagagagagagagattgagacagcacaagcaggaggagcagcagagggagaagtaggctctttgctgatcagggagcctgatggagggctcaatcccaggaccttgggatcatgacctgagccaaaggcagatgtgtaactgattgagccacccaagtgcccttctcttgggggcccttattcacagggtgtagatatcttttacttcaacagtgttcctaaactattgttccagagacttcagatgactcaccttttccactgtagaagaaaatacaagatctaaatgtactgaaatattccaaagatatcctgttgtatactatcatagtcttgcttgcctcctggtttctcatgtctcaaatgagtagcaagcctcaaaccctgttctttcctgtagtttcataataaatctaaggctgctttcatcatcagtgttcctggggataatgttgattattttgaattaactatttcaagtatgaaataaatgttatatatgagtatattacctgcatatttcttccaacttttatgtggaattgtcagaattaaataattacattttttgagaaattaaaacctctgaaggtaattaaactctcttgtaagctttatgcaaactggttctaccctcctaggatcccctggcatcaagaattgagagaggttaggaggaaatgaggcctccccaccttcaactcttcttggcacagcacccggaaccaagtcttctccccaggaatacaatcaggggattcaatactggcagggtttagagagtcaaacaagagctccattcaggctcctgagggttgctacaagtaatactgctgtgaatatcctgctggggacggagcatgcatattaaccagcttaacttttgttccttgtttttagagctatggcaaatgatctggatttagccattcctcttttcctctgtcctgccttacaacacatatatctctctgcaaagtctgattgagactagaagagcaatccgtaccaacagaacacggtgtgaactcctaggggtgagaggctggggagatagggagaggaggaggtatggtttatcaagtattctctctctagcacctaggacagtcaaagcacgcattaaaggactgctggattgaagtgaactaaaaggaatggaactacttggctcataataccaaaaccacacatagacaaggaatacgtgctaggtatctaaacaaattaatagagaaagaaaattttgcgcacagagaaaagctggggatgtatttttccttgatttccttgacctatggcataatcatttattaagaaataaaggaacagaggactgccatcttaaagaaagtcaataaaaacagcatccttttaactcctagtgtattagggtttgtttcttaggaaaaatgaattgtcaacaattctaaaatcaaaaatcgcaagacagttatcgtgatatttacctagaagaaaacaagaattaaagacttcatttatcctctctaaagtttaattctctctctctctctcttttataattatttatatgggggggagcaatagaaatggcatatcactttttatttattttatttaaacagtttcctaaattctacctatgcaggaattggcattattacactcaatacagtaaaaagaaggaatgcataatgaattagaaagacaaaaggtagtactggtaaataaatccaaaaaccaacaaaattaataatccattttctttttaatggagaaagcacacagactaaaaataggaaatggaggggtgcctgggtgactcagttggttacgtgtcctcctttggctagggttgtgatgggatcaagccctgagttgggctttctgttcagcggggagtttgcttctctctctccctgcagctcccccggcttgtgctctgtcaaataaataaatacaaatcttaaaaaaaaaaaaaggaaatggaaatggattaataatcacacacgtgggagaaattaaaagaattctaaaagttgattttgctcagccctatgcaaataaatacacaatatggatgaatttctagtgaaatattaattgccaatattgtccccagaagagacaatcaaaacagcaattactgagacaaatgttgagacttgttaacctccttaccgagagtaaacaactaaataatgccctggtcacagttgattttactagtaaattctacccactttgggcagccctggttggcgcagcggtttggagtcacctgcagcctggggtgtgattctggagacctgggatcgagtctcacgtggagcctgcttccctctgcctgtgtctctgcctctttctctctgtgtctatgaataaataaaatctttaataaataaataaataaataaaataaacaggtattttgtgaatgtagttggaggggcccagggcaggctgcaacagcatagtgattactttgaattgaatctatttgggaaacaaacaggacaaggacactcagaacttcttttgtctccctgaaagcagaaaacaaatctcccatatgaaaaatagcctccctgtactcagaggtaaaaagacatccttatcaacataaatagaggaataaagttgagaatgctataaaataagccttgctatttttttcactaattcactttctcaggctaaattctgcttagaatttactaattaaagctcccaaacttacctgtttattccgcaaaaatctatcatcctttgtctaaaatgtataaacactgggatgcctgggtggttcagtggttgagtgttcgcctttggctcagggaatggttctagggtcctgagatggagtcccacgttggacttccctgcatggagcctgtttcttcctctgcctgtgtctctgcctttctttctgtgtgtctctcatgcataaataaaatcttttaaaaaataaaaataaaaagtataaaaattgcctgccttggtcatttctttgggtctcaatttcattatgggggcatctgtttgcatgtaacaaaattttgtttttttcttctttaatctgtctcgggtaaatttaattcttagtccagctagaaggcctcgaggatagacaaagaattttccctcaccgttaaagtcaatggaatagattacagaatccagaaatagacttgtgaagaattttagcacaacgaaagtggcattttaattgaataggacaaggattgattattcaatacaaaaaggctggacagttaattgagtgactatgtaaaaaaacaaaacaaaacacaaattccttctatatctcaaaataaatttgagatcaacagatttaaatggtaacaaatgaatccctgagagtactagaaaaaaccatggaaacatttttatgagtaaattctttttttttttaatttttatttatttattcatgagagacagagagagagaggcagagacacaggcagagggagaagcaggctccatgcaggaagcccgatgtgggactcgatcctagaccctgggatcaggccctgagccaaaggcagacgctcaaccgctaagccacccaggcatcccttatgaataaattctttggaagaattttgggagttctttggaggaagcaagtattttaaagatctcagaagaaatgagaggtcttaaaaagccaaatttcctgaccaagagtttgagattgggttaggtgaaacctctgaaattctctccttagaagaaggagtggggaattccaagtactccccttgtgcctgcttagtgctgttgaggtaataagtgtattggcttatttcacaatctcactgtgcaaatcttgagtggagggaggaggtatagcctagatgtcagcgggattaccttctcctttgaaattagctggagcctcttgaattctcccttaaagaaatctgggtaatttatgtattttccaatccccttggcatttggaaattaatttcatttatctactgttttgcctaaccctgtgctgttagtattgtgcattgctttgtccccaagtgtggaatagccctccttccccttatattaacattcataaaagggatttacgtatggagcagactttacagaagtttgcttggtttccctttccctttgacacgctgtttgcatcttttcaccttaaatttaccaggactcttgtggctctttatgtattaactccgttctctttgcatgcagaactattttgatcttttccaggcttgcctttgcatatcccaaaactcacgggtatgttttgcaaaacaatgctcatgaacctcgagcctgccagtggtagtagtgctagcaaagacttttctttttggcctctatgtgaagtagggggctgatatttctactattgtccttagaaggcagaagtggctgcagttttgatcttacataatctgctttttcttcctcataaaatggaccagatttcatagccatcagagttacatttgctcctttgactaacattaatcactacataaaagaaacattccaaaggtaaaacaatacaaaatgacaaactcatttatggagttcctaggtcctgtgagaaagtgctcaaagtcccattaagcatatttgaatactattcctaaaatgtttagaccattcaaaaggcaggattcatgggcaagcattatgatttttaaatttactggttatttggctgacttgaagctacgtcagggccatcagttactgaaactctttcagaacactgagacagatagttaaattgtccttttaagagattctgaccctttattcctctaaatgtctgggtaagacatttctttcccgtttcttacattctaaattttccagtgtccacctctggaataataatcttatttatattgttcaacactctgaacagaataagaagcatttatattctgtggtatttagactgtggtatataaatttatcagaggttatttttcatattattttatttctgctatcagtgttatattgtttgttgtttcttaaaaaataaaaagccccagattttcgggtcagtaatttatgggcacaattttaaaaagtcaaaagacacaaatgactatatataactaaaagtgagtctcttccgctctgtccctcactaattctcttttgcagagaaaaccactaggattagtttcctttctgaaagatatactatctcccttcccccaagtatacattctatacactctacattccacattctatacatactgctctgcattttggtcttcacttaaccttacagcttaggaattgttccatatctgcacaaacaggattgtcttatctttatctttaagctgcacatcattccactttatgaaggtatcatcattcatttagctaatctgtcaatggacacttacattgcttctaatttttagttctcattaacatttctgccatcaattaccttatatgtaggtcattttgcatataagagaatatttgaagggtaaattagtaaaagcaagggtaaatattctcaattttgatagctattgccaattgccctccaaaggggtcatgtctattcatgtttccactagcaaatgtttgaaaatacctgtttgctactgacctgaccattagagcatgttttttttttttttttctgtcaatcttatagatgaaaagtgtaacttttagactcttctcactgaatgattcaaaatgccttctttatcatatactaaatttttctgatgcatttctgggctttctggtttattccattggcctctcttgtctcttcatatgctattactacagtttttaaaaaatattttatttatttattcttgagagacacagagagagggagaggcagagacacaggtagagggagaagcaggctccatgcagggagcctgatatgggactcgatcccaggtctccaggatcacaccctgggctgaaggcagcgctaaaccactgagccacccaggtggccctacagtttttttttttttttttttaaagattttatttatttattcatgagagacacagagagaggcagagggagaagcaggctccatgcagggagccccatgtgggacttgatcctgggaccccaggatcatgccctgaaccaaaggcagacactcaaccgctgagccaccctggcatccccatccctacagttttgatcacagtagctttatatcatgttttactttatagtagatctagtcacctttattgctcttcttttccctaagaaatttcctggctgttttttttttttttttcctacatgaatttgaaaaattgttttgcttaaaaaaaaaaatcctgctgcatttttgagattgtattacattaatttatttagagacactactactttttaaagtttatcattgcaggcttaccatttcttaccagtatcttttgggttatgtcttcctgatgctcataaccatgtcttacataaaatattttcttattaattcttcatagcatttttgaaaatagcagggaagatagaagataaagagattagcctaggattacatatgataaagagccttaatacagtgttttatctactatttggtaatgcctcaccagtagattttacacaaattcaaaaacaaaacaaacttttctaccaaggattaaattttcctgttgcaaaaaaaccagcaatgtgcaagaacaattctgcaatatatttctgtgtgatgatctgtggccaagcacagaatgcattcctatcatggagtaacaatttcaaaagaattttgaaaccagagttggcttggatgctatacaatgacacccaggatgttggcctacttccca

SEQ ID NO: 3 - DNA, 9 bp, Canine spp.
aaggagaaa

SEQ ID NO: 4 - DNA, 7 bp, Canine spp.
aggcaag

SEQ ID NO: 5 - DNA, 11 bp, Canine spp.
gcaggagggga

SEQ ID NO: 6 - DNA, 13 bp, Canine spp.
aaaacaggaagag

SEQ ID NO: 7 - DNA, 9 bp, Canine spp.
agaaagcga

SEQ ID NO: 8 - DNA, 22 bp, Canine spp.
aaggagaaagagagaatggaca

SEQ ID NO: 9 - DNA, 15 bp, Canine spp.
gaagagaaggacaga

SEQ ID NO: 10 - DNA, 23 bp, Canine spp.
ggaacaggaaaagagagggcgaa

SEQ ID NO: 11 - DNA, 16 bp, Canine spp.
cgggaaaaggggaggc

SEQ ID NO: 12 - DNA, 2 bp, Canine spp.
ag

SEQ ID NO: 13 - DNA, 6 bp, Canine spp.
aaaaag

SEQ ID NO: 14 - DNA, 6 bp, Canine spp.
aggaga

SEQ ID NO: 15 - DNA, 2 bp, Canine spp.
ag

SEQ ID NO: 16 - DNA, 14 bp, Canine spp.
aataaaagagacga

SEQ ID NO: 17 - DNA, 5 bp, Canine spp.
ggagg

SEQ ID NO: 18 - DNA, 6 bp, Canine spp.
gcaaag

SEQ ID NO: 19 - DNA, 11 bp, Canine spp.
ggcgagcaaaa

SEQ ID NO: 20 - DNA, 8 bp, Canine spp.
atgaaccg

SEQ ID NO: 21 - DNA, 4 bp, Canine spp.
ggca

SEQ ID NO: 22 - DNA, 6 bp, Canine spp.
gaaggg

SEQ ID NO: 23 - DNA, 2 bp, Canine spp.
ag

SEQ ID NO: 24 - DNA, 4 bp, Canine spp.
ggag

SEQ ID NO: 25 - DNA, 4 bp, Canine spp.
agaa

SEQ ID NO: 26 - DNA, 87 bp, Canine spp.
tcttcgcgcaattggacagcgcggcgggggtgttcgcggccgtgtcgagctgggccgagtaactgccaggaactggaacgtccccgg

SEQ ID NO: 27 - DNA, 88 bp, Canine spp.
tcttcgcgcaattggacagcgcggcgggggtgttcgcggccgtgtccgagctgggccgagtaactgccaggaactggaacgtccccgg
